(12) United States Patent
Bernett et al.

(10) Patent No.: US 10,787,518 B2
(45) Date of Patent: *Sep. 29, 2020

(54) BISPECIFIC CHECKPOINT INHIBITOR ANTIBODIES

(71) Applicant: Xencor, Inc., Monrovia, CA (US)

(72) Inventors: Matthew Bernett, Monrovia, CA (US);
Gregory Moore, Azusa, CA (US);
John Desjarlais, Pasadena, CA (US);
Michael Hedvat, Encino, CA (US);
Christine Bonzon, Los Angeles, CA (US); Alex Nisthal, Monrovia, CA (US)

(73) Assignee: Xencor, Inc., Monrovia, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 15/623,314

(22) Filed: Jun. 14, 2017

(65) Prior Publication Data

US 2018/0118836 A1 May 3, 2018

Related U.S. Application Data

(60) Provisional application No. 62/350,145, filed on Jun. 14, 2016, provisional application No. 62/353,511, filed on Jun. 22, 2016, provisional application No. 62/420,500, filed on Nov. 10, 2016.

(51) Int. Cl.
| | |
|---|---|
| *C07K 16/20* | (2006.01) |
| *C07K 16/30* | (2006.01) |
| *C07K 16/40* | (2006.01) |
| *C07K 16/28* | (2006.01) |
| *C07K 14/735* | (2006.01) |
| *C12N 15/861* | (2006.01) |
| *A61K 39/00* | (2006.01) |
| *A61P 35/00* | (2006.01) |

(52) U.S. Cl.
CPC .... *C07K 16/2863* (2013.01); *C07K 14/70535* (2013.01); *C07K 16/2803* (2013.01); *C07K 16/2818* (2013.01); *C12N 15/8613* (2013.01); *A61K 2039/505* (2013.01); *A61K 2039/572* (2013.01); *A61P 35/00* (2018.01); *C07K 2317/24* (2013.01); *C07K 2317/31* (2013.01); *C07K 2317/33* (2013.01); *C07K 2317/34* (2013.01); *C07K 2317/524* (2013.01); *C07K 2317/526* (2013.01); *C07K 2317/53* (2013.01); *C07K 2317/55* (2013.01); *C07K 2317/569* (2013.01); *C07K 2317/622* (2013.01); *C07K 2317/64* (2013.01); *C07K 2317/70* (2013.01); *C07K 2317/71* (2013.01); *C07K 2317/73* (2013.01); *C07K 2317/76* (2013.01); *C07K 2317/92* (2013.01); *C07K 2317/94* (2013.01)

(58) Field of Classification Search
CPC .................................................. C07K 16/2863
USPC ................. 424/133.1, 136.1, 178.1
See application file for complete search history.

(56) References Cited

U.S. PATENT DOCUMENTS

| | | | |
|---|---|---|---|
| 3,773,919 | A | 11/1973 | Boswell et al. |
| 4,169,888 | A | 11/1979 | Hanka et al. |
| 4,179,337 | A | 12/1979 | Davis et al. |
| 4,256,746 | A | 3/1981 | Miyashita et al. |
| 4,294,757 | A | 10/1981 | Asai |
| 4,301,144 | A | 11/1981 | Iwashita et al. |
| 4,307,016 | A | 12/1981 | Asai et al. |
| 4,313,946 | A | 2/1982 | Powell et al. |
| 4,315,929 | A | 2/1982 | Freedman et al. |
| 4,364,935 | A | 2/1982 | Kung et al. |
| 4,322,348 | A | 3/1982 | Asai et al. |
| 4,331,598 | A | 5/1982 | Hasegawa et al. |
| 4,361,650 | A | 5/1982 | Hasegawa et al. |
| 4,362,663 | A | 12/1982 | Kida et al. |
| 4,364,866 | A | 12/1982 | Asai et al. |
| 4,371,533 | A | 2/1983 | Akimoto et al. |
| 4,424,219 | A | 1/1984 | Hashimoto et al. |
| 4,450,254 | A | 5/1984 | Isley et al. |
| 4,496,689 | A | 1/1985 | Mitra |
| 4,640,835 | A | 2/1987 | Shimizu et al. |
| 4,670,417 | A | 6/1987 | Iwasaki et al. |
| 4,791,192 | A | 12/1988 | Nakagawa et al. |
| 4,880,935 | A | 11/1989 | Thorpe |
| 4,923,990 | A | 5/1990 | Nakano et al. |
| 4,943,533 | A | 7/1990 | Mendelsohn et al. |
| 4,970,198 | A | 11/1990 | Lee et al. |

(Continued)

FOREIGN PATENT DOCUMENTS

| | | |
|---|---|---|
| EP | 0425235 B1 | 9/1996 |
| EP | 1752471 | 2/2007 |

(Continued)

OTHER PUBLICATIONS

Sun et al., Anti-CD20/CD3 T cell-dependent bispecific antibody for the treatment of B cell malignancies., Science Translational Medicine May 13, 2015: vol. 7, Issue 287, pp. 287ra70DOI: 10.1126/scitranslmed.aaa480.

(Continued)

*Primary Examiner* — Lynn A Bristol

(74) *Attorney, Agent, or Firm* — Louis T. Nguyen; Robin M. Silva; Morgan, Lewis & Bockius LLP

(57) ABSTRACT

The present invention is directed to compositions that include programmed cell death 1 (PD-1) binding domains and antibodies that include such PD-1 binding domains. Also provided are nucleic acid compositions that encode the binding domains and antibodies, expression vector compositions that include the nucleic acids, and host cells that include the expression vector compositions.

19 Claims, 196 Drawing Sheets

Specification includes a Sequence Listing.

(56) References Cited

U.S. PATENT DOCUMENTS

| | | |
|---|---|---|
| 5,053,394 A | 10/1991 | Ellestad et al. |
| 5,070,092 A | 12/1991 | Kanda et al. |
| 5,084,468 A | 1/1992 | Saito et al. |
| 5,101,038 A | 3/1992 | Nakano et al. |
| 5,122,368 A | 6/1992 | Greenfield et al. |
| 5,187,186 A | 2/1993 | Kanda et al. |
| 5,208,020 A | 5/1993 | Chari et al. |
| 5,264,586 A | 11/1993 | Nicolaou et al. |
| 5,384,412 A | 1/1995 | Nicolaou et al. |
| 5,416,064 A | 5/1995 | Chari et al. |
| 5,475,092 A | 12/1995 | Chari et al. |
| 5,500,362 A | 3/1996 | Robinson et al. |
| 5,530,101 A | 6/1996 | Queen et al. |
| 5,541,087 A | 7/1996 | Lo et al. |
| 5,550,246 A | 8/1996 | Nicolaou et al. |
| 5,558,864 A | 9/1996 | Bendig et al. |
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 4/2003 | Mateo de Acosta del Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | Mack et al. |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,303,749 B1 | 12/2007 | Chari |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 8,063,187 B2 | 11/2011 | Chu et al. |
| 8,114,967 B2 | 2/2012 | Bhatt et al. |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,637,641 B2 | 1/2014 | Dahiyat et al. |
| 8,946,387 B2 | 2/2015 | Koenig et al. |
| 9,822,181 B2 | 11/2017 | Bonvini et al. |
| 9,856,327 B2 | 1/2018 | Bernett et al. |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0017979 A1 | 1/2003 | Mack et al. |
| 2003/0091561 A1 | 5/2003 | Van de Winekl |
| 2003/0223999 A1 | 12/2003 | Lindhofer |
| 2004/0018191 A1 | 1/2004 | Wang |
| 2004/0071696 A1 | 4/2004 | Adams et al. |
| 2004/0162411 A1 | 8/2004 | Lanzavecchia |
| 2004/0170626 A1 | 9/2004 | Schuurman |
| 2004/0242851 A1 | 12/2004 | Zhu |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0082213 A1 | 3/2009 | Horowitz et al. |
| 2009/0136485 A1 | 5/2009 | Chu et al. |
| 2009/0163699 A1 | 6/2009 | Desjarlais |
| 2009/0214539 A1 | 8/2009 | Grosmaire et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Senter |
| 2010/0004431 A1 | 1/2010 | Bernett et al. |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |

(56) References Cited

U.S. PATENT DOCUMENTS

| | | |
|---|---|---|
| 2011/0054151 A1 | 3/2011 | Lazar et al. |
| 2011/0076275 A1 | 3/2011 | Senter |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0121597 A1 | 5/2012 | Ho et al. |
| 2012/0149876 A1 | 6/2012 | Von Kreudenstein et al. |
| 2012/0156207 A1 | 6/2012 | Chu et al. |
| 2012/0251531 A1 | 10/2012 | Baehner et al. |
| 2012/0251541 A1 | 10/2012 | Baurin et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0115208 A1 | 5/2013 | Ho et al. |
| 2013/0129723 A1 | 5/2013 | Blakenship et al. |
| 2013/0142793 A1 | 6/2013 | Ledbetter et al. |
| 2013/0171095 A1 | 7/2013 | Bernett et al. |
| 2013/0195849 A1 | 8/2013 | Von Kreudenstein et al. |
| 2013/0209355 A1 | 8/2013 | De Weers et al. |
| 2013/0267686 A1 | 10/2013 | Brinkmann |
| 2013/0336981 A1 | 12/2013 | de Kruif et al. |
| 2014/0024111 A1 | 1/2014 | Kannan et al. |
| 2014/0056879 A1 | 2/2014 | Lazar |
| 2014/0072581 A1 | 3/2014 | Dixit et al. |
| 2014/0086916 A1 | 3/2014 | Zha |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0307629 A1 | 10/2015 | Bernett et al. |
| 2016/0060360 A1 | 3/2016 | Moore et al. |
| 2016/0068588 A1 | 3/2016 | Bernett et al. |
| 2016/0176969 A1 | 6/2016 | Bernett et al. |
| 2016/0215063 A1 | 7/2016 | Bernett et al. |
| 2016/0229924 A1 | 8/2016 | Bernett et al. |
| 2017/0020963 A1 | 1/2017 | Qu et al. |
| 2018/0118828 A1* | 5/2018 | Bernett ............ A61P 35/00 |
| 2018/0127501 A1* | 5/2018 | Bernett ............ C07K 16/2818 |
| 2019/0270816 A1* | 9/2019 | Bernett ............ A61P 37/06 |
| 2019/0382495 A1* | 12/2019 | Bernett ............ C07K 14/70535 |
| 2019/0389954 A1* | 12/2019 | Bernett ............ C07K 16/2863 |

FOREIGN PATENT DOCUMENTS

| | | |
|---|---|---|
| EP | 1829895 | 5/2007 |
| EP | 2006381 | 12/2008 |
| EP | 2009101 A1 | 12/2008 |
| EP | 2194066 | 6/2010 |
| EP | 2202245 A1 | 6/2010 |
| EP | 2522724 | 6/2011 |
| EP | 2155788 | 2/2014 |
| EP | 3252078 | 12/2017 |
| WO | WO8705330 | 9/1987 |
| WO | WO9211018 | 7/1992 |
| WO | WO9321232 | 10/1993 |
| WO | WO9413804 | 5/1994 |
| WO | WO9520045 | 1/1995 |
| WO | WO9640210 | 6/1996 |
| WO | WO96027011 | 9/1996 |
| WO | WO98050431 | 11/1998 |
| WO | WO199937791 | 7/1999 |
| WO | WO99054440 | 10/1999 |
| WO | WO99066951 | 12/1999 |
| WO | WO200061739 A1 | 10/2000 |
| WO | WO2011005621 | 1/2001 |
| WO | WO200124763 A2 | 4/2001 |
| WO | WO200129246 A1 | 4/2001 |
| WO | WO200162931 A1 | 8/2001 |
| WO | WO200188138 | 11/2001 |
| WO | WO2001083525 | 11/2001 |
| WO | WO2001090192 | 11/2001 |
| WO | WO200216368 | 2/2002 |
| WO | WO200230954 A1 | 4/2002 |
| WO | WO200231140 A1 | 4/2002 |
| WO | WO2002088172 A2 | 7/2002 |
| WO | WO2002062850 | 8/2002 |
| WO | WO2002083180 | 10/2002 |
| WO | WO2002098883 | 12/2002 |
| WO | WO2004010957 | 2/2004 |
| WO | WO2004043493 | 5/2004 |
| WO | WO2004103272 | 12/2004 |
| WO | WO2004106383 | 12/2004 |
| WO | WO2005063816 | 7/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006072620 | 7/2006 |
| WO | WO2006110476 A2 | 10/2006 |
| WO | WO2006106905 | 12/2006 |
| WO | WO2007005612 | 1/2007 |
| WO | WO2007018431 A2 | 2/2007 |
| WO | WO2007033230 | 3/2007 |
| WO | WO2007042261 | 4/2007 |
| WO | WO2007046006 | 4/2007 |
| WO | WO2007047829 | 4/2007 |
| WO | WO2007059404 A2 | 5/2007 |
| WO | WO2007062037 | 5/2007 |
| WO | WO2007084342 | 7/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO2007147901 | 12/2007 |
| WO | WO20070147901 | 12/2007 |
| WO | WO2008003103 | 1/2008 |
| WO | WO2008003115 | 1/2008 |
| WO | WO2008003116 | 1/2008 |
| WO | WO2008119096 | 10/2008 |
| WO | WO2008119566 | 10/2008 |
| WO | WO2008124858 | 10/2008 |
| WO | WO2008145142 | 12/2008 |
| WO | WO2008150494 | 12/2008 |
| WO | WO2009000006 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2013180201 | 6/2009 |
| WO | WO2009086320 | 7/2009 |
| WO | WO2009089004 | 7/2009 |
| WO | WO2009106096 | 9/2009 |
| WO | WO2009106321 | 9/2009 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |

(56) References Cited

FOREIGN PATENT DOCUMENTS

| | | |
|---|---|---|
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO2011133886 | 10/2010 |
| WO | WO20100112193 | 10/2010 |
| WO | WO2010136172 | 12/2010 |
| WO | WO2010151792 | 12/2010 |
| WO | WO2010151808 | 12/2010 |
| WO | WO2011036183 | 3/2011 |
| WO | WO2011066342 | 3/2011 |
| WO | WO2011051307 | 5/2011 |
| WO | WO2011063348 | 5/2011 |
| WO | WO2011066501 | 6/2011 |
| WO | WO2011121110 | 10/2011 |
| WO | WO2011131746 | 10/2011 |
| WO | WO2011143545 | 11/2011 |
| WO | WO2012016227 | 2/2012 |
| WO | WO2012018687 | 2/2012 |
| WO | WO2012032080 | 3/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2013006544 | 1/2013 |
| WO | WO2013016714 | 1/2013 |
| WO | WO2013026833 | 2/2013 |
| WO | WO2013033008 | 3/2013 |
| WO | WO2013047748 | 4/2013 |
| WO | WO2013055809 | 4/2013 |
| WO | WO2013063702 | 5/2013 |
| WO | WO2013096828 | 6/2013 |
| WO | WO2013125667 | 8/2013 |
| WO | WO2013164694 | 11/2013 |
| WO | WO2014004586 | 1/2014 |
| WO | WO2014012085 | 1/2014 |
| WO | WO2014047231 | 3/2014 |
| WO | WO2014056783 | 4/2014 |
| WO | WO2014079000 | 5/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014164553 | 10/2014 |
| WO | WO2014207064 | 12/2014 |
| WO | WO2014209804 | 12/2014 |
| WO | WO2015018528 | 2/2015 |
| WO | WO2015026892 | 2/2015 |
| WO | WO2015063339 | 5/2015 |
| WO | WO2015095392 | 6/2015 |
| WO | WO2015095410 | 6/2015 |
| WO | WO2015095423 | 6/2015 |
| WO | WO2015103072 | 7/2015 |
| WO | WO2015143079 | 9/2015 |
| WO | WO2015149077 | 10/2015 |
| WO | WO2016014984 | 1/2016 |
| WO | WO2016028896 | 2/2016 |
| WO | WO2016079050 | 5/2016 |
| WO | WO2016086186 | 6/2016 |
| WO | WO2016086189 | 6/2016 |
| WO | WO2016086196 | 6/2016 |
| WO | WO2016105450 | 6/2016 |
| WO | WO2016110584 | 7/2016 |
| WO | WO2016115274 | 7/2016 |
| WO | WO2016120789 | 8/2016 |
| WO | WO2016182751 | 11/2016 |
| WO | WO2017112775 | 6/2017 |
| WO | WO2017210485 | 12/2017 |
| WO | WO2017214092 | 12/2017 |
| WO | WO2018041838 | 3/2018 |
| WO | WO2019050521 | 3/2019 |

OTHER PUBLICATIONS

Capizzi et al., Curative chemotherapy for acute myeloid leukemia: the development of high-dose ara-C from the laboratory to bedside., Invest New Drugs. 1996;14(3):249-56.

Giles et al., Intravenous corticosteroids to reduce gemtuzumab ozogamicin infusion reactions. Ann Pharmacother. Sep. 2003;37(9):1182-5.

Duong et al., Targeted treatment of acute myeloid leukemia in older adults: role of gemtuzumab ozogamicin., Clin Interv Aging. 2009;4:197-205. Epub May 14, 2009.

Chu et al., Immunotherapy with Long-Lived Anti-CD123 x Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.

Muramatsu et al., Production and characterization of an active single-chain variable fragment antibody recognizing CD25., Cancer Lett. Jul. 28, 2005;225(2):225-36. Epub Jan. 23, 2005.

Sforzini et al., Targeting of saporin to Hodgkin's lymphoma cells by anti-CD30 and anti-CD25 bispecific antibodies., Br J Haematol. Sep. 1998;102(4):1061-8.

Sun et al., Preclinical Characterization of Combinability and Potential Synergy of Anti-CD20/CD3 T-Cell Dependent Bispecific Antibody with Chemotherapy and PD-1/PD-L1 Blockade., Blood 2016 128:4168.

Zhang et al., The development of bispecific antibodies and their applications in tumor immune escape., Experimental Hematology & Oncology20176:12.

Krupka et al., Blockade of the PD-1/PD-L1 axis augments lysis of AML cells by the CD33/CD3 BiTE antibody construct AMG 330: reversing a T-cell-induced immune escape mechanism., Leukemia. Feb. 2016;30(2):484-91. doi: 10.1038/leu.2015.214. Epub Aug. 4, 2015.

Osada et al., CEA/CD3-bispecific T cell-engaging (BiTE) antibody-mediated T lymphocyte cytotoxicity maximized by inhibition of both PD1 and PD-L1., Cancer Immunol Immunother. Jun. 2015;64(6):677-88. doi: 10.1007/s00262-015-1671-y. Epub Mar. 6, 2015.

Masarova et al., Immune Checkpoint Approaches in AML and MDS: A Next Frontier., The Journal of Targeted Therapies in Cancer, Mar. 6, 2017 (Mar. 6, 2017), XP002784099.

Gantke et al., Trispecific antibodies for CD16A-directed NK cell engagement and dual-targeting of tumor cells., Protein Eng Des Sel. Sep. 1, 2017;30(9):673-684. doi: 10.1093/protein/gzx043.

U.S. Appl. No. 12/875,015, 2011-0054151, U.S. Pat. No. 9,493,578, filed Sep. 2, 2010, Mar. 3, 2011, Nov. 15, 2016.

U.S. Appl. No. 15/279,266, 2017-0058053, filed Sep. 28, 2016, Mar. 2, 2017.

U.S. Appl. No. 13/648,951, 2013-0171095, filed Oct. 10, 2012, Jul. 4, 2013.

U.S. Appl. No. 13/194,904, 2012-0028304, U.S. Pat. No. 8,637,641, filed Jul. 29, 2011, Feb. 2, 2012, Jan. 28, 2014.

U.S. Appl. No. 14/165,487, 2014-0249297, U.S. Pat. No. 9,605,061, filed Jan. 27, 2014, Sep. 4, 2014, Mar. 28, 2017.

U.S. Appl. No. 15/444,087, 2017-0174757, filed Feb. 27, 2017, Jun. 22, 2017.

U.S. Appl. No. 13/568,028, filed Aug. 6, 2012.

U.S. Appl. No. 14/853,622, 2016-0068588, filed Sep. 14, 2015, Mar. 10, 2016.

U.S. Appl. No. 13/887,234, filed May 3, 2013.

U.S. Appl. No. 14/156,431, 2014-0212435, filed Jan. 15, 2014, Jul. 31, 2014.

U.S. Appl. No. 14/156,432, 2014-0212436, filed Jan. 15, 2014, Jul. 31, 2014.

U.S. Appl. No. 14/808,826, 2016-0060360, U.S. Pat. No. 9,738,722, filed Jul. 24, 2015, Mar. 3, 2016, Aug. 22, 2017.

U.S. Appl. No. 15/682,380, filed Aug. 21, 2017.

(56) References Cited

OTHER PUBLICATIONS

U.S. Appl. No. 14/155,248, 2014-0322217, filed Jan. 14, 2014, Oct. 30, 2014.
U.S. Appl. No. 14/155,334, 2014-0370013, filed Jan. 14, 2014, Dec. 18, 2014.
U.S. Appl. No. 14/155,344, 2014-0294833, U.S. Pat. No. 9,701,759, filed Jan. 14, 2014, Oct. 2, 2014, Jul. 11, 2017.
U.S. Appl. No. 14/205,227, 2014-0294835, filed Mar. 11, 2014, Oct. 2, 2014.
U.S. Appl. No. 14/205,248, 2014-0288275, U.S. Pat. No. 9,650,446, filed Mar. 11, 2014, Sep. 25, 2014, May 16, 2017.
U.S. Appl. No. 15/589,908, filed May 8, 2017.
U.S. Appl. No. 14/214,418, 2014-0356381, filed Mar. 14, 2014, Dec. 4, 2014.
U.S. Appl. No. 14/214,475, 2014-0294836, filed Mar. 14, 2014, Oct. 2, 2014.
U.S. Appl. No. 14/217,166, 2014-0294759, filed Mar. 17, 2014, Oct. 2, 2014.
U.S. Appl. No. 14/200,652, 2014-0302064, filed Mar. 7, 2014, Oct. 9, 2014.
U.S. Appl. No. 14/207,489, 2014-0377270, filed Mar. 12, 2014, Dec. 25, 2014.
U.S. Appl. No. 14/200,821, 2014-0294823, U.S. Pat. No. 9,605,084, filed Mar. 7, 2014, Oct. 2, 2014, Mar. 28, 2017.
U.S. Appl. No. 14/216,705, 2014-0363426, filed Mar. 17, 2014, Dec. 11, 2014.
U.S. Appl. No. 15/444,026, 2018-0037668, filed Feb. 27, 2017, Feb. 8, 2018.
U.S. Appl. No. 14/673,695, 2015-0307629, filed Mar. 30, 2015, Oct. 29, 2015.
U.S. Appl. No. 15/786,252, 2018-0094079, filed Oct. 17, 2017, Apr. 5, 2018.
U.S. Appl. No. 14/952,705, 2016-0176969, filed Nov. 25, 2015, Jun. 23, 2016.
U.S. Appl. No. 14/952,714, 2016-0229924, filed Nov. 25, 2015, Aug. 11, 2016.
U.S. Appl. No. 15/141,350, 2016-0355608, filed Apr. 28, 2016, Dec. 8, 2016.
U.S. Appl. No. 14/952,786, 2016-0215063, filed Nov. 25, 2015, Jul. 28, 2016.
U.S. Appl. No. 14/757,809, 2016-0355600, filed Dec. 22, 2015, Dec. 8, 2016.
U.S. Appl. No. 15/063,441, 2017-0037131, filed Mar. 7, 2016, Feb. 9, 2017.
U.S. Appl. No. 15/372,360, 2017-0320947, filed Dec. 7, 2016, Nov. 9, 2017.
U.S. Appl. No. 15/623,314, 2018-0118836, filed Jun. 14, 2017, May 3, 2018.
U.S. Appl. No. 15/611,361, 2017-0349660, filed Jun. 1, 2017, Dec. 7, 2017.
U.S. Appl. No. 15/611,683, 2017-0349657, filed Jun. 1, 2017, Dec. 7, 2017.
U.S. Appl. No. 15/636,590, 2018-0118827, filed Jun. 28, 2017, May 3, 2018.
U.S. Appl. No. 15/185,958, 2017-0081420, U.S. Pat. No. 9,850,320, filed Jun. 17, 2016, Mar. 23, 2017, Dec. 26, 2017.
U.S. Appl. No. 15/186,167, 2017-0081424, U.S. Pat. No. 9,856,327, filed Jun. 17, 2016, Mar. 23, 2017, Jan. 2, 2018.
U.S. Appl. No. 15/691,665, 2018-0127501, filed Aug. 30, 2017, May 10, 2018.
U.S. Appl. No. 15/785,401, 2018-0118805, filed Oct. 16, 2017, May 3, 2018.
U.S. Appl. No. 15/785,393, 2018-0118828, filed Oct. 16, 2017, May 3, 2018.
U.S. Appl. No. 12/631,508, filed Dec. 4, 2009, Chari et al.
(No Author Name) "A method for making multispecific antibodies having heteromultimeric and common components", Expert Opinion on Therapeutic Patents, Genentech, Inc. (1999) 9(6): 785-790, pp. 785-790.
"Polythene Glycol and Derivatives for Advanced PEGylation", Catalog 2005-2006, Nektar Therapeutics.
"Xencor Provides Data Updates on XmaB Bispecific Antibody Program and Announces Presentations at Upcoming American Society of Hematology 2014 Annual Meeting", Nov. 6, 2014, XP055255549, retrieved from the internet: http://files.shareholder.com/downloads/AMDA-2B2V8N/0x0x792404/77590b72-837a-4085-bc55-78fa500638dc/XNCR_News_2014_11_6_General_Releases.pdf.
Abbott Laboratories, Strategies and Current Approaches for Improving Drug-Like-Properties During Biologics Drug Candidate Selection, AAPS Webinar—Nov. 10, 2011.
Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.
Alberola-Ila et al., Stimulation Through the TCR/CD3 Complex Up-Regulates the CD2 Srface Expression on Human T Lymphocytes, Feb. 15, 1991.
Alibaud et al., A New Monoclonal Anti-CD3? Antibody Reactive on Paraffin Sections, Journal of Histochemistry & Cytochemistry, 2000, vol. 48, p. 1609.
An, et al., IgG2m4, an engineered antibody isotype with reduced Fc function, mAbs, 2009, vol. 1, Issue 6, pp. 572-579, www.landesbioscience.com/journals/mabs/article/10185.
Aplin et al., , Preparation, properties, and applications of carbohydrate conjugates of proteins and lipids, 1981, CRC Crit. Rev. Biochem., pp. 259-306.
Arnett, et al., Crystal structure of a human CD3-ε/δ dimer in complex with a UCHT1 single-chain antibody fragment, PNAS, 2004, vol. 101, No. 46, pp. 16268-16273.
Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.
Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.
Atwell, et al., Stable Heterodimers from Remodeling the Domain Interface of a Homodimer using a Phage Display Library, J. Mol. Biol., 1997, vol. 270, pp. 26-35.
Baca et al., Antibody humanization using monovalent phage display, 1997, J. Biol. Chem. 272(16):10678-10684.
Baeuerle, et al., Response to Letter, "Correct TandAb protein," Molecular Immunology, 2007, vol. 44, p. 3084.
Baeuerle, et al., Review—Bispecific T-Cell Engaging Antibodies for Cancer Therapy, Cancer Res, 2009, vol. 69: (12), pp. 4941-4944.
Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.
Bargou et al., Tumor Regression in Cancer Patients by Very Low Doses of a T Cell-Engaging Antibody, Science, 2008, vol. 321, pp. 974-977.
Bhatt, Sea Lane—DDD presentation, "Surrobodies™—A Novel Approach to Bispecifics . . . ," Aug. 8, 2012.
Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.
Biochemica, Your apoptosis specialist, 1999, No. 2, pp. 34-37 (Roche Molecular Biochemicals).
Bird et al., Single-chain antigen-binding proteins, 1988, Science 242:423-426.
Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.
Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.

(56) References Cited

OTHER PUBLICATIONS

Bortoletto, Nicola et al., "Optimizing anti-CD3 affinity for effective T cell targeting against tumor cells.", Eur J Immunol. Nov. 2002;32(11):3102-7.
Boswell et al., Effects of Charge on Antibody Tissue Distribution and Pharmacokinetics, 2010, Bioconjugate Chem, 21(21):2153-2163.
Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.
Brinkmann , et al., presentation slideshow—"Roche Penzberg & Roche Glycart, Schlieren: Centers of Excellence for Recombinant Proteins".
Brinkmann, et al., A recombinant immunotoxin containing a disulfide-stabilized Fv fragment, Proc. Natl. Acad. Sci. USA, 1993, vol. 90, pp. 7538-7542.
Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.
Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.
Carter et al., Antibody-drug conjugates for cancer therapy, 2008, Cancer J. 14(3):154-169.
Carter et al., Humanization of an anti-p185HER2 antibody for human cancer therapy, 1992, Proc Natl Acad Sci USA 89:4285-9.
Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.
Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.
Chames et al., Bispecific antibodies for cancer therapy—The light at the end of the tunnel?, mAbs, 2009, vol. 1, Issue 6, pp. 1-9.
Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.
Chari et al., Immunoconjugates containing novel maytansinoids: promising anticancer drugs, 1992, Cancer Research 52: 127-131.
Chatal, 1989, Monoclonal Antibodies in Immunoscintigraphy, CRC Press (Book Abstract).
Chelius, et al., Structural and functional characterization of the trifunctional antibody catumaxomab, mAbs, 2010, vol. 2, Issue 3, pp. 309-319.
Chothia et al., Canonical structures for the hypervariable regions of immunoglobulins, 1987, J. Mol. Biol. 196:901-917.
Chothia et al., Structural Determinants in the Sequences of Immunoglobulin Variable Domain, J. Mol. Biol., 1998, vol. 278, pp. 457-479.
Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011. 11.029. Epub Jan. 16, 2012.
Conrad, et al., TCR and CD3 Antibody Cross-Reactivity in 44 Species, Cytometry Part A, 2007, vol. 71A, pp. 925-933.
Conrath, et al., Antigen Binding and Solubility Effects upon the Veneering of a Camel VHH in Framework-2 to Mimic a VH, J. Mol. Biol. , 2005, vol. 350, pp. 112-125.
Counterman et al., "Volumes of Individual Amino Acid Residues in Gas-Phase Peptide Ions.", J. Am. Chem. Soc., 1999, 121 (16), pp. 4031-4039.
Cuesta, et al., Multivalent antibodies: when design surpasses evolution, Trends in Biotechnology, 2010, vol. 28, No. 7, pp. 355-362, doi:10.1016/j.tibtech.2010.03.007.
D'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.
Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.
Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.
Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.
De Groot et al., De-Immunization of Therapeutic Proteins by T-Cell Epitope Modification, 2005, Dev. In Biologicals, 2005, 122:171-194.
De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.
Del Nagro et al., A critical role for complement C3d and the B cell coreceptor (CD19/CD21) complex in the initiation of inflammatory arthritis., J Immunol. Oct. 15, 2005;175(8):5379-89.
Demarest et al., Antibody therapeutics, antibody engineering, and the merits of protein stability, Current Opinin in Drug Discovery & Development, 2008 11(5): 675-587, Sep. 11, 2008.
Deyev, et al., Multivalency: the hallmark of antibodies used for optimization of tumor targeting by design, BioEssays, 2008, vol. 30, pp. 904-918.
DiGiammarino et al., Ligand association rates to the inner-variable-domain of a dual-variable-domain immunoglobulin are significantly impacted by linker design, mAbs3:5, Sep.-Oct. 1-8; 3(5):487-94, Landes Bioscience, Sep. 1, 2011.
Dixon, et al., Activation of Human T Lymphocytes by Crosslinking of Anti-CD3 Monoclonal Antibodies, Journal of Leukocyte Biology, 1989, vol. 46, pp. 214-220.
Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.
Doronina , Development of potent monoclonal antibody auristatin conjugates for cancer therapy, 2003, Nat Biotechnol 21(7):778-784.
Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.
Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.
Dubowchik et al., Receptor-mediated and enzyme-dependent targeting of cytotoxic anticancer drugs, 1999, Pharm. Therapeutics 83:67-123.
Ducry et al., Antibody-drug conjugates: linking cytotoxic payloads to monoclonal antibodies, 2010, Bioconjugate Chem. 21:5-13.
Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.
Duke, et al., Measurement of apoptosis and other forms of cell death, 2004, Curr protocols immunol. 3.17.1-3.17.16.
DukSin et al., Relationship of the structure and biological activity of the natural homologues of tunicamycin, 1982, J. Biol. Chem. 257:3105.
Duval, et al., A Bispecific Antibody Composed of a Nonneutralizing Antibody to the gp41 Immunodominant Region and an Anti-CD89

(56) References Cited

OTHER PUBLICATIONS

Antibody Directs Broad Human Immunodeficiency Virus Destruction by Neutrophils, Journal of Virology, 2008, pp. 4671-4674, doi:10.1128/JVI.02499-07.
Edge et al., Deglycosylation of glycoproteins by trifluoromethanesulfonic acid, 1981, Anal. Biochem. 118:131.
Elliott, et al., Antiparallel Conformation of Knob and Hole Aglycosylated Half-Antibody Homodimers Is Mediated by a CH2—CH3 Hydrophobic Interaction, Journal of Molecular Biology, 2014, vol. 426, Issue 9, pp. 1947-1957.
Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.
Feldmann et al., Retargeting of T Cells to Prostate Stem Cell Antigen Expressing Tumor Cells: Comparison of Different Antibody Formats, Dec. 28, 2010.
Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.
Fischer, Nicolas et al., "Bispecifc antibodies: molecules that enable novel therapeutic strategies", 2007, vol. 74, pp. 3-14.
Foreman, et al., ErbB3 Inhibitory Surrobodies Inhibit Tumor Cell Proliferation In Vitro and In Vivo, Mol Cancer Ther, 2012, vol. 11(7), pp. 1411-1420.
Foreman, et al., PEGS poster, "ErbB3 Inhibitory Surrobodies Inhibit Tumor Cell Proliferation In Vitro and In Vivo," 2012.
Fraker et al., Crystal structure of peptide cyclo-(D-VAL-L-PRO-L-VAL-D-PRO)$_3$, 1978, Biochem. Biophys. Res. Commun. 80(4):849-57.
Francois, et al., Construction of a Bispecific Antibody Reacting with the α- and β-Chains of the Human IL-2 Receptor, The Journal of Immunology, May 15, 1993, vol. 150, No. 10, pp. 4610-4619.
F-star Modular Antibodies Fact Sheet, Apr. 2008, "Modular Antibody Technology" (w/ reference to Ruker WO 2006/072620 A1).
F-star Modular Antibodies Press Release, Mar. 28, 2008, "Antibody Engineering Company F-Star Buys Back Royalty Obligations. TVM Capital Joins Investor Syndicate."
Fudenberg, et al., Serologic Demonstration of Dual Specificity of Rabbit Bivalent Hybrid Antibody, The Journal of Experimental Medicine, 1964, vol. 119(1), pp. 151-166.
Ganesan, et al., FcγRIIb on Liver Sinusoidal Endothelium Clears Small Immune Complexes, The Journal of Immunology, Nov. 15, 2012, vol. 189 No. 10, pp. 4981-4988.
GenBank AAA38124.1, immunoglobulin heavy-chain VJ region [*Mus musculus*] Protein/NCBI.
GenBank AAA39180.1, immunoglobulin light-chain VJ region [*Mus musculus*] Protein/NCBI.
Ghendler et al., One of the CD3ε Subunits within a T Cell Receptor Complex Lies in Close Proximity to the Cβ FG Loop, J. Exp. Med., 1998, vol. 187, No. 9. pp. 1529-1536.
Ghetie et al., Multiple roles for the major histocompatibility complex Class I-related receptor FcRn, 2000, Annu Rev Immunol 18:739-766.
Gilliland, et al., Universal bispecific antibody for targeting tumor cells for destruction by cytotoxic T cells, Proc. Natl. Acad. Sci. USA, 1988, vol. 85, pp. 7719-7723.
Gorman et al., Reshaping a therapeutic CD4 antibody, Proc. Natl. Acad. Sci. USA 88:4181-4185.
Grodzki & Bernstein, "Antibody Purification: Ion-Exchange Chromatography.", Methods Mol Biol 2010 ;588:27-32.
Gunasekaran et al., Enhancing Antibody Fc Heterodimer Formation through Electrostatic Steering Effects, Journal of Biological Chemimstry, vol. 285, No. 25, pp. 19637-10946, Apr. 16, 2010 & Supplementary Tables.
Haagen, et al., The Efficacy of CD3 x CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.

Hakimuddin et al., A chemical method for the deglycosylation of proteins, 1987, Arch. Biochem. Biophys. 259:52.
Hamel, et al., The Role of the $V_L$- and $V_H$-Segments in the Preferential Reassociation of Immunoglobulin Subunits, Molecular Immunology, 1986, vol. 23, No. 5, pp. 503-510.
Hawkins et al, Selection of phage antibodies by binding affinity mimicking affinity maturation, 1992, J. Mol. Biol. 226:889-896.
Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.
He et al., Humanization and pharmacokinetics of a monoclonal antibody with specificity for both E- and P-selectin, 1998, J. Immunol. 160:1029-1035.
Hennecke et al., "Non-repetitive single-chain Fv linkers selected by selectively infective phage (SIP) technology.", Protein Eng. May 1998;11(5):405-10.
Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.
Hexham, et al., Influence of relative binding affinity on efficacy in a panel of anti-CD3 scFv immunotoxins, Molecular Immunology, 2001, vol. 38, pp. 397-408.
Hinman et al., Preparation and characterization of monoclonal antibody conjugates of the calicheamicins: a novel and potent family of antitumor antibodies, 1993 Cancer Res. 53:3336-3342.
Hoffmann, et al., Serial killing of tumor cells by cytotoxic T cells redirected with a CD19-/CD3-bispecific single-chain antibody construct, Int. J. Cancer, 2005, vol. 115, pp. 98-104.
Holliger et al., "Diabodies": Small Bivalent and bispecific antibody fragments, 1993, Proc. Natl. Acad. Sci. U.S.A. 90:6444-6448.
Holliger et al., Engineering bispecific antibodies, 1993, Current Opinion Biotechnol. 4:446-449.
Houtenbos, et al., The novel bispecific diabody αCD40/αCD28 strengthens leukaemic dendritic cell-induced T-cell reactivity, British Journal of Haematology, 2008, vol. 142, pp. 273-283.
Hu et al., Minibody: A novel engineered anti-carcinoembryonic antigen antibody fragment (single-chain Fv-$C_H$3) which exhibits rapid, high-level targeting of xenografts, 1996, Cancer Res. 56:3055-3061.
Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Igawa et al., Reduced elimination of IgG antibodies by engineering the variable region, 2010, PEDS. 23(5): 385-392.
Igawa, $V_H/V_L$ interface engineering to promote selective expression and inhibit conformational isomerization of thrombopoietin receptor agonist single-chain diabody, Protein Engineering, Design & Selection, 2010, vol. 23, No. 8, pp. 667-677.
Jackson et al., In vitro antibody maturation, 1995, J. Immunol. 154(7):3310-9.
Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.
Jefferis et al., Interaction sites on human IgG-Fc for FcγR: current models, 2002, Immunol Lett 82:57-65.
Jespers, et al., Crystal Structure of HEL4, a Soluble, Refoldable Human $V_H$ Single Domain with a Germ-line Scaffold, J. Mol. Biol., 2004, vol. 337, pp. 893-903.
Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.
Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.
Johnson et al., Anti-tumor activity of CC49-doxorubicin immunoconguates, 1995, Anticancer Res. 15:1387-93.
Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.

(56) References Cited

OTHER PUBLICATIONS

Jones et al., Replacing the complementarity-determining regions in a human antibody with those from a mouse, 1986, Nature 321:522-525.

Jordan et al., Structural understanding of stabilization patterns in engineered bispecific Ig-like antibody molecules, Proteins 2009; 77:832-841, Jun. 19, 2009.

Jung, et al., Design of interchain disulfide bonds in the framework region of the Fv fragment of the monoclonal antibody B3, Proteins, 1994, vol. 19(1), pp. 35-47.

Jung, et al., Target Cell-restricted Triggering of the CD95 (APO-1/Fas) Death Receptor with Bispecific Antibody Fragments, Cancer Research, 2001, vol. 61, pp. 1846-1848.

Jungbluth et al., A monoclonal antibody recognizing human cancers with amplification/overexpression of the human epidermal growth factor receptor, 2003, Proc Natl Acad Sci U S A. 100(2):639-44.

Kabat et al., 1991, Sequences of proteins of immunological interest, Department of Health and Human Services, Bethesda, vol. 1, $5^{th}$ Ed.

Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.

Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.

Kettleborough et al., Humanization of a mouse monoclonal antibody by CDR-grafting: the importance of framework residues on loop conformation, 1991, Protein Eng. 4(7):773-83.

Keyna, et al., Surrogate Light Chain-Dependent Selection of Ig Heavy Chain V Regions, J. Immunol., 1995, vol. 155, pp. 5536-5542.

Kiewe, et al., Phase I Trial of the Trifunctional Anti-HER2 x Anti-CD3 Antibody Ertumaxomab in Metastatic Breast Cancer, Clin Cancer Res., 2006, vol. 12(10), pp. 3085-3091.

Kim et al., "Localization of the site of murine IgG1 molecule that is involved in binding the murine intestinal Fc receptor," Eur. J. Immunol., 24:2429-2434, 1994.

Kipriyanov, et al., Bispecific CD3 x CD19 Diabody for T Cell-Mediated Lysis of Malignant Human B Cells, Int. J. Cancer, 1998. vol. 77, pp. 763-772.

Kipriyanov, et al., Bispecific Tandem Diabody for Tumor Therapy with Improved Antigen Binding and Pharmacokinetics, J. Mol. Biol., 1999, vol. 293, pp. 41-56.

Kipriyanov, et al., Effect of Domain Order on the Activity of Bacterially Produced Bispecific Single-chain Fv Antibodies, J. Mol. Biol., 2003, vol. 330, pp. 99-111.

Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.

Klein et al., Progression of metastatic human prostate cancer to androgen independence in immunodeficient SDIC mice, 1997, Nature Medicine 3: 402-408.

Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.

Klinger, et al., Immunopharmacologic response of patients with B-lineage acute lymphoblastic leukemia to continuous infusion of T cell-engaging CD19/CD3-bispecific BiTE antibody blinatumomab, Blood, 2012, vol. 119, No. 26, pp. 6226-6233.

Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.

Kostelny, et al., Formation of a Bispecific Antibody by the Use of Leucine Zippers, The Journal of Immunology 1992 vol. 148, pp. 1547-1553.

Krauss et al., Specificity grafting of human antibody frameworks selected from a phage display library: generation of a highly stable humanized anti-CD22 single-chain Fv fragment, 2003, Protein Engineering 16(10):753-759.

Krupka, et al., CD33 target validation and sustained depletion of AML blasts in long-term cultures by the bispecific T-cell-engaging antibody AMG 330, Blood, 2014, vol. 123, No. 3, pp. 356-365, Prepublished online Dec. 3, 2013; doi:10.1182/blood-2013-08-523548 & Data Supplement.

Kung, et al., Monoclonal Antibodies Defining Distinctive Human T Cell Surface Antigens, Science, 1979, vol. 206, pp. 347-349.

Kuppen, peter et al., The development and purification of a bispecific antibody for lymphokine-activated killer cell targeting against the rat colon carcinoma CC531., Cancer Immunol Immunother. Jun. 1993;36(6):403-8.

Labrijn, et al., Efficient generation of stable bispecific IgG1 by controlled Fab-arm exchange, www.pnas.org/cgi/doi/10.1073/pnas.1220145110 & Supporting Information.

Laszlo et al., Cellular determinants for preclinical activity of a novel CD33/CD3 bispecific T-cell engager (BiTE) antibody, AMG 330, against human AML, blood 2014 123: 554-561, Dec. 5, 2013.

Lau et al., Conjugation of Doxorubicin to monoclonal anti-carcinoembryonic antigen antibody via novel thiol-directed cross-linking regents, 1995, Bioorg-Med-Chem. 3(10):1299-1304.

Lau et al., Novel doxorubicin-monoclonal anti-carcinoembryonic antigen antibody immunoconjugate activity in vitro, 1995, Bioorg-Med-Chem. 3(10):1305-12.

Lazar Declaration, Dec. 27, 2010, pp. 1-4.

Lewis, et al., Generation of bispecific IgG antibodies by structure-based design of an orthogonal Fab interface, Nature Biotechnology, 2014, doi:10.1038/nbt.2797 & Supplemental Information.

Li, et al., Construction and characterization of a humanized anti-human CD3 monoclonal antibody 12F6 with effective immunoregulation functions, Immunology, 2005, vol. 116, pp. 487-498.

Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.

Ling, et al., Interspecies Scaling of Therapeutic Monoclonal Antibodies: Initial Look, J Clin Pharmacol, 2009, vol. 49, pp. 1382-1402, doi: 10.1177/0091270009337134.

Link, et al., Production and Characterization of a Bispecific IgG Capable of Inducing T-Cell-Mediated Lysis of Malignant B Cells, Blood, 1993, vol. 81, No. 12, pp. 3343-3349.

Linke, et al., Catumaxomab, Clinical development and future directions, mAbs, 2010, vol. 2, Issue 2, pp. 129-136.

Little, et al., Letter to the Editor, "Flawed TandAb production," Molecular Immunology, 2007, vol. 44, p. 3083.

Liu et al, Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.

Liu et al., Eradication of large colon tumor xenografts by targeted delivery of maytansinoids, 1996 Proc. Natl. Acad. Sci. USA 93:8618-8623.

Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.

Lode et al., Targeted therapy with a novel enediyene antibiotic calicheamicins $o^{51}{}_1$ effectively suppress growth and dissemination of liver metastases in a syngeneic model of murine neuroblastoma, 1998, Cancer Res. 58:2928.

Löffler, et al., A recombinant bispecific single-chain antibody, CD19×CD3, induces rapid, and high lymphoma-directed cytotoxicity by unstimulated T lymphocytes, Blood, 2000, vol. 95, No. 6, pp. 2098-2103.

Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.

(56) References Cited

OTHER PUBLICATIONS

Lu, et al., Di-diabody: a novel tetravalent bispecific antibody molecule by design, Journal of Immunological Methods, 2003, vol. 279, pp. 219-232.
Lu, et al., Fab-scFv fusion protein: an efficient approach to production of bispecific antibody fragments, Journal of Immunological Methods, 2002, vol. 267, pp. 213-226.
Lu, et al., The effect of variable domain orientation and arrangement on the antigen-binding activity of a recombinant human bispecific diabody, Biochemical and Biophysical Research Communications, 2004, vol. 318, pp. 507-513.
Lum, et al., The new face of bispecific antibodies: targeting cancer and much more, Experimental Hematology, 2006, vol. 34, pp. 1-6.
Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.
Lutterbuese, et al., T cell-engaging BiTE antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.
Ma, et al., Expression and Characterization of a Divalent Chimeric Anti-Human CD3 Single Chain Antibody, Scand.J.Immunol, 1996, vol. 43, pp. 134-139.
Mabry, et al., A dual-targeting PDGFRβ/VEGF—A molecule assembled from stable antibody fragments demonstrated anti-angiogenic activity in vitro and in vivo, mAbs, 2010, vol. 2, Issue 1, pp. 20-34; www.landesbioscience.com/journals/mabs/article/10498 & Supplemental Information.
Mabry, et al., Engineering of stable bispecific antibodies targeting IL-17A and IL-23, Protein Engineering, Design & Selection, 2009, vol. 23, No. 3, pp. 115-127; doi:10.1093/protein/gzp073 & Supplementary Figures 1-8.
Mack, et al., A small bispecific antibody construct expressed as a functional single-chain molecule with high tumor cell cytotoxicity, Proc. Natl. Acad. Sci. USA, 1995, vol. 92, pp. 7021-7025.
Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.
MacroGenics Factsheet, Dual Affinity Re-Targeting ("DART") Platform, 2010.
Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.
Mandler et al., Modifications in synthesis strategy improve the yield and efficacy of geldanamycin-herceptin immunoconjugates, 2002, Bioconjugate Chem. 13:786-791).
Mandler et al., Synthesis and evaluation of antiproliferative activity of a geldanaymcin-herceptin™ immunoconjugates, 2000, Bioorganic & Med. Chem. Letters 10:1025-1028.
Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.
Mandy, et al., Recombination of Univalent Subunits Derived from Rabbit Antibody, The Journal of Biological Chemistry, 1961, vol. 236, No. 12, pp. 3221-3226.
Marks et al., By-passing immunization: building high affinity human antibodies by chain shuffling, 1992, Biotechnology 10:779-783.
Martin, et al., Generation of the Germline Peripheral B Cell Repertoire: VH81X-λ B Cells Are Unable to Complete All Developmental Programs, J. Immunol., 1998, vol. 160, pp. 3748-3758.
Martinez, et al., Characterization of a novel modification on IgG2 light chain: Evidence for the presence of O-linked mannosylation, J. Chromatogr. A, 2007, vol. 1156 pp. 183-187.
Marvin, Bispecific antibodies for dual-modality cancer therapy: killing two signaling cascades with one stone, Curr Opin Drug Discov Devel, 2006, vol. 9(2), pp. 184-193.
Marvin, et al., Recombinant approaches to IgG-like bispecific antibodies, Acta Pharmacologica Sinica, 2005, vol. 26 (6), pp. 649-658.
Mateo et al, Humanization of a mouse nonoclonal antibody that blocks the epidermal growth factor receptor: recovery of antagonistic activity, 1997, Immunotechnology, 3(1):71-81.
McPhee, Engineering human immunodeficiency virus 1 protease heterodimers as macromolecular inhibitors of viral maturation, Proc. Natl. Acad. Sci. USA, 1996, vol. 93, pp. 11477-11481.
Meijer, et al., Isolation of Human Antibody Repertoires with Preservation of the Natural Heavy and Light Chain Pairing, J. Mol. Biol., 2006, vol. 358, pp. 764-772.
Merchant, et al., An efficient route to human bispecific IgG, Nature Biotechnology, 1998, vol. 16, pp. 677-681.
Mertens, Nico, "Tribodies: Fab-scFv fusion proteins as a platform to create multi-functional pharmaceuticals.", SpringerLink 2011, 135-149.
Metz, et al., Bispecific antibody derivatives with restricted binding functionalities that are activated by proteolytic processing, Protein Engineering, Design & Selection, 2012, vol. 25, No. 10, pp. 571-580.
Metz, et al., Bispecific digoxigenin-binding antibodies for targeted payload delivery, PNAS, 2011, vol. 108, No. 20, pp. 8194-8199.
Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.
Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.
Miller et al., Stability engineering of scFvs for the development of bispecific and multivalent antibodies, PEDS, 2010, vol. 23, No. 7, pp. 549-557 & Supplementary Data.
Miller, biogen idec Stability Engineering and Production of IgG-like Bispecifc Antibodies, AAPS National Biotechnology Conference, Jun. 24 to Jun. 27, 2007.
Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency".
Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.
Mimoto, et al., Novel asymmetrically engineered antibody Fc variant with superior FcγR binding affinity and specificity compared with afucosylated Fc variant, mAbs, 2013, vol. 5, Issue 2, pp. 229-236.
Modjtahedi et al, Phase I trial and tumour localization of the anti-EGFR monoclonal antibody ICR62 in head and neck or lung cancer, 1996, Br J Cancer, 73(2):228-35.
Modjtahedi et al, Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.
Modjtahedi et al., Antitumor activity of combinations of antibodies directed against different epitopes on the extracellular domain of the human EGF receptor, 1993, J. Cell Biophys. 1993, 22(1-3):129-46.
Modjtahedi et al., The human EGF receptor as a target for cancer therapy: six new rat mAbs against the receptor on the breast carcinoma MDA-MB 468, 1993, Br J Cancer. 1993, 67(2):247-53.
Mølhøj, et al., CD19-/CD3-bispecific antibody of the BiTE class is far superior to tandem diabody with respect to redirected tumor cell lysis, Molecular Immunology 2007, vol. 44, pp. 1935-1943.
Moore et al., Tuning T Cell Affinity Improves Efficacy and Safety of Anti-CD38 x Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.
Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.

(56) References Cited

OTHER PUBLICATIONS

Moore, et al., Application of dual affinity retargeting molecules to achieve optimal redirected T-cell killing of B-cell lymphoma, Blood, 2011, vol. 117, No. 17, pp. 4542-4551.

Moretti et al., BEAT® the bispecific challenge: a novel and efficient platform for the expression of bispecific IgGs. BMC Proceedings 2013 7(Suppl 6):O9.

Morrison, et al., News and Views: Two heads are better than one, Nature Biotechnology, 2007, vol. 25, No. 11, pp. 1233-1234.

Mosmann, 1983, Rapid colorimetric assay for cellular growth and survival: application to proliferation and cytotoxicity assays, J. Immunol. Methods 65:55-63.

Muda, et al., Therapeutic assessment of SEED: a new engineered antibody platform designed to generate mono and bispecific antibodies, Protein Engineering, Design & Selection, 2011, vol. 24, No. 5, pp. 447-454.

Murthy et al., Binding of an antagonistic monoclonal antibody to an intact and fragmented EGF-receptor polypeptide, 1987, Arch Biochem Biophys. 252(2):549-60.

Nagorsen, et al., Blinatumomab: A historical perspective, Pharmacology & Therapeutics, 2012, vol. 136, pp. 334-342, http://dx.doi.org/10.1016/j.pharmthera.2012.07.013.

Nelson, et al., Point of View: Antibody fragments—Hope and hype, mAbs, 2010, vol. 2, Issue 1, pp. 77-83.

Neville et al., Enhancement of immunotoxin efficacy by acid-cleavable cross-ling agents utilizing diphtheria toxin and toxin mutants, 1989, Biol. Chem. 264:14653-14661.

Nielsen, et al., Human T cells resistant to complement lysis by bivalent antibody can be efficiently lysed by dimers of monovalent antibody, Blood, 2002, vol. 100, No. 12, pp. 4067-4073.

Nisonoff, et al., Letters to the Editors: Recombination of a Mixture of Univalent Antibody Fragments of Different Specificity, Arch. Biochem. Biophys., 1961, pp. 460-462.

Nisonoff, et al., Quantitative Estimation of the Hybridization of Rabbit Antibodies, Nature, 1962, vol. 194, No. 4826, pp. 355-359.

North, et al., A New Clustering of Antibody CDR Loop Conformations, J. Mol. Biol., 2011, vol. 406, pp. 228-256, doi:10.1016/j.jmb.2010.10.030.

O'Connor et al., Humanization of an antibody against human protein C and calcium-dependence involving framework residues, 1998, Protein Eng 11:321-8.

Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.

Page et al., 1993, Intermantional. Journal of Oncology 3:473-476.

Panke, et al., Quantification of cell surface proteins with bispecific antibodies, Protein Engineering, Design & Selection, 2013, vol. 26, No. 10, pp. 645-654.

Pessano, et al., The T3/T cell receptor complex: antigenic distinction between the two 20-kd T3 (T3-δ and T3-ε) subunits, The EMBO Journal, 1985, vol. 4, No. 2, pp. 337-344.

Pettit et al., Antineoplastic agents 365. Dolastatin 10 SAR probes, 1998, Anti-Cancer Drug Design 13:243-277.

Pettit et al., Dolastatins 24. Synthesis of (−)-dolastatin 10.I X-ray molecular structure of N,N-dimethylvalyl-valyl-dolaisoleuine tert-butyl ester, 1996, J. Chem. Soc. Perkin Trans. 1 5:859-863.

Pettit et al., Specific activities of dolastatin 10 and peptide derivatives against Cryptococcus neoformans, 1998, Antimicrob. Agents Chemother. 42(11):2961-2965.

Pettit et al., Structure-activity studies with chiral isomers and with segments of the antimitotic marine peptide dolastation 10, 1989, J. Am. Chem. Soc. 111:5463-5465.

Pettit, et al., The dolastatins; 18: Sterospecific synthesis of dolaproine1, 1996, Synthesis 719-725.

Pichler et al., Differences of T-Cell Activation by the Anti-CD3 Antibodies Leu4 and BMA030, Mar. 30, 1987.

Potapov et al., Protein-Protein Recognition: Juxtaposition of Domain and Interface Cores in Immunoglobulins and Other Sandwich-like Proteins, J. Mol. Biol., 2004, vol. 342, pp. 665-679.

Presta et al., Humanization of an anti-vascular endothelial growth factor monoclonal antibody for the therapy of solid tumors and other disorders, 1997, Cancer Res.57(20):4593-9.

Queen et al., A humanized antibody that binds to the interleukin 2 receptor, 1989, Proc Natl Acad Sci, USA 86:10029-33.

Rader et al., A phage display approach for rapid antibody humanization: designed combinatorial V gene libraries, 1998, Proc. Natl. Acad. Sci. USA 95:8910-8915.

Raghavan et al., Fc receptors and their interactios with immunoglobulins, 1996, Annu Rev Cell Dev Biol 12:181-220.

Rattel, et al., AACR Poster, "Validation of Cynomolgus Monkeys as Relevant Species for Safety Assessment of a Novel Human BiTE Antibody Platform for Cancer Therapy," 2010.

Reddy et al., Elimination of Fc receptor-dependent effector functions of a modified IgG4 monoclonal antibody to human CD4., *J Immunol.* Feb. 15, 2000;164(4):1925-33.

Reiter et al., Disulfide stabilization of antibody Fv: computer predictions and experimental evaluation, Protein Eng., 1995, vol. 8(12), pp. 1323-1331.

Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.

Remington's Pharmaceutical Sciences 16th edition, Osol, A. Ed. (1980) (Book Abstract).

Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.

Ridgeway, et al., 'Knobs-into-holes' engineering of antibody CH3 domains for heavy chain heterodimerization, Protein Engineering,1996, vol. 9, No. 7, pp. 617-621.

Riechmann et al., Reshaping human antibodies for therapy, 1988, Nature 332:323-329.

Riethmüller, Symmetry breaking: bispecific antibodies, the beginnings, and 50 years on, Cancer Immunity, 2012, vol. 12, p. 12, pp. 1-7.

Rodeck et al., Interactions between growth factor receptors and corresponding monoclonal antibodies in human tumors, 1987, J Cell Biochem. 35(4):315-20.

Roguska et al., Humanization of murine monoclonal antibodies through variable domain resurfacing, 1994, Proc. Natl. Acad. Sci. USA 91:969-973.

Roosnek, et al., Triggering T Cells by Otherwise Inert Hybrid Anti-CD3/Antitumor Antibodies Requires Encounter with the Specific Target Cell, J. Exp. Med., 1989, vol. 170, pp. 297-302.

Roque et al., Antibodies and genetically engineered related molecules: production and purification, 2004, Biotechnol. Prog. 20:639-654.

Rose, et al., Mutation of Y407 in the CH3 domain dramatically alters glycosylation and structure of human IgG, mAbs, 2013, vol. 5, Issue 2, pp. 219-228.

Rose, et al., Quantitative Analysis of the Interaction Strength and Dynamics of Human IgG4 Half Molecules by Native Mass Spectrometry, Structure , 2011, vol. 19, pp. 1274-1282.

Rosok et al., A combinatorial library strategy for the rapid humanization of anticarcinoma BR 96 Fab, 1996, J. Biol. Chem. 271(37): 22611-22618.

Rossi, et al. A new class of bispecific antibodies to redirect T cells for cancer immunotherapy, mAbs 2014, vol. 6, Issue 2, pp. 381-391.

Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.

Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.

Röthlisberger, et al., Domain Interactions in the Fab Fragment: A Comparative Evaluation of the Single-chain Fv and Fab Format Engineered with Variable Domains of Different Stability, J. Mol. Biol. , 2005, vol. 347, pp. 773-789.

(56) References Cited

OTHER PUBLICATIONS

Salmeron et al., A conformational epitope expressed upon association of CD3-epsilon with either CD3-delta or CD3-gamma is the main target for recognition by anti-CD3 monoclonal antibodies, Nov. 1, 1991.
Sancho et al., CD3-Surface Expression Is Required for CD4-p56ick-mediated Up-regulation of T Cell Antigen Receptor-CD3 Signaling in T Cells, Apr. 16, 1992.
Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.
Schaefer, et al., Immunoglobulin domain crossover as a generic approach for the production of bispecific IgG antibodies, PNAS, 2011, vol. 108, No. 27, pp. 11187-11192.
Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.
Schlereth, et al., Eradication of Tumors from a Human Colon Cancer Cell Line and from Ovarian Cancer Metastases in Immunodeficient Mice by a Single-Chain EP-CAM-/CD3-Bispecific Antibody Construct, Cancer Res 2005, vol. 65(7), pp. 2882-2889.
Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.
Schoonjans, et al., Fab Chains As an Efficient Heterodimerization Scaffold for the Production of Recombinant Bispecific and Trispecific Antibody Derivatives, The Journal of Immunology, 2000, vol. 165, pp. 7050-7057.
Schroder et al., The Peptides, vol. pp. 76-136, 1965, Academic Press.
Senter et al, Proceedings of the American Association for Cancer Research, 2004, vol. 45, Abstract No. 623.
Senter, Potent antibody drug conjugates for cancer therapy, 2009, Current Opin. Chem. Biol. 13:235.
Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.
Shan, et al., Characterization of scFv-Ig Constructs Generated from the Anti-CD20 mAb 1F5 Using Linker Peptides of Varying Lengths, J Immunol, 1999, vol. 162, pp. 6589-6595.
Shearman, et al., Construction, Expression and Characterization of Humanized Antibodies Directed Against the Human α/β T Cell Receptor, The Journal of Immunology, 1991, vol. 147, No. 12, pp. 4366-4373.
Shen, et al., Catumaxomab, a rat/murine hybrid trifunctional bispecific monoclonal antibody for the treatment of cancer, Curr Opin Mol Ther, 2008, vol. 10(3), pp. 273-284.
Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.
Shields et al., Lack of fucose on human IgG1 N-linked oligosaccharide improves binding to human FcγRIII and antibody-dependent cellular toxicity, 2002, J Biol Chem 277:26733-26740.
Shier et al., Identification of functional and structural amino-acid residues by parsimonious mutagenesis, 1995, Gene 169:147-155.
Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.
Skehan et al., Identification of functional and structural amino-acid residues by parsimonious mutagenesis, 1990, J. Natl. Cancer Inst. 82(13):1107-12.
Soumyarani et al, Oxidatively modified high density lipoprotein promotes inflammatory response in human monocytes-macrophages by enhanced production of ROS, TNF-α, MMP-9, and MMP-2., Mol Cell Biochem. Jul. 2012;366(1-2):277-85. doi: 10.1007/s11010-012-1306-y. Epub Apr. 17, 2012.
Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.
Spiess, et al., Bispecific antibodies with natural architecture produced by co-culture of bacteria expressing two distinct half-antibodies, Nature Biotechnology, 2013, doi:10.1038/nbt.2621 & Supplemental Information.
Stamova, Unexpected recombinations in single chain bispecific anti-CD3-anti-CD33 antibodies can be avoided by a novel linker module, Oct. 29, 2011.
Stanfield, et al., Maturation of Shark Single-domain (IgNAR) Antibodies: Evidence for Induced-fit Binding, J. Mol. Biol., 2007, vol. 367, pp. 358-372.
Stewart, et al., Recombinant CD36 inhibits oxLDL-induced ICAM-1-dependent monocyte adhesion., Mol Immunol. Feb. 2006;43(3):255-67.
Strop, P. et al., Generating Bispecific Human IgG1 and IgG2 Antibodies from Any Antibody Pair, J. Mol. Biol., 2012, doi:10.1016/j.jmb.2012.04.020.
Tan et al., "Superhumanized" antibodies: reduction of immunogenic potential by complementarity-determining region grafting with human germline sequences: application to an anti-CD28, 2002, J. Immunol. 169:1119-1125.
Tan, Philip, Presentation at PepTalk, Jan. 25, 2013, "Bi-specific ADAPTIR Molecule Targeting CD86 and Delivering Monomeric IL10 to Inhibit Antigen Presenting Cells".
Tarcsa et al, Chapter 10 Dual-Variable Domain Immunoglobulin (DVD-Ig™) Technology: A Versatile, Novel Format for the Next Generation of Dual-Targeting Biologics, Bispecific Antibodies 2011, pp. 171-185, 2011.
Teachey, et al., Cytokine release syndrome after blinatumomab treatment related to abnormal macrophage activation and ameliorated with cytokine-directed therapy, Blood, 2013, vol. 121, No. 26, pp. 5154-5157.
Tedgui, et al., Cytokines in atherosclerosis: pathogenic and regulatory pathways., Physiol Rev. Apr. 2006;86(2):515-81.
Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.
Thompson, et al., Improved binding of a bivalent single-chain immunotoxin results in increased efficacy for in vivo T-cell depletion, Protein Engineering, 2001, vol. 14, No. 12, pp. 1035-1041.
Thorne, et al., CD36 is a receptor for oxidized high density lipoprotein: implications for the development of atherosclerosis., FEBS Lett. Mar. 20, 2007;581(6):1227-32. Epub Feb. 28, 2007.
Thorpe et al., New coupling agents for the synthesis of immunotoxins containing a hindered disulfide bond with improved stability in Vivo, 1987, Cancer Res. 47:5924-5931.
Thotakura et al., Enzymatic deglycosylating of glycoproteins, 1987, Meth. Enzymol. 138:350.
Thurman et al., Detection of complement activation using monoclonal antibodies against C3d., J Clin Invest. May 2013;123(5):2218-30. doi: 10.1172/JCI65861. Epub Apr. 24, 2013.
Tomlinson et. al., Methods for generating multivalent and bispecific antibody fragments, 2000, Methods Enzymol. 326:461-479.
Topp, et al., Targeted Therapy With the T-Cell-Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498.
Traunecker, et al., Bispecific single chain molecules (Janusins) target cytotoxic lymphocytes on HIV infected cells, The EMBO Journal, 1991, vol. 1, No. 12, pp. 3655-3659.
Tsurushita et al., Humanization of monoclonal antibodies, 2004, Molecular Biology of B Cells 533-545.
Umaña et al., Engineered glycoforms of an antineuro-blastoma IgG1 with optimized antibody-dependent cellular cytotoxic activity, 1999, Nat Biotechnol 17:176-180.

(56) References Cited

OTHER PUBLICATIONS

Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.

Van Boxel, et al., Some lessons from the systematic production and structural analysis of soluble αβ T-cell receptors, Journal of Immunological Methods, 2009, vol. 350, pp. 14-21.

Van Wauwe, et al., OKT3: A Monoclonal Anti-Human T Lymphoctye Antibody with Potent Mitogenic Properties, The Journal of Immunology, 1980, vol. 124, No. 6, pp. 2708-2713.

Verdier, et al., Determination of lymphocyte subsets and cytokine levels in Cynomolgus monkeys, Toxicology, 1995, vol. 105, pp. 81-90.

Verhoeyen et al., Reshaping human antibodies: grafting an antilysozyme activity, 1988, Science, 239:1534-1536.

Veri, et al., Therapeutic Control of B Cell Activation via Recruitment of Fcγ Receptor IIb (CD32B) Inhibitory Function With a Novel Bispecific Antibody Scaffold, Arthritis & Rheumatism, 2010, vol. 62, No. 7, pp. 1933-1943.

Vettermann, et al., Powered by pairing: The surrogate light chain amplifies immunoglobulin heavy chain signaling and pre-selects the antibody repertoire, Seminars in Immunology 18, 2006, pp. 44-55.

Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.

Wang et al., Conserved amino acid networks involved in antibody variable domain interactions, Proteins, 2009, vol. 76, pp. 99-114.

Wang et al., Expression and characterization of recombinant soluble monkey CD3 molecules: mapping the FN18 polymorphic epitope, Molecular Immunology, 2004, vol. 40, pp. 1179-1188.

Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.

Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.

Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55.

Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.

Weiner, et al., The Role of T Cell Activation Bispecific Antibody Therapy in Anti-CD3 X Antitumor, Journal of Immunology, 1994, vol. 152, pp. 2385-2392.

Wesolowski, et al., Single domain antibodies: promising experimental and therapeutic tools in infection and immunity, Med Microbiol Immunol, 2009, vol. 198, pp. 157-174.

Whitlow, et al., An improved linker for single-chain Fv with reduced aggregation and enhanced proteolytic stability, Protein Engineering, 1993, vol. 6 , No. 8, pp. 989-995.

Wong, et al., The Mechanism of Anti-CD3 Monoclonal Antibodies, Transplantation, 1990, vol. 50, No. 4, pp. 683-689.

Woods, et al., LC-MS characterization and purity assessment of a prototype bispecific antibody, mAbs, 2013, vol. 5, Issue 5, pp. 711-722, http://dx.doi.org/10.4161/mabs.25488.

Woyke et al., In vitro activities and postantifungal effects of the potent dolastation 10 derivative auristatin PHE, 2001, Antimicrob. Agents and Chemother. 45(12):3580-3584.

Wu et al, Molecular construction and optimization of anti-human IL-11α/β dual variable domain immunoglobulin (DVD-Ig™) molecules, [mAbs 1:4, 339-347; Jul./Aug. 2009]; Landes Bioscience, Apr. 10, 2009.

Wu et al, Simultaneous targeting of multiple disease mediators by a dual-variable-domain immunoglobulin, (DVD-Ig™) molecules, Jul.-Aug. 2009; 339-347, Oct. 14, 2007.

Wu et al., Humanization of a murine monoclonal antibody by simultaneous optimization of framework and CDR residues, 1999, J. Mol. Biol. 294:151-162.

Wu, et al., Multimerization of a chimeric anti-CD20 single-chain Fv-Fc fusion protein is mediated through variable domain exchange, Protein Engineering, 2001, vol. 14, No. 12, pp. 1025-1033.

Wucherpfennig, et al., Structural Biology of the T-cell Receptor: Insights into Receptor Assembly, Ligand Recognition, and Initiation of Signaling, Cold Spring Harb Perspect Biol 2010;2:a005140.

Xie, et al., A new format of bispecific antibody: highly efficient heterodimerization, expression and tumor cell lysis, Journal of Immunological Methods, 2005, vol. 296 , pp. 95-101, doi:10.1016/j.jim.2004.11.005.

Xu, et al., Combinatorial surrobody libraries, PNAS, 2008, vol. 105, No. 31, pp. 10756-10761.

Xu, et al., Rapid optimization and prototyping for therapeutic antibody-like molecules, mAbs, 2013, vol. 5, Issue 2, pp. 237-254.

Xu, et al. Surrobodies with Functional Tails, J. Mol. Biol., 2010, vol. 397, pp. 352-360.

Yang et al., Differential in vitro activation of CD8-CD4+ and CD4-CD8+ T lymphocytes by combinations of anti-CD2 and anti-CD3 antibodies, Apr. 1, 1988.

Yelton et al., Affinity maturation of the BR96 anti-carcinoma antibody by codon-based mutagenesis, 1995, J. Immunol. 155:1994-2004.

Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.

Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.

Yu et al., The biosynthetic gene cluster of the maytansinoids antitumor agent ansamitocin from actinosynnema pretiosum, 2002, PNAS 99:7968-7973.

Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.

Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.

Zhu, et al., Remodeling domain interfaces to enhance heterodimer formation, Protein Science, 1997, vol. 6, pp. 781-788.

Zuo, et al., An efficient route to the production of an IgG-like bispecific antibody, Protein Engineering, 2000, vol. 13, No. 5, pp. 361-367.

Kharmate et al., Inhibition of tumor promoting signals by activation of SSTR2 and opioid receptors in human breast cancer cells., Cancer Cell Int. Sep. 23, 2013;13(1):93. doi: 10.1186/1475-2867-13-93.

Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432.CCR-13-0143.

Spranger et al., Mechanism of tumor rejection with doublets of CTLA-4, PD-1/Pd-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.

Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.

Hedvat et al., Dual Blockade of PD-1 and CTLA-4 with Bispecific Antibodies Promotes Human T cell Activation and Proliferation., Nov. 11, 2016, retrieved from the internet: http://files.shareholder.

(56) References Cited

OTHER PUBLICATIONS com/downloads/AMDA-2B2V8N/0x0x916284/D8084990-61EC-4DFE-8B76-60CF58B8C06F/CPI_bispecifics.pdf.

Chichili et al., Co-targeting of PD-1 and CTLA-4 Inhibitory Pathways with Bispecific DART® and TRIDENT™ Molecules., Apr. 4, 2017, retrieved from the internet: http://files.shareholder.com/downloads/AMDA-278VRP/0x0x935572/8CC86417-40BA-41C0-935D-EF1B7DBOB5BB/AACR_2017_-_Co-targeting_PD-1_and_CTLA-4_Inhibitory_Pathways_with_DART_and_TRIDENT_Molecules.pdf.

Jin et al. The Design and Engineering of IgG-Like Bispecific Antibodies., Chapter 9, Bispecific Antibodies, pp. 151-169.

Zamyatnin AA., Amino Acid, Peptide, and Protein Volume in Solution., Annu Rev Biophys Bioeng. 1984;13:145-65.

Zalevsky et al. "Enhanced antibody half-life improves in vivo activity." Nature Biotechnology, vol. 28, No. 2, Feb. 1, 2010, pp. 157-159.

Ziebig et al., Effect of the oxLDL Binding Protein Fc-CD68 on Plaque Extension and Vulnerability in Atherosclerosis., Circulation Research 108: 695-703, 2011.

Ishigaki et al., Impact of Plasma Oxidized Low-Density Lipoprotein Removal on Atherosclerosis., Circulation 118: 75-83, 2008.

Wigginton et al., An immunoglobulin E-reactive chimeric human immunoglobulin G1 anti-idiotype inhibits basophil degranulation through cross-linking of FcεRI with FcγRIIb., Clinical & Experimental Allergy, 38:313-319. doi:10.1111/j.1365-2222.2007.02896.x.

Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.

Smith et al., Mouse model recapitulating human Fcγ receptor structural and functional diversity., Proc Natl Acad Sci U S A. Apr. 17, 2012;109(16):6181-6. doi: 10.1073/pnas.1203954109. Epub Apr. 2, 2012.

Tabrizi et al., Biodistribution mechanisms of therapeutic monoclonal antibodies in health and disease., AAPS J. Mar. 2010;12(1):33-43. doi: 10.1208/s12248-009-9157-5. Epub Nov. 19, 2009.

DiGiandomenico et al., A multifunctional bispecific antibody protects against Pseudomonas aeruginosa., Sci Transl Med. Nov. 12, 2014;6(262):262ra155. doi: 10.1126/scitranslmed.3009655.

Scott et al., Antibody therapy of cancer., Nat Rev Cancer. Mar. 22, 2012;12(4):278-87. doi: 10.1038/nrc3236.

Clynes et al., Redirected T Cell Cytotoxicity in Cancer Therapy., Annu Rev Med. Jan. 27, 2019;70:437-450. doi: 10.1146/annurev-med-062617-035821. Epub Oct. 31, 2018.

Merchant et al., Monovalent antibody design and mechanism of action of onartuzumab, a MET antagonist with anti-tumor activity as a therapeutic agent., Proc Natl Acad Sci U S A. Aug. 6, 2013;110(32):E2987-96. doi: 10.1073/pnas.1302725110. Epub Jul. 23, 2013.

Fos et al., ICOS ligation recruits the p50alpha PI3K regulatory subunit to the immunological synapse., J Immunol. Aug. 1, 2008;181(3):1969-77.

Sanmamed et al., Agonists of Co-stimulation in Cancer Immunotherapy Directed Against CD137, OX40, GITR, CD27, CD28, and ICOS., Semin Oncol. Aug. 2015;42(4):640-55. doi: 10.1053/j.seminoncol.2015.05.014. Epub Jun. 11, 2015.

Vieira et al., ICOS-mediated signaling regulates cytokine production by human T cells and provides a unique signal to selectively control the clonal expansion of Th2 helper cells., Eur J Immunol. May 2004;34(5):1282-90.

Madrenas et al., Conversion of CTLA-4 from inhibitor to activator of T cells with a bispecific tandem single-chain Fv ligand., J Immunol. May 15, 2004;172(10):5948-56.

Yokosuka et al., Spatiotemporal basis of CTLA-4 costimulatory molecule-mediated negative regulation of T cell activation., Immunity. Sep. 24, 2010;33(3):326-39. doi: 10.1016/j.immuni.2010.09.006.

Carpenter et al., Activation of human B cells by the agonist CD40 antibody CP-870,893 and augmentation with simultaneous toll-like receptor 9 stimulation., J Transl Med. Nov. 11, 2009;7:93. doi: 10.1186/1479-5876-7-93.

Fan et al., Engagement of the ICOS pathway markedly enhances efficacy of CTLA-4 blockade in cancer immunotherapy., J Exp Med. Apr. 7, 2014;211(4):715-25. doi: 10.1084/jem.20130590. Epub Mar. 31, 2014.

Gilboa et al., Use of oligonucleotide aptamer ligands to modulate the function of immune receptors., Clin Cancer Res. Mar. 1, 2013;19(5):1054-62. doi: 10.1158/1078-0432.CCR-12-2067.

Uy et al., Preliminary Results of a Phase 1 Study of Flotetuzumab, a CD123 x CD3 Bispecific Dart® Protein, in Patients with Relapsed/Refractory Acute Myeloid Leukemia and Myelodysplastic Syndrome., Blood 2017 130:637.

Vey et al., Interim Results from a Phase 1 First-in-Human study of flotetuzumab, a CD123 x CD3 bispecific Dart molecule, in AML/MDS., Annals of Oncology (2017) 28 (suppl_5): v355-v371. 10.1093/annonc/mdx373.

Ravandi et al., Complete Responses in Relapsed/Refractory Acute Myeloid Leukemia (AML) Patients on a Weekly Dosing Schedule of XmAb14045, a CD123 x CD3 T Cell-Engaging Bispecific Antibody: Initial Results of a Phase 1 Study., Blood 2018 132:763; doi: https://doi.org/10.1182/blood-2018-99-119786.

Bacac et al., A Novel Carcinoembryonic Antigen T-Cell Bispecific Antibody (CEA TCB) for the Treatment of Solid Tumors., Clin Cancer Res. Jul. 1, 2016;22(13):3286-97.

Schuster et al., Immunotherapy with the trifunctional anti-CD20 x anti-CD3 antibody FBTA05 (Lymphomun) in paediatric high-risk patients with recurrent CD20-positive B cell malignancies., Br J Haematol. Apr. 2015;169(1):90-102. doi: 10.1111/bjh.13242. Epub Dec. 11, 2014.

\* cited by examiner

Figure 2A antigen sequences

Human PD-1 sequence

>sp|Q15116  SEQ ID NO: 1
MQIPQAPWPVVWAVLQLGWRPGWFLDSPDRPWNPPTFSPALLVVTEGDNATFTCSFSNTSESFVLNWYRMSPSNQTDKLAAFPEDR
SQPGQDCRFRVTQLPNGRDFHMSVVRARRNDSGTYLCGAISLAPKAQIKESLRAELRVTERRAEVPTAHPSPSPRPAGQFQTLVVG
VVGGLLGSLVLLVWVLAVICSRAARGTIGARRTGQPLKEDPSAVPVFSVDYGELDFQWREKTPEPPVPCVPEQTEYATIVFPSGMG
TSSPARRGSADGPRSAQPLRPEDGHCSWPL

Human PD-1 sequence, extracellular domain

>sp|Q15116|21-170  SEQ ID NO: 2
PGWFLDSPDRPWNPPTFSPALLVVTEGDNATFTCSFSNTSESFVLNWYRMSPSNQTDKLAAFPEDRSQPGQDCRFRVTQLPNGRDF
HMSVVRARRNDSGTYLCGAISLAPKAQIKESLRAELRVTERRAEVPTAHPSPSPRPAGQFQTLV

Macaca fascicularis PD-1 sequence

>tr|B0LAJ3  SEQ ID NO: 3
MQIPQAPWPVVWAVLQLGWRPGWFLESPDRPWNAPTFSPALLLVTEGDNATFTCSFSNASESFVLNWYRMSPSNQTDKLAAFPEDR
SQPGQDCRFRVTRLPNGRDFHMSVVRARRNDSGTYLCGAISLAPKAQIKESLRAELRVTERRAEVPTAHPSPSPRPAGQFQALVVG
VVGGLLGSLVLLVWVLAVICSRAAQGTIEARRTGQPLKEDPSAVPVFSVDYGELDFQWREKTPEPPAPCVPEQTEYATIVFPSGLG
TSSPARRGSADGPRSPRPLRPEDGHCSWPL

Macaca fascicularis PD-1 sequence, extracellular domain (predicted)

>tr|B0LAJ3|21-170  SEQ ID NO: 4
PGWFLESPDRPWNAPTFSPALLLVTEGDNATFTCSFSNASESFVLNWYRMSPSNQTDKLAAFPEDRSQPGQDCRFRVTRLPNGRDF
HMSVVRARRNDSGTYLCGAISLAPKAQIKESLRAELRVTERRAEVPTAHPSPSPRPAGQFQALV

Human CTLA-4 sequence

>sp|P16410  SEQ ID NO: 5
MACLGFQRHKAQLNLATRTWPCTLLFFLLFIPVFCKAMHVAQPAVVLASSRGIASFVCEYASPGKATEVRVTVLRQADSQVTEVCA
ATYMMGNELTFLDDSICTGTSSGNQVNLTIQGLRAMDTGLYICKVELMYPPPYYLGIGNGTQIYVIDPEPCPDSDFLLWILAAVSS
GLFFYSFLLTAVSLSKMLKKRSPLTTGVYVKMPPTEPECEKQFQPYFIPIN

Human CTLA-4 sequence, extracellular domain

>sp|P16410|36-161  SEQ ID NO: 6
KAMHVAQPAVVLASSRGIASFVCEYASPGKATEVRVTVLRQADSQVTEVCAATYMMGNELTFLDDSICTGTSSGNQVNLTIQGLRA
MDTGLYICKVELMYPPPYYLGIGNGTQIYVIDPEPCPDSD

Figure 2B

Macaca fascicularis CTLA-4 sequence

>tr|G7PL88 SEQ ID NO: 7
MACLGFQRHKARLNLATRTRPYTLLFSLLFIPVFSKAMHVAQPAVVLANSRGIASFVCEYASPGKATEVRVTVLRQADSQVTEVCA
ATYMMGNELTFLDDSICTGTSSGNQVNLTIQGLRAMDTGLYICKVELMYPPPYYMGIGNGTQIYVIDPEPCPDSDFLLWILAAVSS
GLFFYSFLLTAVSLSKMLKKRSPLTTGVYVKMPPTEPECEKQFQPYFIPIN

Macaca fascicularis CTLA-4 sequence, extracellular domain (predicted)

>tr|G7PL88 SEQ ID NO: 8
KAMHVAQPAVVLANSRGIASFVCEYASPGKATEVRVTVLRQADSQVTEVCAATYMMGNELTFLDDSICTGTSSGNQVNLTIQGLRA
MDTGLYICKVELMYPPPYYMGIGNGTQIYVIDPEPCPDSD

Human LAG-3 sequence

>sp|P18627 SEQ ID NO: 9
MWEAQFLGLLFLQPLWVAPVKPLQPGAEVPVVWAQEGAPAQLPCSPTIPLQDLSLLRRAGVTWQHQPDSGPPAAAPGHPLAPGPHP
AAPSSWGPRPRRYTVLSVGPGGLRSGRLPLQPRVQLDERGRQRGDFSLWLRPARRADAGEYRAAVHLRDRALSCRLRLRLGQASMT
ASPPGSLRASDWVILNCSFSRPDRPASVHWFRNRGQGRVPVRESPHHHLAESFLFLPQVSPMDSGPWGCILTYRDGFNVSIMYNLT
VLGLEPPTPLTVYAGAGSRVGLPCRLPAGVGTRSFLTAKWTPPGGGPDLLVTGDNGDFTLRLEDVSQAQAGTYTCHIHLQEQQLNA
TVTLAIITVTPKSFGSPGSLGKLLCEVTPVSGQERFVWSSLDTPSQRSFSGPWLEAQEAQLLSQPWQCQLYQGERLLGAAVYFTEL
SSPGAQRSGRAPGALPAGHLLLFLILGVLSLLLLVTGAFGFHLWRRQWRPRRFSALEQGIHPPQAQSKIEELEQEPEPEPEPEPEP
EPEPEPEQL

Human LAG-3 sequence, extracellular domain

>sp|P18627|29-450 SEQ ID NO: 10
VPVVWAQEGAPAQLPCSPTIPLQDLSLLRRAGVTWQHQPDSGPPAAAPGHPLAPGPHPAAPSSWGPRPRRYTVLSVGPGGLRSGRL
PLQPRVQLDERGRQRGDFSLWLRPARRADAGEYRAAVHLRDRALSCRLRLRLGQASMTASPPGSLRASDWVILNCSFSRPDRPASV
HWFRNRGQGRVPVRESPHHHLAESFLFLPQVSPMDSGPWGCILTYRDGFNVSIMYNLTVLGLEPPTPLTVYAGAGSRVGLPCRLPA
GVGTRSFLTAKWTPPGGGPDLLVTGDNGDFTLRLEDVSQAQAGTYTCHIHLQEQQLNATVTLAIITVTPKSFGSPGSLGKLLCEVT
PVSGQERFVWSSLDTPSQRSFSGPWLEAQEAQLLSQPWQCQLYQGERLLGAAVYFTELSSPGAQRSGRAPGALPAGHL

Macaca fascicularis LAG-3 sequence (predicted)

>gi|544467815|ref|XP_005570011.1 SEQ ID NO: 11
MWEAQFLGLLFLQPLWVAPVKPPQPGAEISVVWAQEGAPAQLPCSPTIPLQDLSLLRRAGVTWQHQPDSGPPAXAPGHPPVPGHRP
AAPYSWGPRPRRYTVLSVGPGGLRSGRLPLQPRVQLDERGRQRGDFSLWLRPARRADAGEYRATVHLRDRALSCRLRLRVGQASMT
ASPPGSLRTSDWVILNCSFSRPDRPASVHWFRSRGQGRVPVQGSPHHHLAESFLFLPHVGPMDSGLWGCILTYRDGFNVSIMYNLT
VLGLEPATPLTVYAGAGSRVELPCRLPPAVGTQSFLTAKWAPPGGGPDLLVAGDNGDFTLRLEDVSQAQAGTYICHIRLQGQQLNA
TVTLAIITVTPKSFGSPGSLGKLLCEVTPASGQEHFVWSPLNTPSQRSFSGPWLEAQEAQLLSQPWQCQLHQGERLLGAAVYFTEL
SSPGAQRSGRAPGALRAGHLPLFLILGVLFLLLLVTGAFGFHLWRRQWRPRRFSALEQGIHPPQAQSKIEELEQEPELEPEPELER
ELGPEPEPGPEPEPEQL

Figure 2C

Macaca fascicularis LAG-3 sequence, extracellular domain (predicted)

```
>gi|544467815|ref|XP_005570011.1|29-450 SEQ ID NO: 12
ISVVWAQEGAPAQLPCSPTIPLQDLSLLRRAGVTWQHQPDSGPPAXAPGHPPVPGHRPAAPYSWGPRPRRYTVLSVGPGGLRSGRL
PLQPRVQLDERGRQRGDFSLWLRPARRADAGEYRATVHLRDRALSCRLRLRVGQASMTASPPGSLRTSDWVILNCSFSRPDRPASV
HWFRSRGQGRVPVQGSPHHHLAESFLFLPHVGPMDSGLWGCILTYRDGFNVSIMYNLTVLGLEPATPLTVYAGAGSRVELPCRLPP
AVGTQSFLTAKWAPPGGGPDLLVAGDNGDFTLRLEDVSQAQAGTYICHIRLQGQQLNATVTLAIITVTPKSFGSPGSLGKLLCEVT
PASGQEHFVWSPLNTPSQRSFSGPWLEAQEAQLLSQPWQCQLHQGERLLGAAVYFTELSSPGAQRSGRAPGALRAGHL
```

Human BTLA sequence

```
>sp|Q7Z6A9 SEQ ID NO: 13
MKTLPAMLGTGKLFWVFFLIPYLDIWNIHGKESCDVQLYIKRQSEHSILAGDPFELECPVKYCANRPHVTWCKLNGTTCVKLEDRQ
TSWKEEKNISFFILHFEPVLPNDNGSYRCSANFQSNLIESHSTTLYVTDVKSASERPSKDEMASRPWLLYRLLPLGGLPLLITTCF
CLFCCLRRHQGKQNELSDTAGREINLVDAHLKSEQTEASTRQNSQVLLSETGIYDNDPDLCFRMQEGSEVYSNPCLEENKPGIVYA
SLNHSVIGPNSRLARNVKEAPTEYASICVRS
```

Human BTLA sequence, extracellular domain

```
>sp|Q7Z6A9|31-157 SEQ ID NO: 14
KESCDVQLYIKRQSEHSILAGDPFELECPVKYCANRPHVTWCKLNGTTCVKLEDRQTSWKEEKNISFFILHFEPVLPNDNGSYRCS
ANFQSNLIESHSTTLYVTDVKSASERPSKDEMASRPWLLYR
```

Macaca fascicularis BTLA sequence (predicted)

```
>gi|355746406|gb|EHH51020.1 SEQ ID NO: 15
MKTLPAMLGSGRLFWVVFLIPYLDIWNIHGKESCDVQLYIKRQSYHSIFAGDRFKLECPVKYCAHRPQVTWCKLNGTTCVKLEGRH
TSWKQEKNLSFFILHFEPVLPSDNGSYRCSANFLSAIIESHSTTLYVTDVKSASERPSKDEMASRPWLLYSLLPLGGLPLLITTCF
CLFCFLRRHQGKQNELSDTTRREITLVDVPFKSEQTEASTRQNSQVLLSETGIYDNEPDFCFRMQEGSEVYSNPCLEENKPGIIYA
SLNHSIIGLNARQARNVKEAPTEYASICVRS
```

Macaca fascicularis BTLA sequence, extracellular domain (predicted)

```
>gi|355746406|gb|EHH51020.1|31-157 SEQ ID NO: 16
KESCDVQLYIKRQSYHSIFAGDRFKLECPVKYCAHRPQVTWCKLNGTTCVKLEGRHTSWKQEKNLSFFILHFEPVLPSDNGSYRCS
ANFLSAIIESHSTTLYVTDVKSASERPSKDEMASRPWLLYS
```

Human TIM-3 sequence

```
>sp|Q8TDQ0 SEQ ID NO: 17
MFSHLPFDCVLLLLLLLTRSSEVEYRAEVGQNAYLPCFYTPAAPGNLVPVCWGKGACPVFECGNVVLRTDERDVNYWTSRYWLNG
DFRKGDVSLTIENVTLADSGIYCCRIQIPGIMNDEKFNLKLVIKPAKVTPAPTRQRDFTAAFPRMLTTRGHGPAETQTLGSLPDIN
LTQISTLANELRDSRLANDLRDSGATIRIGIYIGAGICAGLALALIFGALIFKWYSHSKEKIQNLSLISLANLPPSGLANAVAEGI
RSEENIYTIEENVYEVEEPNEYYCYVSSRQQPSQPLGCRFAM
```

Figure 2D

Human TIM-3 sequence, extracellular domain

>sp|Q8TDQ0|22-202  SEQ ID NO: 18
SEVEYRAEVGQNAYLPCFYTPAAPGNLVPVCWGKGACPVFECGNVVLRTDERDVNYWTSRYWLNGDFRKGDVSLTIENVTLADSGI
YCCRIQIPGIMNDEKFNLKLVIKPAKVTPAPTRQRDFTAAFPRMLTTRGHGPAETQTLGSLPDINLTQISTLANELRDSRLANDLR
DSGATIRIG

Macaca fascicularis TIM-3 sequence (predicted)

>gi|355750365|gb|EHH54703.1  SEQ ID NO: 19
MFSHLPFDCVLLLLLLLTRSSEVEYIAEVGQNAYLPCSYTPAPPGNLVPVCWGKGACPVFDCSNVVLRTDNRDVNDRTSGRYWLK
GDFHKGDVSLTIENVTLADSGVYCCRIQIPGIMNDEKHNVKLVVIKPAKVTPAPTLQRDLTSAFPRMLTTGEHGPAETQTPGSLPD
VNLTVSNFFCELQIFTLTNELRDSGATIRTAIYIAAGISAGLALALIFGALIFKWYSHSKEKTQNLSLISLANIPPSGLANAVAEG
IRSEENIYTIEEDVYEVEEPNEYYCYVSSGQQPSQPLGCRVAMP

Macaca fascicularis TIM-3 sequence, extracellular domain (predicted)

>gi|355750365|gb|EHH54703.1|22-203  SEQ ID NO: 20
SEVEYIAEVGQNAYLPCSYTPAPPGNLVPVCWGKGACPVFDCSNVVLRTDNRDVNDRTSGRYWLKGDFHKGDVSLTIENVTLADSG
VYCCRIQIPGIMNDEKHNVKLVVIKPAKVTPAPTLQRDLTSAFPRMLTTGEHGPAETQTPGSLPDVNLTVSNFFCELQIFTLTNEL
RDSGATIRTA

II. Figure 3A skew variants

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 3B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 3C

| Monomer 1 | Monomer 2 |
|---|---|
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| N208D Q295E Q418E N421D | |
| Q196K I199T P217R P228R N276K | |
| Q196K I199T N276K | |
| E269Q E272Q E283Q E357Q | |
| E269Q E272Q E283Q | |
| E269Q E272Q | |
| E269Q E283Q | |
| E272Q E283Q | |
| E269Q | |

Figure 3D

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 3E

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |

Figure 3F

| Monomer 1 | Monomer 2 |
|---|---|
| T366S/L368A/Y407V/Y349C | T366W/S354C |
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| Q295E N384D Q418E N421D | |
| N208D Q295E Q418E N421D | |
| Q295E Q418E N421D | |
| Q196K I199T P217R P228R N276K | |
| Q196K I199T N276K | |
| E269Q E272Q E283Q E357Q | |
| E269Q E272Q E283Q | |
| E269Q E272Q | |
| E269Q E283Q | |
| E272Q E283Q | |
| E269Q | |

III.  Figure 4  pI variants

| Variant constant region | Substitutions |
|---|---|
| pI_ISO(-) | I199T N203D K274Q R355Q N384S K392N V397M Q419E DEL447 |
| pI_(-)_isosteric_A | N208D Q295E N384D Q418E N421D |
| pI_(-)_isosteric A-Fc only | Q295E N384D Q418E N421D |
| pI_(-)_isosteric_B | N208D Q295E Q418E N421D |
| pI_(-)_isosteric_B-Fc only | Q295E Q418E N421D |
| pI_ISO(+RR) | Q196K I199T P217R P228R N276K |
| pI_ISO(+) | Q196K I199T N276K |
| pI_(+)_isosteric_A | E269Q E272Q E283Q E357Q |
| pI_(+)_isosteric_B | E269Q E272Q E283Q |
| pI_(+)_isosteric_E269Q/E272Q | E269Q E272Q |
| pI_(+)_isosteric_E269Q/E283Q | E269Q E283Q |
| pI_(+)_

IV. Figure 5: Ablation variants

| Variant | Variant(s), cont. |
|---|---|
| G236R | P329K |
| S239G | A330L |
| S239K | A330S/P331S |
| S239Q | I332K |
| S239R | I332R |
| V266D | V266D/A327Q |
| S267K | V266D/P329K |
| S267R | S267R/A327Q |
| H268K | S267R/P329K |
| E269R | G236R/L328R |
| 299R | E233P/L234V/L235A/G236del/S239K |
| 299K | E233P/L234V/L235A/G236del/S267K |
| K322A | E233P/L234V/L235A/G236del/S239K/A327G |
| A327G | E233P/L234V/L235A/G236del/S267K/A327G |
| A327L | E233P/L234V/L235A/G236del |
| A327N | S239K/S267K |
| A327Q | 267K/P329K |
| L328E | |
| L328R | |
| P329A | |
| P329H | |

Figure 6A useful combinations

| scFv monomer (+) | Fab monomer (-) |
|---|---|
| Heterodimer pI variants S364K/E357Q | Heterodimerization pI variants L368D/K370S |
| Optional scFv charged linker including but not limited to (GKPGS)$_4$ (SEQ ID NO: 37755) | Isosteric pI substitutions N208D/Q295E/N384D/Q418E/N421D |
| FcKO E233P/L234V/L235A/G236del/S267K | FcKO E233P/L234V/L235A/G236del/S267K |
| ± 428L/434S for FcRn | ± 428L/434S for FcRn |
| scFv of ABD of either ICOS or a checkpoint inhibitor | Fv/Fab of the other of ABD of either ICOS or a checkpoint inhibitor |

Figure 6B

| scFv monomer | Fab monomer |
|---|---|
| Heterodimer pI variants S364K/E357Q | Heterodimerization pI variants L368D/K370S |
| Optional scFv charged linker including, but not limited to (GKPGS)$_4$ (SEQ ID NO: 37755) | pI substitutions I199T N203D K274Q R355Q Q419E K447del |
| FcKO E233P/L234V/L235A/G236del/S267K | FcKO E233P/L234V/L235A/G236del/S267K |
| ± 428L/434S for FcRn (optional) | ± 428L/434S for FcRn (optional) |
| scFv of either ICOS or a checkpoint inhibitor | Fv/Fab of the other of ABD of either ICOS or a checkpoint inhibitor |

Figure 7A Linkers

Positive charged scFv linkers

| Name | Sequence | Length | Charge | SEQ ID NO: |
|---|---|---|---|---|
| Gly-Ser 15 | GGGGSGGGGSGGGGS | 15 | 0 | 37699 |
| Whitlow linker | GSTSGSGKPGSGEGSTKG | 18 | +1 | 37700 |
| 6paxA_1 (+A) | IRPRAIGGSKPRVA | 14 | +4 | 37701 |
| +B | GKGGSGKGGSGKGGS | 15 | +3 | 37702 |
| +C | GGKGSGGKGSGGKGS | 15 | +3 | 37703 |
| +D | GGGKSGGGKSGGGKS | 15 | +3 | 37704 |
| +E | GKGKSGKGKSGKGKS | 15 | +6 | 37705 |
| +F | GGGKSGGKGSGKGGS | 15 | +3 | 37706 |
| +G | GKPGSGKPGSGKPGS | 15 | +3 | 37707 |
| +H | GKPGSGKPGSGKPGSGKPGS | 20 | +4 | 37708 |
| +I | GKGKSGKGKSGKGKSGKGKS | 20 | +8 | 37709 |

Negative charged scFv linkers

| Name | Sequence | Length | Charge | SEQ ID NO: |
|---|---|---|---|---|
| Gly-Ser 15 | GGGGSGGGGSGGGGSGGGGS | 20 | 0 | 37710 |
| 3hsc_2 (-A) | STAGDTHLGGEDFD | 14 | -4 | 37711 |
| -B | GEGGSGEGGSGEGGS | 15 | -3 | 37712 |
| -C | GGEGSGGEGSGGEGS | 15 | -3 | 37713 |
| -D | GGGESGGGESGGGES | 15 | -3 | 37714 |
| -E | GEGESGEGESGEGES | 15 | -6 | 37715 |
| -F | GGGESGGEGSGEGGS | 15 | -3 | 37716 |
| -G | GEGESGEGESGEGESGEGES | 20 | -8 | 37717 |

Figure 7B scFv linkers

| | |
|---|---|
| GGGGSGGGGSGGGGS | (SEQ ID NO: 37718) |
| GGGGSGGGGSGGGGSGGGGS | (SEQ ID NO: 37719) |
| GSTSGSGKPGSGEGSTKG | (SEQ ID NO: 37720) |
| PRGASKSGSASQTGSAPGS | (SEQ ID NO: 37721) |
| GTAAAGAGAAGGAAAGAAG | (SEQ ID NO: 37722) |
| GTSGSSGSGSGGSGSGGGG | (SEQ ID NO: 37723) |
| GKPGSGKPGSGKPGSGKPGS | (SEQ ID NO: 37724) |

VII. Figure 8 Tms of skews

| XENP | Heterodimer-skewing variant, Chain 1 | Heterodimer-skewing variant, Chain 2 | Heterodimer Yield (%) | CH3 Tm (°C) |
|---|---|---|---|---|
| 12757 | none | none | 52.7 | 83.1 |
| 12758 | L368D/K370S | S364K | 94.4 | 76.6 |
| 12759 | L368D/K370S | S364K/E357L | 90.2 | 77.2 |
| 12760 | L368D/K370S | S364K/E357Q | 95.2 | 77.5 |
| 12761 | T411E/K360E/Q362E | D401K | 85.6 | 80.6 |
| 12496 | L368E/K370S | S364K | 91.5 | n.d. |
| 12511 | K370S | S364K | 59.9 | n.d. |
| 12840 | L368E/K370S | S364K/E357Q | 59.5 | n.d. |
| 12841 | K370S | S364K/E357Q | 90.4 | n.d. |
| 12894 | L368E/K370S | S364K | 41.0 | n.d. |
| 12895 | K370S | S364K | 49.3 | n.d. |
| 12896 | L368E/K370S | S364K/E357Q | 73.9 | n.d. |
| 12901 | K370S | S364K/E357Q | 87.9 | n.d. |

Figure 9A   XENP19690 1G6_H1.279_L1.194 anti-PD-1 Fv sequences

| What | sequence | SEQ ID NO: |
|---|---|---|
| Vh domain | EVQLVESGGGLVKPGGSLRLSCVASGFTFSNYWMNWVRQAPGKGLEWVAEIRLYSNNYATHYAESVKGRFTISRDDSKSTLYLQMN NLKTEDTGVYYCTRYYGNYGGYFDVWGRGTLVTVSS | 37759 |
| vhCDR1 | NYWMN | 37760 |
| vhCDR2 | EIRLYSNNYATHYAESVKG | 37761 |
| vhCDR3 | YYGNYGGYFDV | 37762 |
| scFv linker | GKPGSGKPGSGKPGSGKPGS | 37708 |
| Vl domain | EIVLTQSPATLSASPGERVTLTCRASQSVGNLVAWYQQKPGQAPRLLINYASHRYTGVPDRFTGSGYGTEFTLTISSVQSEDFGVY YCQQDFSSPRTFGGGTKVEIK | 37763 |
| vlCDR1 | RASQSVGNDVA | 37764 |
| vlCDR2 | YASHRYT | 37765 |
| vlCDR3 | QQDFSSPRT | 37766 |
| scFv | EVQLVESGGGLVKPGGSLRLSCVASGFTFSNYWMNWVRQAPGKGLEWVAEIRLYSNNYATHYAESVKGRFTISRDDSKSTLYLQMN NLKTEDTGVYYCTRYYGNYGGYFDVWGRGTLVTVSS/GKPGSGKPGSGKPGSGKPGS/EIVLTQSPATLSASPGERVTLTCRASQS VGNLVAWYQQKPGQAPRLLINYASHRYTGVPDRFTGSGYGTEFTLTISSVQSEDFGVYYCQQDFSSPRTFGGGTKVEIK/ | 37767 |

Figure 9B   1G6_H1.280_L1.224 anti-PD-1 Fv sequences

| What | sequence | SEQ ID NO: |
|---|---|---|
| Variable heavy (vh) domain | EVQLVESGGGLVKPGGSLRLTCVASGFTFSNYWMNWVRQAPGKGLEWVAEIRLYSNNYATHYAESVKGRFTISRDDSKSTLYLQMN NLKTEDTGVYYCTRYYGNYGGYFDVWGRGTLVTVSS | 37768 |
| vhCDR1 | NYWMN | 37769 |
| vhCDR2 | EIRLYSNNYATHYAESVKG | 37770 |
| vhCDR3 | YYGNYGGYFDV | 37771 |
| scFv linker | GKPGSGKPGSGKPGSGKPGS | 37708 |
| Variable light (vl) domain | EIVLTQSPATLSVSPGERVTLTCRASQSVGNEVAWYQQKPGQAPRLLINYASHRYTSVPDRFTGSGYGTEFTLTISSVQSEDFAVY YCQQDWSSPRTFGGGTKVEIK | 37772 |
| vlCDR1 | RASQSVGNDVA | 37773 |
| vlCDR2 | YASHRYT | 37774 |
| vlCDR3 | QQDWSSPRT | 37775 |
| scFv | EVQLVESGGGLVKPGGSLRLTCVASGFTFSNYWMNWVRQAPGKGLEWVAEIRLYSNNYATHYAESVKGRFTISRDDSKSTLYLQMN NLKTEDTGVYYCTRYYGNYGGYFDVWGRGTLVTVSS/GKPGSGKPGSGKPGSGKPGS/EIVLTQSPATLSVSPGERVTLTCRASQS VGNEVAWYQQKPGQAPRLLINYASHRYTSVPDRFTGSGYGTEFTLTISSVQSEDFAVYYCQQDWSSPRTFGGGTKVEIK | 37776 |

Figure 9C XENP19692 1G6_L1.194_H1.279 anti-PD-1 Fv sequences

| What | sequence | SEQ ID NO: |
|---|---|---|
| Variable light (vl) domain | EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK | 37777 |
| vlCDR1 | RASQSVGNDVA | 37778 |
| vlCDR2 | YASHRYT | 37779 |
| vlCDR3 | QQDFSSPRT | 37780 |
| scFv linker | GKPGSGKPGSGKPGSGKPGS | 37708 |
| Variable heavy (vh) domain | EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS | 37781 |
| vhCDR1 | NYWMN | 37782 |
| vhCDR2 | EIRLYSNNYATHYAESVKG | 37783 |
| vhCDR3 | YYGNYGGYFDV | 37784 |
| scFv | EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK/GKPGSGKPGSGKPGSGKPGS/EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS | 37785 |

Figure 9D XENP19669 1G6_L1.210_H1.288 anti-PD-1 Fv sequences

| What | sequence | SEQ ID NO: |
|---|---|---|
| Variable heavy (vh) domain | EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIK | 37786 |
| vhCDR1 | RASQSVGNDVA | 37787 |
| vhCDR2 | YASHRYT | 37789 |
| vhCDR3 | QQDFSSPRT | 37790 |
| scFv linker | GKPGSGKPGSGKPGSGKPGS | 37708 |
| Variable light (vl) domain | EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSS | 37790 |
| vlCDR1 | NYWMN | 37791 |
| vlCDR2 | EIRLYSNNYATHYAESVKG | 37792 |
| vlCDR3 | YYGNYGGYFDV | 37793 |
| scFv | EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIK/GKPGSGKPGSGKPGSGKPGS/EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSS | 37794 |

Figure 9E XENP20162 2E9_H1L1 anti-PD-1 Fv sequences

| What | sequence | SEQ ID NO: |
|---|---|---|
| Variable heavy (vh) domain | QVQLVQSGAEVKKPGASVKVSCKASGYAFTNYWLGWVRQAPGQGLEWMGNFYPGSSNTYYNEKFQGRVTMTADKSI STAYMELSRLRSDDTAVYFCARHYGTNYRYFDVWGAGTLVTVSS | 37795 |
| vhCDR1 | NYWLG | 37796 |
| vhCDR2 | NFYPGSSNTYYNEKFQG | 37797 |
| vhCDR3 | HYGTNYRYFDV | 37798 |
| scFv linker | GKPGSGKPGSGKPGS | 37708 |
| Variable light (vl) domain | DIVLTQSPGTLSLSPGERATLSCRASQSVSNDVAWYQQKPGQSPRLLIYYASNRYTGVPDRFTGSGYGTDFTLTIS RLEPEDFAVYFCQQDYSSPYTFGGGTKVEIK | 37799 |
| vlCDR1 | RASQSVSNDVA | 37800 |
| vlCDR2 | YASNRYT | 37801 |
| vlCDR3 | QQDYSSPYT | 37802 |
| scFv | QVQLVQSGAEVKKPGASVKVSCKASGYAFTNYWLGWVRQAPGQGLEWMGNFYPGSSNTYYNEKFQGRVTMTADKSI STAYMELSRLRSDDTAVYFCARHYGTNYRYFDVWGAGTLVTVSS/GKPGSGKPGSGKPGS/DIVLTQSPGT LSLSPGERATLSCRASQSVSNDVAWYQQKPGQSPRLLIYYASNRYTGVPDRFTGSGYGTDFTLTISRLEPEDFAVY FCQQDYSSPYTFGGGTKVEIK | 37803 |

Figure 10A [CTLA-4]_H0.25_L0 Anti-CTLA-4 Fv sequences (XENP19235 Fab, XENP19769 scFv)

| What | sequence | SEQ ID NO: |
|---|---|---|
| Variable heavy (vh) domain | QVQLVESGGGVVQPGRSLRLSCAASGFTFSSYAMHWVRQAPGKGLEWVTFISYDGNNKYYADSVKGRFTISRDNSKNTLYLQMNSLRAEDTAIYYCARTGWLGPFDYWGQGTLVTVSS | 37804 |
| vhCDR1 | SYAMH | 37805 |
| vhCDR2 | FISYDGNNKYYADSVKG | 37806 |
| vhCDR3 | TGWLGPFDY | 37807 |
| scFv linker | GKPGSGKPGSGKPGSGKPGS | 37708 |
| Variable light (vl) domain | EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 37808 |
| vlCDR1 | RASQSVGSSYLA | 37809 |
| vlCDR2 | GAFSRAT | 37810 |
| vlCDR3 | QQYGSSPWT | 37811 |
| scFv | QVQLVESGGGVVQPGRSLRLSCAASGFTFSSYAMHWVRQAPGKGLEWVTFISYDGNNKYYADSVKGRFTISRDNSKNTLYLQMNSLRAEDTAIYYCARTGWLGPFDYWGQGTLVTVSS/GKPGSGKPGSGKPGSGKPGS/EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK/ | 37812 |

Figure 10B [CTLA-4]_H0.26_L0 Anti-CTLA-4 Fv sequences (XENP19236 Fab, XENP19770 scFv)

| What | sequence | SEQ ID NO: |
|---|---|---|
| Variable heavy (vh) domain | QVQLVESGGGVVQPGRSLRLSCAASGFTFSSYGMHWVRQAPGKGLEWVTFISYDGNNKYYADSVKGRFTISRDNSKNTLYLQMNSLRAEDTAIYYCARTGWLGPFDYWGQGTLVTVSS | 37813 |
| vhCDR1 | SYGMH | 37814 |
| vhCDR2 | FISYDGNNKYYADSVKG | 37815 |
| vhCDR3 | TGWLGPFDY | 37816 |
| scFv linker | GKPGSGKPGSGKPGSGKPGS | 37708 |
| Variable light (vl) domain | EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 37817 |
| vlCDR1 | RASQSVGSSYLA | 37818 |
| vlCDR2 | GAFSRAT | 37819 |
| vlCDR3 | QQYGSSPWT | 37820 |
| scFv | QVQLVESGGGVVQPGRSLRLSCAASGFTFSSYGMHWVRQAPGKGLEWVTFISYDGNNKYYADSVKGRFTISRDNSKNTLYLQMNSLRAEDTAIYYCARTGWLGPFDYWGQGTLVTVSS/GKPGSGKPGSGKPGSGKPGS/EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 37821 |

Figure 10C [CTLA-4]_H0.27_L0 Anti-CTLA-4 Fv sequences (XENP19237 Fab, XENP19771 scFv)

| What | sequence | SEQ ID NO: |
|---|---|---|
| Variable heavy (vh) domain | QVQLVESGGGVVQPGRSLRLSCAASGFTFSSYSMHWVRQAPGKGLEWVTFISYDGNNKYYADSVKGRFTISRDNSKNT LYLQMNSLRAEDTAIYYCARTGWLGPFDYWGQGTLVTVSS | 37822 |
| vhCDR1 | SYSMH | 37823 |
| vhCDR2 | FISYDGNNKYYADSVKG | 37824 |
| vhCDR3 | TGWLGPFDY | 37825 |
| scFv linker | GKPGSGKPGSGKPGSGKPGS | 37708 |
| Variable light (vl) domain | EIVLTQSPGTLSLSPGERATLSCRASQSVGSSYLAWYQQKPGQAPRLLIYGAFSRATGIPDRFSGSGSGTDFTLTISR LEPEDFAVYYCQQYGSSPWTFGQGTKVEIK | 37826 |
| vlCDR1 | RASQSVGSSYLA | 37827 |
| vlCDR2 | GAFSRAT | 37828 |
| vlCDR3 | QQYGSSPWT | 37829 |
| scFv | QVQLVESGGGVVQPGRSLRLSCAASGFTFSSYSMHWVRQAPGKGLEWVTFISYDGNNKYYADSVKGRFTISRDNSKNT LYLQMNSLRAEDTAIYYCARTGWLGPFDYWGQGTLVTVSS/GKPGSGKPGSGKPGSGKPGS/EIVLTQSPGTLSLSPG ERATLSCRASQSVGSSYLAWYQQKPGQAPRLLIYGAFSRATGIPDRFSGSGSGTDFTLTISRLEPEDFAVYYCQQYGS SPWTFGQGTKVEIK | 37830 |

Figure 10D [CTLA-4]_H0.29_L0 Fab XENP19773, scFv XENP19239

| What | sequence | SEQ ID NO: |
|---|---|---|
| Variable heavy (vh) domain | | |
| vhCDR1 | | |
| vhCDR2 | | |
| vhCDR3 | | |
| scFv linker | GKPGSGKPGSGKPGSGKPGS | 37708 |
| Variable light (vl) domain | | |
| vlCDR1 | | |
| vlCDR2 | | |
| vlCDR3 | | |
| scFv | QVQLVESGGGVVQPGRSLRLSCAASGFTFSSYSMHWVRQAPGKGLEWVTFISYDGNNKYYADSVKGRFTISRDNSKNT LYLQMNSLRAEDTAIYYCARTGWLGPFDYWGQGTLVTVSS/GKPGSGKPGSGKPGSGKPGS/EIVLTQSPGTLSLSPG ERATLSCRASQSVGSSYLAWYQQKPGQAPRLLIYGAFSRATGIPDRFSGSGSGTDFTLTISRLEPEDFAVYYCQQYGS SPWTFGQGTKVEIK | 37831 |

Figure 10E [CTLA-4]_H0.38_L0 (Fab XENP19248, scFv XENP19782)

| What | sequence | SEQ ID NO: |
|---|---|---|
| Variable heavy (vh) domain | QVQLVESGGGVVQPGRSLRLSCAASGFTFSSYTMHWVRQAPGKGLEWVAFISYDGNNKYYADSVKGRFTISRDNSKNTLYLQMNSLRAEDTAIYYCARTGWLGFFDYWGQGTLVTVSS | 37832 |
| vhCDR1 | SYTMH | 37833 |
| vhCDR2 | FISYDGNNKYYADSVKG | 37834 |
| vhCDR3 | TGWLGFFDY | 37835 |
| scFv linker | GKPGSGKPGSGKPGSGKPGS | 37708 |
| Variable light (vl) domain | EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 37836 |
| vlCDR1 | RASQSVGSSYLA | 37837 |
| vlCDR2 | GAFSRAT | 37838 |
| vlCDR3 | QQYGSSPWT | 37839 |
| scFv | QVQLVESGGGVVQPGRSLRLSCAASGFTFSSYTMHWVRQAPGKGLEWVAFISYDGNNKYYADSVKGRFTISRDNSKNTLYLQMNSLRAEDTAIYYCARTGWLGFFDYWGQGTLVTVSS/GKPGSGKPGSGKPGSGKPGS/EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK/ | 37840 |

Figure 10F [CTLA-4]_H0.39_L0 (Fab XENP19249, scFv XENP19783)

| What | sequence | SEQ ID NO: |
|---|---|---|
| Variable heavy (vh) domain | QVQLVESGGGVVQPGRSLRLSCAASGFTFSSYTMHWVRQAPGKGLEWVGFISYDGNNKYYADSVKGRFTISRDNSKNTLYLQMNSLRAEDTAIYYCARTGWLGFFDYWGQGTLVTVSS | 37841 |
| vhCDR1 | SYTMH | 37842 |
| vhCDR2 | FISYDGNNKYYADSVKG | 37843 |
| vhCDR3 | TGWLGFFDY | 37844 |
| scFv linker | GKPGSGKPGSGKPGSGKPGS | 37708 |
| Variable light (vl) domain | EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 37845 |
| vlCDR1 | RASQSVGSSYLA | 37846 |
| vlCDR2 | GAFSRAT | 37847 |
| vlCDR3 | QQYGSSPWT | 37848 |
| scFv | QVQLVESGGGVVQPGRSLRLSCAASGFTFSSYTMHWVRQAPGKGLEWVGFISYDGNNKYYADSVKGRFTISRDNSKNTLYLQMNSLRAEDTAIYYCARTGWLGFFDYWGQGTLVTVSS/GKPGSGKPGSGKPGSGKPGS/EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 37849 |

Figure 10G [CTLA-4]_H0.40_L0 (Fab XENP19250, scFv XENP19784)

| What | sequence | SEQ ID NO: |
|---|---|---|
| Variable heavy (vh) domain | QVQLVESGGGVVQPGRSLRLSCAASGFTFSSYTMHWVRQAPGKGLEWVSFISYDGNNKYYADSVKGRFTISRDNSKNTL YLQMNSLRAEDTAIYYCARTGWLGFFDYWGQGTLVTVSS | 37850 |
| vhCDR1 | SYTMH | 37851 |
| vhCDR2 | FISYDGNNKYYADSVKG | 37852 |
| vhCDR3 | TGWLGFFDY | 37853 |
| scFv linker | GKPGSGKPGSGKPGSGKPGS | 37708 |
| Variable light (vl) domain | EIVLTQSPGTLSLSPGERATLSCRASQSVGSSYLAWYQQKPGQAPRLLIYGAFSRATGIPDRFSGSGSGTDFTLTISRL EPEDFAVYYCQQYGSSPWTFGQGTKVEIK | 37854 |
| vlCDR1 | RASQSVGSSYLA | 37855 |
| vlCDR2 | GAFSRAT | 37856 |
| vlCDR3 | QQYGSSPWT | 37857 |
| scFv | QVQLVESGGGVVQPGRSLRLSCAASGFTFSSYTMHWVRQAPGKGLEWVSFISYDGNNKYYADSVKGRFTISRDNSKNTL YLQMNSLRAEDTAIYYCARTGWLGFFDYWGQGTLVTVSS/GKPGSGKPGSGKPGSGKPGS/EIVLTQSPGTLSLSPGER ATLSCRASQSVGSSYLAWYQQKPGQAPRLLIYGAFSRATGIPDRFSGSGSGTDFTLTISRLEPEDFAVYYCQQYGSSPW TFGQGTKVEIK | 37858 |

Figure 10H [CTLA-4]_H0.70_L0 (Fab XENP19280, scFv XENP19818)

| What | sequence | SEQ ID NO: |
|---|---|---|
| Variable heavy (vh) domain | QVQLVESGGGVVQPGRSLRLSCAASGFTFSSYTMHWVRQAPGKGLEWVTFISYDGSNKYYADSVKGRFTISRDNSKNT LYLQMNSLRAEDTAIYYCARTGWLGFFDYWGQGTLVTVSS | 37859 |
| vhCDR1 | SYTMH | 37860 |
| vhCDR2 | FISYDGSNKYYADSVKG | 37861 |
| vhCDR3 | TGWLGFFDY | 37862 |
| scFv linker | GKPGSGKPGSGKPGSGKPGS | 37708 |
| Variable light (vl) domain | EIVLTQSPGTLSLSPGERATLSCRASQSVGSSYLAWYQQKPGQAPRLLIYGAFSRATGIPDRFSGSGSGTDFTLTISR LEPEDFAVYYCQQYGSSPWTFGQGTKVEIK | 37863 |
| vlCDR1 | RASQSVGSSYLA | 37864 |
| vlCDR2 | GAFSRAT | 37865 |
| vlCDR3 | QQYGSSPWT | 37866 |
| scFv | QVQLVESGGGVVQPGRSLRLSCAASGFTFSSYTMHWVRQAPGKGLEWVTFISYDGSNKYYADSVKGRFTISRDNSKNT LYLQMNSLRAEDTAIYYCARTGWLGFFDYWGQGTLVTVSS/GKPGSGKPGSGKPGSGKPGS/EIVLTQSPGTLSLSPG ERATLSCRASQSVGSSYLAWYQQKPGQAPRLLIYGAFSRATGIPDRFSGSGSGTDFTLTISRLEPEDFAVYYCQQYGS SPWTFGQGTKVEIK | 37867 |

Figure 10I [CTLA-4]_H0_L0.22 (Fab XENP19437, scFv XENP19910)

| What | sequence | SEQ ID NO: |
|---|---|---|
| Variable heavy (vh) domain | QVQLVESGGGVVQPGRSLRLSCAASGFTFSSYTMHWVRQAPGKGLEWVTFISYDGNNKYYADSVKGRFTISRDNSKNT LYLQMNSLRAEDTAIYYCARTGWLGPFDYWGQGTLVTVSS | 37868 |
| vhCDR1 | SYTMH | 37869 |
| vhCDR2 | FISYDGNNKYYADSVKG | 37870 |
| vhCDR3 | TGWLGPFDY | 37871 |
| scFv linker | GKPGSGKPGSGKPGSGKPGS | 37708 |
| Variable light (vl) domain | EIVLTQSPGTLSLSPGERATLSCRASQSVSSSYLAWYQQKPGQAPRLLIYGAFSRATGIPDRFSGSGSGTDFTLTISR LEPEDFAVYYCQQYGSSPWTFGQGTKVEIK | 37872 |
| vlCDR1 | RASQSVSSSYLA | 37873 |
| vlCDR2 | GAFSRAT | 37874 |
| vlCDR3 | QQYGSSPWT | 37875 |
| scFv | QVQLVESGGGVVQPGRSLRLSCAASGFTFSSYTMHWVRQAPGKGLEWVTFISYDGNNKYYADSVKGRFTISRDNSKNT LYLQMNSLRAEDTAIYYCARTGWLGPFDYWGQGTLVTVSS/GKPGSGKPGSGKPGSGKPGS/EIVLTQSPGTLSLSPG ERATLSCRASQSVSSSYLAWYQQKPGQAPRLLIYGAFSRATGIPDRFSGSGSGTDFTLTISRLEPEDFAVYYCQQYGS SPWTFGQGTKVEIK | 37876 |

Figure 10J [CTLA-4]_H2_L0 (Fab XENP,19545 scFv XENP19552)

| What | sequence | SEQ ID NO: |
|---|---|---|
| Variable heavy (vh) domain | EVQLVESGGGLVQPGGSLRLSCAASGFTFSSYTMHWVRQAPGKGLEWVTFISYDGNNKYYPGSVKGRFTISRENAKNS LYLQMNSLRAGDTAVYYCARTGWLGPFDYWGQGTLVTVSS | 37877 |
| vhCDR1 | SYTMH | 37878 |
| vhCDR2 | FISYDGNNKYYPGSVKG | 37879 |
| vhCDR3 | TGWLGPFDY | 37880 |
| scFv linker | GKPGSGKPGSGKPGSGKPGS | 37708 |
| Variable light (vl) domain | EIVLTQSPGTLSLSPGERATLSCRASQSVGSSYLAWYQQKPGQAPRLLIYGAFSRATGIPDRFSGSGSGTDFTLTISR LEPEDFAVYYCQQYGSSPWTFGQGTKVEIK | 37881 |
| vlCDR1 | RASQSVGSSYLA | 37882 |
| vlCDR2 | GAFSRAT | 37883 |
| vlCDR3 | QQYGSSPWT | 37884 |
| scFv | EVQLVESGGGLVQPGGSLRLSCAASGFTFSSYTMHWVRQAPGKGLEWVTFISYDGNNKYYPGSVKGRFTISRENAKNS LYLQMNSLRAGDTAVYYCARTGWLGPFDYWGQGTLVTVSS/GKPGSGKPGSGKPGSGKPGS/EIVLTQSPGTLSLSPG ERATLSCRASQSVGSSYLAWYQQKPGQAPRLLIYGAFSRATGIPDRFSGSGSGTDFTLTISRLEPEDFAVYYCQQYGS SPWTFGQGTKVEIK | 37885 |

Figure 10K [CTLA-4]_H3.21_L0.124 (Fab XENP20422, scFv XENP20431)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNTKYYADSVKGRFTISRDNAKNS LYLQMNSLRAEDTAVYYCARGGLLGPFDLWGQGTMVTVSS | 37886 |
| vhCDR1 | SYTMH | 37887 |
| vhCDR2 | FISYDGNTKYYADSVKG | 37888 |
| vhCDR3 | GGLLGPFDL | 37889 |
| scFv linker | GKPGSGKPGSGKPGSGKPGS | 37708 |
| Variable light (vl) domain | EIVLTQSPATLSVSPGERATLSCRASQSVGSSYLAWYQQKPGQAPRLLIYGASSRATGIPDRFSGSGSGTDFTLTISR LEPEDFAVYYCQQYGSSPWTFGQGTKVEIK | 37890 |
| vlCDR1 | RASQSVGSSYLA | 37891 |
| vlCDR2 | GASSRAT | 37892 |
| vlCDR3 | QQYGSSPWT | 37893 |
| scFv | EVQLVESGGGLVKPGGSLRLSCAASGFTFSSYTMHWVRQAPGKGLEWVSFISYDGNTKYYADSVKGRFTISRDNAKNS LYLQMNSLRAEDTAVYYCARGGLLGPFDLWGQGTMVTVSS/GKPGSGKPGSGKPGSGKPGS/EIVLTQSPATLSVSPG ERATLSCRASQSVGSSYLAWYQQKPGQAPRLLIYGASSRATGIPDRFSGSGSGTDFTLTISRLEPEDFAVYYCQQYGS SPWTFGQGTKVEIK | 37894 |

Figure 10L [CTLA-4]_H3.21_L0.129 (Fab XENP20423, scFv XENP20432)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNTKYYADSVKGRFTISRDNAKNS LYLQMNSLRAEDTAVYYCARGGLLGPFDLWGQGTMVTVSS | 37895 |
| vhCDR1 | SYTMH | 37896 |
| vhCDR2 | FISYDGNTKYYADSVKG | 37897 |
| vhCDR3 | GGLLGPFDL | 37898 |
| scFv linker | GKPGSGKPGSGKPGSGKPGS | 37708 |
| Variable light (vl) domain | EIVLTQSPATLSLSPGERATLSCRASQSVGSSYLAWYQQKPGQAPRLLIYGASSRATGIPDRFSGSGSGTDFTLTISR LEPEDFAVYYCQQYGSSPWTFGQGTKVEIK | 37899 |
| vlCDR1 | RASQSVGSSYLA | 37900 |
| vlCDR2 | GASSRAT | 37901 |
| vlCDR3 | QQYGSSPWT | 37902 |
| scFv | EVQLVESGGGLVKPGGSLRLSCAASGFTFSSYTMHWVRQAPGKGLEWVSFISYDGNTKYYADSVKGRFTISRDNAKNS LYLQMNSLRAEDTAVYYCARGGLLGPFDLWGQGTMVTVSS/GKPGSGKPGSGKPGSGKPGS/EIVLTQSPATLSLSPG ERATLSCRASQSVGSSYLAWYQQKPGQAPRLLIYGASSRATGIPDRFSGSGSGTDFTLTISRLEPEDFAVYYCQQYGS SPWTFGQGTKVEIK | 37903 |

Figure 10M [CTLA-4]_H3.21_L0.132 (Fab XENP20424, scFv XENP20433)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSS | 37904 |
| vhCDR1 | SYTMH | 37905 |
| vhCDR2 | FISYDGNTKYYADSVKG | 37906 |
| vhCDR3 | GGLLGPFDL | 37907 |
| scFv linker | GKPGSGKPGSGKPGSGKPGS | 37708 |
| Variable light (vl) domain | EIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK | 37908 |
| vlCDR1 | RASQSVSSSYLA | 37909 |
| vlCDR2 | GASSRAT | 37910 |
| vlCDR3 | QQYGSSPWT | 37911 |
| scFv | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSS/GKPGSGKPGSGKPGSGKPGS/EIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK | 37912 |

Figure 10N [CTLA-4]_H3.23_L0.124 (Fab XENP20425, scFv XENP20434)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGHLGPFDLWGQGTMVTVSS | 37913 |
| vhCDR1 | SYTMH | 37914 |
| vhCDR2 | FISYDGNYKYYADSVKG | 37915 |
| vhCDR3 | GGHLGPFDL | 37916 |
| scFv linker | GKPGSGKPGSGKPGSGKPGS | 37708 |
| Variable light (vl) domain | EIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 37917 |
| vlCDR1 | RASQSVGSSYLA | 37918 |
| vlCDR2 | GASSRAT | 37919 |
| vlCDR3 | QQYGSSPWT | 37920 |
| scFv | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSS/GKPGSGKPGSGKPGSGKPGS/EIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 37921 |

Figure 10O [CTLA-4]_H3.23_L0.129 (Fab XENP20426, scFv XENP20435)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGFFDLWGQGTMVTVSS | 37922 |
| vhCDR1 | SYTMH | 37923 |
| vhCDR2 | FISYDGNYKYYADSVKG | 37924 |
| vhCDR3 | GGHLGFFDL | 37925 |
| scFv linker | GKPGSGKPGSGKPGSGKPGS | 37708 |
| Variable light (vl) domain | EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 37926 |
| vlCDR1 | RASQSVGSSYLA | 37927 |
| vlCDR2 | GASSRAT | 37928 |
| vlCDR3 | QQYGSSPWT | 37929 |
| scFv | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGFFDLWGQGTMVTVSS/GKPGSGKPGSGKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 37930 |

Figure 10P [CTLA-4]_H3.23_L0.132 (Fab XENP20427, scFv XENP20436)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGFFDLWGQGTMVTVSS | 37931 |
| vhCDR1 | SYTMH | 37932 |
| vhCDR2 | FISYDGNYKYYADSVKG | 37933 |
| vhCDR3 | GGHLGFFDL | 37934 |
| scFv linker | GKPGSGKPGSGKPGSGKPGS | 37708 |
| Variable light (vl) domain | EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 37935 |
| vlCDR1 | RASQSVGSSYLA | 37936 |
| vlCDR2 | GASSRAT | 37937 |
| vlCDR3 | QQYGSSPWT | 37938 |
| scFv | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGFFDLWGQGTMVTVSS/GKPGSGKPGSGKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 37939 |

Figure 10Q [CTLA-4] H3.25_L0.124 (Fab XENP20428, scFv XENP20437)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNYKYYADSVKGRFTISRDNAKNS LYLQMNSLRAEDTAVYYCARGGLLGPFDLWGQGTMVTVSS | 37940 |
| vhCDR1 | SYTMH | 37941 |
| vhCDR2 | FISYDGNYKYYADSVKG | 37942 |
| vhCDR3 | GGLLGPFDL | 37943 |
| scFv linker | GKPGSGKPGSGKPGSGKPGS | 37708 |
| Variable light (vl) domain | EIVLTQSPATLSVSPGERATLSCRASQSVGSSYLAWYQQKPGQAPRLLIYGASSRATGIPDRFSGSGSGTDFTLTISR LEPEDFAVYYCQQYGSSPWTFGQGTKVEIK | 37944 |
| vlCDR1 | RASQSVGSSYLA | 37945 |
| vlCDR2 | GASSRAT | 37946 |
| vlCDR3 | QQYGSSPWT | 37947 |
| scFv | EVQLVESGGGLVKPGGSLRLSCAASGFTFSSYTMHWVRQAPGKGLEWVSFISYDGNYKYYADSVKGRFTISRDNAKNS LYLQMNSLRAEDTAVYYCARGGLLGPFDLWGQGTMVTVSS/GKPGSGKPGSGKPGSGKPGS/EIVLTQSPATLSVSPG ERATLSCRASQSVGSSYLAWYQQKPGQAPRLLIYGASSRATGIPDRFSGSGSGTDFTLTISRLEPEDFAVYYCQQYGS SPWTFGQGTKVEIK | 37948 |

Figure 10R [CTLA-4] H3.25_L0.129 (Fab XENP20429, scFv XENP20438)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNYKYYADSVKGRFTISRDNAKNS LYLQMNSLRAEDTAVYYCARGGLLGPFDLWGQGTMVTVSS | 37949 |
| vhCDR1 | SYTMH | 37950 |
| vhCDR2 | FISYDGNYKYYADSVKG | 37951 |
| vhCDR3 | GGLLGPFDL | 37952 |
| scFv linker | GKPGSGKPGSGKPGSGKPGS | 37708 |
| Variable light (vl) domain | EIVLTQSPATLSLSPGERATLSCRASQSVGSSYLAWYQQKPGQAPRLLIYGASSRATGIPDRFSGSGSGTDFTLTISR LEPEDFAVYYCQQYGSSPWTFGQGTKVEIK | 37953 |
| vlCDR1 | RASQSVGSSYLA | 37954 |
| vlCDR2 | GASSRAT | 37955 |
| vlCDR3 | QQYGSSPWT | 37956 |
| scFv | EVQLVESGGGLVKPGGSLRLSCAASGFTFSSYTMHWVRQAPGKGLEWVSFISYDGNYKYYADSVKGRFTISRDNAKNS LYLQMNSLRAEDTAVYYCARGGLLGPFDLWGQGTMVTVSS/GKPGSGKPGSGKPGSGKPGS/EIVLTQSPATLSLSPG ERATLSCRASQSVGSSYLAWYQQKPGQAPRLLIYGASSRATGIPDRFSGSGSGTDFTLTISRLEPEDFAVYYCQQYGS SPWTFGQGTKVEIK | 37957 |

Figure 10S [CTLA-4]_H3.25_L0.132 (Fab XENP20430, scFv XENP20439)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGFFDLWGQGTMVTVSS | 37958 |
| vhCDR1 | SYTMH | 37959 |
| vhCDR2 | FISYDGNYKYYADSVKG | 37960 |
| vhCDR3 | GGLLGFFDL | 37961 |
| scFv linker | GKPGSGKPGSGKPGSGKPGS | 37708 |
| Variable light (vl) domain | EIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK | 37962 |
| vlCDR1 | RASQSVSSSYLA | 37963 |
| vlCDR2 | GASSRAT | 37964 |
| vlCDR3 | QQYGSSPWT | 37965 |
| scFv | EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGFFDLWGQGTMVTVSS/GKPGSGKPGSGKPGSGKPGS/EIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK | 37966 |

Figure 10T [CTLA-4]_H3.4_L0.118 (Fab XENP20341, scFv XENP20378)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDENHKYYADSVKGRFTISRDNAKNSLYLQMNSLRAEDTAVYYCARTGHLGFFDLWGQGTMVTVSS | 37967 |
| vhCDR1 | SSYTMH | 37968 |
| vhCDR2 | FISYDGNHKYYADSVKG | 37969 |
| vhCDR3 | TGHLGFFDL | 37970 |
| scFv linker | GKPGSGKPGSGKPGSGKPGS | 37708 |
| Variable light (vl) domain | EIVLTQSPATLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 37971 |
| vlCDR1 | RASQSVGSSYLA | 37972 |
| vlCDR2 | GAFSRAT | 37973 |
| vlCDR3 | QQYGSSPWT | 37974 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGFFDLWGQGTMVTVSS/GKPGSGKPGSGKPGSGKPGS/EIVLTQSPATLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 37975 |

Figure 10U [CTLA-4]_H3.4_L0.119 (Fab XENP20342, scFv XENP20379)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 37976 |
| vhCDR1 | SYTMH | 37977 |
| vhCDR2 | FISYDGNHKYYADSVKG | 37978 |
| vhCDR3 | TGHLGPFDL | 37979 |
| scFv linker | GKPGSGKPGSGKPGSGKPGS | 37708 |
| Variable light (vl) domain | EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 37980 |
| vlCDR1 | RASQSVGSSYLA | 37981 |
| vlCDR2 | GAFSRAT | 37982 |
| vlCDR3 | QQYGSSPWT | 37983 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 37984 |

Figure 10V [CTLA-4]_H3.4_L0.12 (Fab XENP20071, scFv XENP20078)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 37985 |
| vhCDR1 | SYTMH | 37986 |
| vhCDR2 | FISYDGNHKYYADSVKG | 37987 |
| vhCDR3 | TGHLGPFDL | 37988 |
| scFv linker | GKPGSGKPGSGKPGSGKPGS | 37708 |
| Variable light (vl) domain | EIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 37989 |
| vlCDR1 | RASQSVGSSYLA | 37990 |
| vlCDR2 | GAFSRAT | 37991 |
| vlCDR3 | QQYGSSPWT | 37992 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 37993 |

Figure 10W [CTLA-4]_H3.4_L0.121 (Fab XENP20344, scFv XENP20381)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 37994 |
| vhCDR1 | SYTMH | 37995 |
| vhCDR2 | FISYDGNHKYYADSVKG | 37996 |
| vhCDR3 | TGHLGPFDL | 37997 |
| scFv linker | GKPGSGKPGSGKPGSGKPGS | 37708 |
| Variable light (vl) domain | EIVLTQSPGTLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 37998 |
| vlCDR1 | RASQSVGSSYLA | 37999 |
| vlCDR2 | GASSRAT | 38000 |
| vlCDR3 | QQYGSSPWT | 38001 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPGTLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 38002 |

Figure 10X [CTLA-4]_H3.4_L0.122 (Fab XENP20345, scFv XENP20382)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 38003 |
| vhCDR1 | SYTMH | 38004 |
| vhCDR2 | FISYDGNHKYYADSVKG | 38005 |
| vhCDR3 | TGHLGPFDL | 38006 |
| scFv linker | GKPGSGKPGSGKPGSGKPGS | 37708 |
| Variable light (vl) domain | EIVLTQSPATLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 38007 |
| vlCDR1 | RASQSVGSSYLA | 38008 |
| vlCDR2 | GAFSRAT | 38009 |
| vlCDR3 | QQYGSSPWT | 38010 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPATLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 38011 |

Figure 10Y [CTLA-4]_H3.4_L0.123 (Fab XENP20346, scFv XENP20383)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 38012 |
| vhCDR1 | SYTMH | 38013 |
| vhCDR2 | FISYDGNHKYYADSVKG | 38014 |
| vhCDR3 | TGHLGPFDL | 38015 |
| scFv linker | GKPGSGKPGSGKPGSGKPGS | 37708 |
| Variable light (vl) domain | EIVLTQSPATLSVSPGERATLSCRASQSVGSSSYLAWYQQKPGQAPRLLIYGAFSRATGIPDRFSGSGSGTDFTLTISRLEPEDFAVYYCQQYGSSPWTFGQGTKVEIK | 38016 |
| vlCDR1 | RASQSVGSSSYLA | 38017 |
| vlCDR2 | GAFSRAT | 38018 |
| vlCDR3 | QQYGSSPWT | 38019 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPATLSVSPGERATLSCRASQSVGSSSYLAWYQQKPGQAPRLLIYGAFSRATGIPDRFSGSGSGTDFTLTISRLEPEDFAVYYCQQYGSSPWTFGQGTKVEIK | 38020 |

Figure 10Z [CTLA-4]_H3.4_L0.124 (Fab XENP20347, scFv XENP20384)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 38021 |
| vhCDR1 | SYTMH | 38022 |
| vhCDR2 | FISYDGNHKYYADSVKG | 38023 |
| vhCDR3 | TGHLGPFDL | 38024 |
| scFv linker | GKPGSGKPGSGKPGSGKPGS | 37708 |
| Variable light (vl) domain | EIVLTQSPATLSVSPGERATLSCRASQSVGSSSYLAWYQQKPGQAPRLLIYGASSRATGIPDRFSGSGSGTDFTLTISRLEPEDFAVYYCQQYGSSPWTFGQGTKVEIK | 38025 |
| vlCDR1 | RASQSVGSSSYLA | 38026 |
| vlCDR2 | GASSRAT | 38027 |
| vlCDR3 | QQYGSSPWT | 38028 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPATLSVSPGERATLSCRASQSVGSSSYLAWYQQKPGQAPRLLIYGASSRATGIPDRFSGSGSGTDFTLTISRLEPEDFAVYYCQQYGSSPWTFGQGTKVEIK | 38029 |

Figure 10AA [CTLA-4]_H3.4_L0.125 (Fab XENP20348, scFv XENP20385)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMN SLRAEDTAVYYCARTGHLGPFDLWGQGTMVTVSS | 38030 |
| vhCDR1 | SYTMH | 38031 |
| vhCDR2 | FISYDGNHKYYADSVKG | 38032 |
| vhCDR3 | TGHLGPFDL | 38033 |
| scFv linker | GKPGSGKPGSGKPGSGKPGS | 37708 |
| Variable light (vl) domain | EIVLTQSPGTLSLSPGERATLSCRASQSVGSSSYLAWYQQKPGQAPRLLIYGAFSRATGIPDRFSGSGSGTDFTLTISRLEPEDF AVYYCQQYGSSPWTFGQGTKVEIK | 38034 |
| vlCDR1 | RASQSVSSSYLA | 38035 |
| vlCDR2 | GAFSRAT | 38036 |
| vlCDR3 | QQYGSSPWT | 38037 |
| scFv | EVQLVESGGGLVKPGGSLRLSCAASGFTFSSYTMHWVRQAPGKGLEWVSFISYDGNHKYYADSVKGRFTISRDNAKNSLYLQMN SLRAEDTAVYYCARTGHLGPFDLWGQGTMVTVSS/GKPGSGKPGSGKPGSGKPGS/EIVLTQSPGTLSLSPGERATLSCRASQS VGSSSYLAWYQQKPGQAPRLLIYGAFSRATGIPDRFSGSGSGTDFTLTISRLEPEDFAVYYCQQYGSSPWTFGQGTKVEIK | 38038 |

Figure 10BB [CTLA-4]_H3.4_L0.126 (Fab XENP20349, scFv XENP20386)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMN SLRAEDTAVYYCARTGHLGPFDLWGQGTMVTVSS | 38039 |
| vhCDR1 | SYTMH | 38040 |
| vhCDR2 | FISYDGNHKYYADSVKG | 38041 |
| vhCDR3 | TGHLGPFDL | 38042 |
| scFv linker | GKPGSGKPGSGKPGSGKPGS | 37708 |
| Variable light (vl) domain | EIVLTQSPGTLSLSPGERATLSCRASQSVGSSSYLAWYQQKPGQAPRLLIYGASSRATGIPDRFSGSGSGTDFTLTISRLEPEDF AVYYCQQYGSSPWTFGQGTKVEIK | 38043 |
| vlCDR1 | RASQSVGSSSYLA | 38044 |
| vlCDR2 | GASSRAT | 38045 |
| vlCDR3 | QQYGSSPWT | 38046 |
| scFv | EVQLVESGGGLVKPGGSLRLSCAASGFTFSSYTMHWVRQAPGKGLEWVSFISYDGNHKYYADSVKGRFTISRDNAKNSLYLQMN SLRAEDTAVYYCARTGHLGPFDLWGQGTMVTVSS/GKPGSGKPGSGKPGSGKPGS/EIVLTQSPGTLSLSPGERATLSCRASQS VGSSSYLAWYQQKPGQAPRLLIYGASSRATGIPDRFSGSGSGTDFTLTISRLEPEDFAVYYCQQYGSSPWTFGQGTKVEIK | 38047 |

Figure 10CC [CTLA-4]_H3.4_L0.127 (Fab XENP20350, scFv XENP20387)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 38048 |
| vhCDR1 | SYTMH | 38049 |
| vhCDR2 | FISYDGNHKYYADSVKG | 38050 |
| vhCDR3 | TGHLGPFDL | 38051 |
| scFv linker | GKPGSGKPGSGKPGSGKPGS | 37708 |
| Variable light (vl) domain | EIVLTQSPGTLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK | 38052 |
| vlCDR1 | RASQSVSSSYLA | 38053 |
| vlCDR2 | GASSRAT | 38054 |
| vlCDR3 | QQYGSSPWT | 38055 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPGTLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK | 38056 |

Figure 10DD [CTLA-4]_H3.4_L0.128 (Fab XENP20351, scFv XENP20388)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 38057 |
| vhCDR1 | SYTMH | 38058 |
| vhCDR2 | FISYDGNHKYYADSVKG | 38059 |
| vhCDR3 | TGHLGPFDL | 38060 |
| scFv linker | GKPGSGKPGSGKPGSGKPGS | 37708 |
| Variable light (vl) domain | EIVLTQSPATLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK | 38061 |
| vlCDR1 | RASQSVSSSYLA | 38062 |
| vlCDR2 | GAFSRAT | 38063 |
| vlCDR3 | QQYGSSPWT | 38064 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPATLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK | 38065 |

Figure 10EE [CTLA-4]_H3.4_L0.129 (Fab XENP20352, scFv XENP20389)

| What | sequence | SEQ ID NO: |
|---|---|---|
| Variable heavy (vh) domain | | |
| vhCDR1 | | |
| vhCDR2 | | |
| vhCDR3 | | |
| scFv linker | GKPGSGKPGSGKPGSGKPGS | 37708 |
| Variable light (vl) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 38066 |
| vlCDR1 | SYTMH | 38067 |
| vlCDR2 | FISYDGNHKYYADSVKG | 38068 |
| vlCDR3 | TGHLGPFDL | 38069 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK | 38070 |

Figure 10FF [CTLA-4]_H3.4_L0.130 (Fab XENP20353, scFv XENP20390)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS | 38071 |
| vhCDR1 | SYTMH | 38072 |
| vhCDR2 | FISYDGNHKYYADSVKG | 38073 |
| vhCDR3 | TGHLGPFDL | 38074 |
| scFv linker | GKPGSGKPGSGKPGSGKPGS | 37708 |
| Variable light (vl) domain | EIVLTQSPATLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK | 38075 |
| vlCDR1 | RASQSVSSSYLA | 38076 |
| vlCDR2 | GASSRAT | 38077 |
| vlCDR3 | QQYGSSPWT | 38078 |
| scFv | EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGSGKPGSGKPGS/EIVLTQSPATLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK | 38079 |

Figure 10GG [CTLA-4]_H3.4_L0.131 (Fab XENP20354, scFv XENP20391)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQM NSLRAEDTAVYYCARTGHLGPFDLWGQGTMVTVSS | 38080 |
| vhCDR1 | SYTMH | 38081 |
| vhCDR2 | FISYDGNHKYYADSVKG | 38082 |
| vhCDR3 | TGHLGPFDL | 38083 |
| scFv linker | GKPGSGKPGSGKPGSGKPGS | 37708 |
| Variable light (vl) domain | EIVLTQSPGTLSLSPGERATLSCRASQSVSSSYLAWYQQKPGQAPRLLIYGASSRATGIPDRFSGSGSGTDFTLTISRLEPED FAVYYCQQYGSSPWTFGQGTKVEIK | 38084 |
| vlCDR1 | RASQSVSSSYLA | 38085 |
| vlCDR2 | GASSRAT | 38086 |
| vlCDR3 | QQYGSSPWT | 38087 |
| scFv | EVQLVESGGGLVKPGGSLRLSCAASGFTFSSYTMHWVRQAPGKGLEWVSFISYDGNHKYYADSVKGRFTISRDNAKNSLYLQM NSLRAEDTAVYYCARTGHLGPFDLWGQGTMVTVSS/GKPGSGKPGSGKPGSGKPGS/EIVLTQSPGTLSLSPGERATLSCRAS QSVSSSYLAWYQQKPGQAPRLLIYGASSRATGIPDRFSGSGSGTDFTLTISRLEPEDFAVYYCQQYGSSPWTFGQGTKVEIK | 38088 |

Figure 10HH [CTLA-4]_H3.4_L0.132 (Fab XENP20355, scFv XENP20392)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNHKYYADSVKGRFTISRDNAKNSLYLQM NSLRAEDTAVYYCARTGHLGPFDLWGQGTMVTVSS | 38089 |
| vhCDR1 | SYTMH | 38090 |
| vhCDR2 | FISYDGNHKYYADSVKG | 38091 |
| vhCDR3 | TGHLGPFDL | 38092 |
| scFv linker | GKPGSGKPGSGKPGSGKPGS | 37708 |
| Variable light (vl) domain | EIVLTQSPATLSLSPGERATLSCRASQSVSSSYLAWYQQKPGQAPRLLIYGASSRATGIPDRFSGSGSGTDFTLTISRLEPED FAVYYCQQYGSSPWTFGQGTKVEIK | 38093 |
| vlCDR1 | RASQSVSSSYLA | 38094 |
| vlCDR2 | GASSRAT | 38095 |
| vlCDR3 | QQYGSSPWT | 38096 |
| scFv | EVQLVESGGGLVKPGGSLRLSCAASGFTFSSYTMHWVRQAPGKGLEWVSFISYDGNHKYYADSVKGRFTISRDNAKNSLYLQM NSLRAEDTAVYYCARTGHLGPFDLWGQGTMVTVSS/GKPGSGKPGSGKPGSGKPGS/EIVLTQSPATLSLSPGERATLSCRAS QSVSSSYLAWYQQKPGQAPRLLIYGASSRATGIPDRFSGSGSGTDFTLTISRLEPEDFAVYYCQQYGSSPWTFGQGTKVEIK | 38097 |

Figure 10II [CTLA-4]_H3.5_L2.1 (Fab XENP20357, scFv XENP20394)

| What | sequence | SEQ ID NO: |
|---|---|---|
| Variable heavy (vh) domain | EVQLVESGGGLVKPGGSLRLSCAASGFTFSSSYTMHWVRQAPGKGLEWVSFISYDGNTKYYADSVKGRFTISRDNAKNSLYLQMNSLRAEDTAVYYCARTGHLGPFDLWGQGTMVTVSS | 38098 |
| vhCDR1 | SYTMH | 38099 |
| vhCDR2 | FISYDGNTKYYADSVKG | 38100 |
| vhCDR3 | TGHLGPFDL | 38101 |
| scFv linker | GKPGSGKPGSGKPGSGKPGS | 37708 |
| Variable light (vl) domain | EIVMTQSPATLSVSPGERATLSCRASQSVSSSYLAWYQQKPGQAPRLLIYGAFSRATGIPARFSGSGSGTEFTLTISSLQSEDFAVYYCQQYGSSPWTFGQGTKVEIK | 38102 |
| vlCDR1 | RASQSVSSSYLA | 38103 |
| vlCDR2 | GAFSRAT | 38104 |
| vlCDR3 | QQYGSSPWT | 38105 |
| scFv | EVQLVESGGGLVKPGGSLRLSCAASGFTFSSSYTMHWVRQAPGKGLEWVSFISYDGNTKYYADSVKGRFTISRDNAKNSLYLQMNSLRAEDTAVYYCARTGHLGPFDLWGQGTMVTVSS/GKPGSGKPGSGKPGSGKPGS/EIVMTQSPATLSVSPGERATLSCRASQSVSSSYLAWYQQKPGQAPRLLIYGAFSRATGIPARFSGSGSGTEFTLTISSLQSEDFAVYYCQQYGSSPWTFGQGTKVEIK | 38106 |

Figure 10JJ [CTLA-4]_H3.5_L2.2 (Fab XENP20358, scFv XENP20395)

| What | sequence | SEQ ID NO: |
|---|---|---|
| Variable heavy (vh) domain | EVQLVESGGGLVKPGGSLRLSCAASGFTFSSSYTMHWVRQAPGKGLEWVSFISYDGNTKYYADSVKGRFTISRDNAKNSLYLQMNSLRAEDTAVYYCARTGHLGPFDLWGQGTMVTVSS | 38107 |
| vhCDR1 | SYTMH | 38108 |
| vhCDR2 | FISYDGNTKYYADSVKG | 38109 |
| vhCDR3 | TGHLGPFDL | 38110 |
| scFv linker | GKPGSGKPGSGKPGSGKPGS | 37708 |
| Variable light (vl) domain | EIVMTQSPATLSVSPGERATLSCRASQSVSSSYLAWYQQKPGQAPRLLIYGASSRATGIPARFSGSGSGTEFTLTISSLQSEDFAVYYCQQYGSSPWTFGQGTKVEIK | 38111 |
| vlCDR1 | RASQSVSSSYLA | 38112 |
| vlCDR2 | GASSRAT | 38113 |
| vlCDR3 | QQYGSSPWT | 38114 |
| scFv | EVQLVESGGGLVKPGGSLRLSCAASGFTFSSSYTMHWVRQAPGKGLEWVSFISYDGNTKYYADSVKGRFTISRDNAKNSLYLQMNSLRAEDTAVYYCARTGHLGPFDLWGQGTMVTVSS/GKPGSGKPGSGKPGSGKPGS/EIVMTQSPATLSVSPGERATLSCRASQSVSSSYLAWYQQKPGQAPRLLIYGASSRATGIPARFSGSGSGTEFTLTISSLQSEDFAVYYCQQYGSSPWTFGQGTKVEIK | 38115 |

Figure 10KK [CTLA-4]_H3.5_L2.3 (Fab XENP20359, scFv XENP20396)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSS | 38116 |
| vhCDR1 | SYTMH | 38117 |
| vhCDR2 | FISYDGNTKYYADSVKG | 38118 |
| vhCDR3 | TGHLGPFDL | 38119 |
| scFv linker | GKPGSGKPGSGKPGSGKPGS | 37708 |
| Variable light (vl) domain | EIVMTQSPATLSVSPGERATLSCRASQSVSSSYLAWYQQKPGQAPRLLIYGASSRATGIPARFSGSGSGTEFTLTISSLQSEDFAVYYCQQYGSSPWTFGQGTKVEIK | 38120 |
| vlCDR1 | RASQSVSSSYLA | 38121 |
| vlCDR2 | GASSRAT | 38122 |
| vlCDR3 | QQYGSSPWT | 38123 |
| scFv | EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSS/GKPGSGKPGSGKPGSGKPGS/EIVMTQSPATLSVSPGERATLSCRASQSVSSSYLAWYQQKPGQAPRLLIYGASSRATGIPARFSGSGSGTEFTLTISSLQSEDFAVYYCQQYGSSPWTFGQGTKVEIK | 38124 |

Figure 10LL [CTLA-4]_H3_L0 (Fab XENP19546, scFv XENP19553)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGFFDYWGQGTLVTVSS | 38125 |
| vhCDR1 | SYTMH | 38126 |
| vhCDR2 | FISYDGNNKYYADSVKG | 38127 |
| vhCDR3 | TGWLGPFDY | 38128 |
| scFv linker | GKPGSGKPGSGKPGSGKPGS | 37708 |
| Variable light (vl) domain | EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 38129 |
| vlCDR1 | RASQSVGSSYLA | 38130 |
| vlCDR2 | GAFSRAT | 38131 |
| vlCDR3 | QQYGSSPWT | 38132 |
| scFv | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS/GKPGSGKPGSGKPGSGKPGS/EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 38133 |

Figure 10MM [CTLA-4]_H3_L0.22 (Fab XENP20011)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGFFDYWGQGTLVTVSS | 38134 |
| vhCDR1 | SYTMH | 38135 |
| vhCDR2 | FISYDGNNKYYADSVKG | 38136 |
| vhCDR3 | TGWLGFFDY | 38137 |
| scFv linker | GKPGSGKPGSGKPGSGKPGS | 37708 |
| Variable light (vl) domain | EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK | 38138 |
| vlCDR1 | RASQSVSSSYLA | 38139 |
| vlCDR2 | GAFSRAT | 38140 |
| vlCDR3 | QQYGSSPWT | 38141 |
| scFv | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGFFDYWGQGTLVTVSS/GKPGSGKPGSGKPGSGKPGS/EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK | 38142 |

Figure 10NN [CTLA-4]_H3_L0.44 (Fab XENP20052)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGFFDYWGQGTLVTVSS | 38143 |
| vhCDR1 | SYTMH | 38144 |
| vhCDR2 | FISYDGNNKYYADSVKG | 38145 |
| vhCDR3 | TGWLGFFDY | 38146 |
| scFv linker | GKPGSGKPGSGKPGSGKPGS | 37708 |
| Variable light (vl) domain | EIVLTQSPGTLSLSPGERATLSCRASQSVGSSYLSWYQQKPGQAPRLLIYGAFSRATGIPDRFSGSGSGTDFTLTISRLEPEDFAVYYCQQYGSSPWTFGQGTKVEIK | 38147 |
| vlCDR1 | RASQSVGSSYLS | 38148 |
| vlCDR2 | GAFSRAT | 38149 |
| vlCDR3 | QQYGSSPWT | 38150 |
| scFv | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGFFDYWGQGTLVTVSS/GKPGSGKPGSGKPGSGKPGS/EIVLTQSPGTLSLSPGERATLSCRASQSVGSSYLSWYQQKPGQAPRLLIYGAFSRATGIPDRFSGSGSGTDFTLTISRLEPEDFAVYYCQQYGSSPWTFGQGTKVEIK | 38151 |

Figure 10OO [CTLA-4]_H3_L0.67 (Fab XENP20018)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS | 38152 |
| vhCDR1 | SYTMH | 38153 |
| vhCDR2 | FISYDGNNKYYADSVKG | 38154 |
| vhCDR3 | TGWLGPFDY | 38155 |
| scFv linker | GKPGSGKPGSGKPGSGKPGS | 37708 |
| Variable light (vl) domain | EIVLTQSPGTLSLSPGERATLSCRASQSVGSSYLAWYQQKPGQAPRLLIYDAFSRATGIPDRFSGSGSGTDFTLTISRLEPEDFAVYYCQQYGSSPWTFGQGTKVEIK | 38156 |
| vlCDR1 | RASQSVGSSYLA | 38157 |
| vlCDR2 | DAFSRAT | 38158 |
| vlCDR3 | QQYGSSPWT | 38159 |
| scFv | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS/GKPGSGKPGSGKPGSGKPGS/EIVLTQSPGTLSLSPGERATLSCRASQSVGSSYLAWYQQKPGQAPRLLIYDAFSRATGIPDRFSGSGSGTDFTLTISRLEPEDFAVYYCQQYGSSPWTFGQGTKVEIK | 38160 |

Figure 10PP [CTLA-4]_H3_L0.74 (Fab XENP20020)

| What | sequence | SEQ ID NO: |
|---|---|---|
| Variable heavy (vh) domain | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS | 38161 |
| vhCDR1 | SYTMH | 38162 |
| vhCDR2 | FISYDGNNKYYADSVKG | 38163 |
| vhCDR3 | TGWLGPFDY | 38164 |
| scFv linker | GKPGSGKPGSGKPGSGKPGS | 37708 |
| Variable light (vl) domain | EIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIK | 38165 |
| vlCDR1 | RASQSVGSSYLA | 38166 |
| vlCDR2 | GAYSRAT | 38167 |
| vlCDR3 | QQYGSSPWT | 38168 |
| scFv | EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS/GKPGSGKPGSGKPGSGKPGS/EIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIK | 38169 |

Figure 11A
7G8_H3.30_L1.34 (Fab XENP22594)

| What | sequence | SEQ ID NO: |
|---|---|---|
| Variable heavy (vh) domain | EVQLVESGGGLVQPGGSLRLSCAASGFTFDDAWMSWVRQAPGKGLEWVAEISTKANNHATYYAESVK GRFTISRDDSKSSVYLQMNSLRAEDTAVYYCTRLATWDWYFDVWGQGTTVTVSS | 38170 |
| vhCDR1 | DAWMS | 38171 |
| vhCDR2 | EISTKANNHATYYAESVKG | 38172 |
| vhCDR3 | LATWDWYFDV | 38173 |
| Variable light (vl) domain | DIVLTQSPSSLSASVGDRVTITCRASQSVDYDGDSYMNWYQQKPGKPPKLLIYAASELESGIPARFS GSGSGTDFTLTISSLQPEDFATYYCQQSNEDPFTFGSGTKLEIK | 38174 |
| vlCDR1 | RASQSVDYDGDSYMN | 38175 |
| vlCDR2 | AASELES | 38176 |
| vlCDR3 | QQSNEDPFT | 38177 |

Figure 11B
2A11_H1.144_L2.142 (Fab XENP22656)

| What | sequence | SEQ ID NO: |
|---|---|---|
| Variable heavy (vh) domain | EVQLVQSGAEVKKPGATVKISCKASGFNIKDYFMHWVQQAPGKGLEWMGWIDPELGDTEYAPKFQGR VTITADTSTNTAYMELSSLRSEDTAVYYCYARGVYQALDYWGQGTLVTVSS | 38178 |
| vhCDR1 | DYFMH | 38179 |
| vhCDR2 | WIDPELGDTEYAPKFQG | 38180 |
| vhCDR3 | RGVYQALDY | 38181 |
| Variable light (vl) domain | DIQMTQSPAFLSVTPGEKVTITCQASQDIGNYLNWFQQKPGQTVKLLIYFTSYLHSGVPSRFSGSGS GTDYTFTISSLEAEDAATYFCQQGNTLPYTFGGGTKVEIK | 38182 |
| vlCDR1 | QASQDIGNYLN | 38183 |
| vlCDR2 | FTSYLHS | 38184 |
| vlCDR3 | QQGNTLPYT | 38185 |

Figure 11C
7G8_H3.18_L1.11 (Fab XENP21670)

| What | sequence | SEQ ID NO: |
|---|---|---|
| Variable heavy (vh) domain | EVQLVESGGGLVQPGGSLRLSCAASGFTFDLAWMDWVRQAPGKGLEWVAEISTKANNHATYYAESVKGRFTISRDDSKSSVYLQMNSLRAEDTAVYYCTRLATWDWYFDVWGQGTTVTVSS | 38186 |
| vhCDR1 | DAWMD | 38187 |
| vhCDR2 | EISTKANNHATYYAESVKG | 38188 |
| vhCDR3 | LATWDWYFDV | 38189 |
| Variable light (vl) domain | DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIK | 38190 |
| vlCDR1 | RASQSVDYDGDSYMN | 38191 |
| vlCDR2 | AASELES | 38192 |
| vlCDR3 | QQSNEDPFT | 38193 |

Figure 11D
2A11_H0L0 (Fab XENP20930)

| What | sequence | SEQ ID NO: |
|---|---|---|
| Variable heavy (vh) domain | EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWDWYFDVWGAGTTVTVSS | 38194 |
| vhCDR1 | DAWMD | 38195 |
| vhCDR2 | EIRTKANNHATYYAESVKG | 38196 |
| vhCDR3 | LANWDWYFDV | 38197 |
| Variable light (vl) domain | DTVLTQSPASLAVSLGQRATISCKASQSVDYDGDSYMNWYQQKPGQPPKLLIYAASNLESGIPARLSGSGSGTDFTLNIHPVEEEDAATYYCQQSNEDPFTFGSGTKLEVK | 38198 |
| vlCDR1 | KASQSVDYDGDSYMN | 38199 |
| vlCDR2 | AASNLES | 38200 |
| vlCDR3 | QQSNEDPFT | 38201 |

Figure 11E
2A11_H1.125_L2.113 (Fab XENP21921)

| What | sequence | SEQ ID NO: |
|---|---|---|
| Variable heavy (vh) domain | EVQLVQSGAEVKKPGATVKISCKASGFNIKHYEMHWVQQAPGKGLEWMGWIDPYLGDTEYAPKFQGR VTITADTSTNTAYMELSSLRSEDTAVYYCYARGVYQALDYWGQGTLVTVSS | 38202 |
| vhCDR1 | HYFMH | 38203 |
| vhCDR2 | WIDPYLGDTEYAPKFQG | 38204 |
| vhCDR3 | RGVYQALDY | 38205 |
| Variable light (vl) domain | DIQMTQSPAFLSVTPGEKVTITCQASQDIGNYLNWFQQKPDQTVKLLIYFTSYLHSGVPSRFSGSGS GTDYTFTISSLEAEDAATYFCQQGNTLPYTFGGGTKVEIK | 38206 |
| vlCDR1 | QASQDIGNYLN | 38207 |
| vlCDR2 | FTSYLHS | 38208 |
| vlCDR3 | QQGNTLPYT | 38209 |

Figure 11F
2A11_H1L2 (Fab XENP20847)

| What | sequence | SEQ ID NO: |
|---|---|---|
| Variable heavy (vh) domain | EVQLVQSGAEVKKPGATVKISCKASGFNIKDYYMHWVQQAPGKGLEWMGWIDPENGDTEYAPKFQGR VTITADTSTNTAYMELSSLRSEDTAVYYCYARGVRQALDYWGQGTLVTVSS | 38210 |
| vhCDR1 | DYYMH | 38211 |
| vhCDR2 | WIDPENGDTEYAPKFQG | 38212 |
| vhCDR3 | RGVRQALDY | 38213 |
| Variable light (vl) domain | DIQMTQSPAFLSVTPGEKVTITCQASQDIGNYLNWFQQKPDQTVKLLIYYTSRLHSGVPSRFSGSGS GTDYTFTISSLEAEDAATYFCQQGNTLPYTFGGGTKVEIK | 38214 |
| vlCDR1 | QASQDIGNYLN | 38215 |
| vlCDR2 | YTSRLHS | 38216 |
| vlCDR3 | QQGNTLPYT | 38217 |

Figure 11G
2A11_H1_L2.25 (Fab XENP21372)

| What | sequence | SEQ ID NO: |
|---|---|---|
| Variable heavy (vh) domain | EVQLVQSGAEVKKPGATVKISCKASGFNIKDYYMHWVQQAPGKGLEWMGWIDPENGDTEYAPKFQGR VTITADTSTNTAYMELSSLRSEDTAVYYCYARGVRQALDYWGQGTLVTVSS | 38218 |
| vhCDR1 | DYYMH | 38219 |
| vhCDR2 | WIDPENGDTEYAPKFQG | 38220 |
| vhCDR3 | RGVRQALDY | 38221 |
| Variable light (vl) domain | DIQMTQSPAFLSVTPGEKVTITCQASQDIGNHLNWFQQKPDQTVKLLIYYTSRLHSGVPSRFSGSGS GTDYTFTISSLEAEDAATYFCQQGNTLPYTFGGGTKVEIK | 38222 |
| vlCDR1 | QASQDIGNHLN | 38223 |
| vlCDR2 | YTSRLHS | 38224 |
| vlCDR3 | QQGNTLPYT | 38225 |

Figure 11H
2A11_H1_L2.47 (Fab XENP21394)

| What | sequence | SEQ ID NO: |
|---|---|---|
| Variable heavy (vh) domain | EVQLVQSGAEVKKPGATVKISCKASGFNIKDYYMHWVQQAPGKGLEWMGWIDPENGDTEYAPKFQGR VTITADTSTNTAYMELSSLRSEDTAVYYCYARGVRQALDYWGQGTLVTVSS | 38226 |
| vhCDR1 | DYYMH | 38227 |
| vhCDR2 | WIDPENGDTEYAPKFQG | 38228 |
| vhCDR3 | RGVRQALDY | 38229 |
| Variable light (vl) domain | DIQMTQSPAFLSVTPGEKVTITCQASQDIGNYLNWFQQKPDQTVKLLIYYTSRLHSGVPSRFSGSGS GTDYTFTISSLEAEDAATYFCQQGNTLPYTFGGGTKVEIK | 38230 |
| vlCDR1 | QASQDIGNYLN | 38231 |
| vlCDR2 | YTSRLHS | 38232 |
| vlCDR3 | QQGNTLPYT | 38233 |

Figure 11I
2A11_H1_L2.50 (Fab XENP21401)

| What | sequence | SEQ ID NO: |
|---|---|---|
| Variable heavy (vh) domain | EVQLVQSGAEVKKPGATVKISCKASGFNIKDYYMHWVQQAPGKGLEWMGWIDPENGDTEYAPKFQGR VTITADTSTNTAYMELSSLRSEDTAVYYCYARGVRQALDYWGQGTLVTVSS | 38234 |
| vhCDR1 | DYYMH | 38235 |
| vhCDR2 | WIDPENGDTEYAPKFQG | 38236 |
| vhCDR3 | RGVRQALDY | 38237 |
| Variable light (vl) domain | DIQMTQSPAFLSVTPGEKVTITCQASQDIGNYLNWFQQKPDQTVKLLIYYTSYLHSGVPSRFSGSGS GTDYTFTISSLEAEDAATYFCQQGNTLPYTFGGGTKVEIK | 38238 |
| vlCDR1 | QASQDIGNYLN | 38239 |
| vlCDR2 | YTSYLHS | 38240 |
| vlCDR3 | QQGNTLPYT | 38241 |

Figure 11J
2A11_H1L2 (Fab XENP20847)

| What | sequence | SEQ ID NO: |
|---|---|---|
| Variable heavy (vh) domain | EVQLVQSGAEVKKPGATVKISCKASGFNIKDYYMHWVQQAPGKGLEWMGWIDPENGDTEYAPKFQGR VTITADTSTNTAYMELSSLRSEDTAVYYCYARGVRQALDYWGQGTLVTVSS | 38242 |
| vhCDR1 | DYYMH | 38243 |
| vhCDR2 | WIDPENGDTEYAPKFQG | 38244 |
| vhCDR3 | RGVRQALDY | 38245 |
| Variable light (vl) domain | DIQMTQSPAFLSVTPGEKVTITCQASQDIGNYLNWFQQKPDQTVKLLIYYTSRLHSGVPSRFSGSGS GTDYTFTISSLEAEDAATYFCQQGNTLPYTFGGGTKVEIK | 38246 |
| vlCDR1 | QASQDIGNYLN | 38247 |
| vlCDR2 | YTSRLHS | 38248 |
| vlCDR3 | QQGNTLPYT | 38249 |

Figure 11K
7G8_H3.23_L1.11 (fab XENP21670)

| What | sequence | SEQ ID NO: |
|---|---|---|
| Variable heavy (vh) domain | EVQLVESGGGLVQPGGSLRLSCAASGFTFDDAWMDWVRQAPGKGLEWVAEISTKANNHATYYAESVK GRFTISRDDSKSSVYLQMNSLRAEDTAVYYCTRLATWDWYFDVWGQGTTVTVSS | 38250 |
| vhCDR1 | DAWMD | 38251 |
| vhCDR2 | EISTKANNHATYYAESVKG | 38252 |
| vhCDR3 | LATWDWYFDV | 38253 |
| Variable light (vl) domain | DTVLTQSPSSLSASVGDRVTITCRASQSVDYDGDSYMNWYQQKPGKPPKLLIYAASELESGIPARLS GSGSGTDFTLTISSLQPEDFATYYCQQSNEDPFTFGSGTKLEIK | 38254 |
| vlCDR1 | RASQSVDYDGDSYMN | 38255 |
| vlCDR2 | AASELES | 38256 |
| vlCDR3 | QQSNEDPFT | 38257 |

Figure 11L
7G8_H3.28_L1 (Fab XENP21892)

| What | sequence | SEQ ID NO: |
|---|---|---|
| Variable heavy (vh) domain | EVQLVESGGGLVQPGGSLRLSCAASGFTFDDAWMDWVRQAPGKGLEWVAEISTKAYNHATYYAESVK GRFTISRDDSKSSVYLQMNSLRAEDTAVYYCTRLATWDWYFDVWGQGTTVTVSS | 38258 |
| vhCDR1 | DAWMD | 38259 |
| vhCDR2 | EISTKAYNHATYYAESVKG | 38260 |
| vhCDR3 | LATWDWYFDV | 38261 |
| Variable light (vl) domain | DTVLTQSPSSLSASVGDRVTITCRASQSVDYDGDSYMNWYQQKPGKPPKLLIYAASNLESGIPARLS GSGSGTDFTLTISSLQPEDFATYYCQQSNEDPFTFGSGTKLEIK | 38262 |
| vlCDR1 | RASQSVDYDGDSYMN | 38263 |
| vlCDR2 | AASNLES | 38264 |
| vlCDR3 | QQSNEDPFT | 38265 |

Figure 11M
7G8_H3.28_L1.11 (Fab XENP21893)

| What | sequence | SEQ ID NO: |
|---|---|---|
| Variable heavy (vh) domain | EVQLVESGGGLVQPGGSLRLSCAASGFTFDDAWMDWVRQAPGKGLEWVAEISTKAYNHATYYAESVKGRFTISRDDSKSSVYLQMNSLRAEDTAVYYCTRLATWDWYFDVWGQGTTVTVSS | 38266 |
| vhCDR1 | DAWMD | 38267 |
| vhCDR2 | EISTKAYNHATYYAESVKG | 38268 |
| vhCDR3 | LATWDWYFDV | 38269 |
| Variable light (vl) domain | DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIK | 38270 |
| vlCDR1 | RASQSVDYDGDSYMN | 38271 |
| vlCDR2 | AASELES | 38272 |
| vlCDR3 | QQSNEDPFT | 38273 |

Figure 11N
7G8_H3.28_L1.13 (Fab XENP21894)

| What | sequence | SEQ ID NO: |
|---|---|---|
| Variable heavy (vh) domain | EVQLVESGGGLVQPGGSLRLSCAASGFTFDDAWMDWVRQAPGKGLEWVAEISTKAYNHATYYAESVKGRFTISRDDSKSSVYLQMNSLRAEDTAVYYCTRLATWDWYFDVWGQGTTVTVSS | 38274 |
| vhCDR1 | DAWMD | 38275 |
| vhCDR2 | EISTKAYNHATYYAESVKG | 38276 |
| vhCDR3 | LATWDWYFDV | 38277 |
| Variable light (vl) domain | DTVLTQSPSSLSASVGDRVTITCRASQSVDHDGDSYMNWYQQKPGKPPKLLIYAASELESGIPARLSGSGSGTDFTLTISSLQPEDFATYYCQQSNEDPFTFGSGTKLEIK | 38278 |
| vlCDR1 | RASQSVDHDGDSYMN | 38279 |
| vlCDR2 | AASELES | 38280 |
| vlCDR3 | QQSNEDPFT | 38281 |

Figure 12A (anti BTLA4 variable heavy and light chains + CDRs)

| What: anti-BTLA XENP20269 9C6_H0L0 | sequence | SEQ ID NO: |
|---|---|---|
| Variable heavy (vh) domain | QVQLKESGPGLVAPSQSLSITCTVSGFSLTGYGVNWVRQPPGKGLEWLGMIWIDGSTDYNSALKSRLSIN KDNSKSQVFLKMNSLQTDDTARYYCARDRPDGRAMDYWGQGTSVTVSS | 38282 |
| vhCDR1 | GYGVN | 38283 |
| vhCDR2 | MIWIDGSTDYNSALKS | 38284 |
| vhCDR3 | DRPDGRAMDY | 38285 |
| Variable light (vl) domain | SIVMTQTPKFLLVSAGDRVTITCKASQSVSNDVAWYQQKPGQSPKLLIYYASNRYTGVPDRFTGSGYGTD FTFTISTVQAEDLAVYFCQQDYSSPTFGGGTKLEIK | 38286 |
| vlCDR1 | KASQSVSNDVA | 38287 |
| vlCDR2 | YASNRYT | 38288 |
| vlCDR3 | QQDYSSPT | 38289 |

Figure 12B

| What: anti-BTLA XENP20872 9C6_H1.1L1 | sequence | SEQ ID NO: |
|---|---|---|
| Variable heavy (vh) domain | QVQLKESGAEVKKPGASVKVSCKVSGFSLTGYGVNWVRQAPGQGLEWMGMIWIDGSTDYNSKFQGRVTMT KDNSKSTVYMELSSLRSEDTAVYYCARDRPDGRAMDYWGQGTMVTVSS | 38290 |
| vhCDR1 | GYGVN | 38291 |
| vhCDR2 | MIWIDGSTDYNSKFQG | 38292 |
| vhCDR3 | DRPDGRAMDY | 38293 |
| Variable light (vl) domain | SIVMTQSPDSLAVSLGERATINCKASQSVSNDVAWYQQKPGQSPKLLIYYASNRYTGVPDRFTGSGYGTD FTLTISSLQAEDVAVYFCQQDYSSPTFGGGTKLEIK | 38294 |
| vlCDR1 | KASQSVSNDVA | 38295 |
| vlCDR2 | YASNRYT | 38296 |
| vlCDR3 | QQDYSSPT | 38297 |

Figure 12C (anti BTLA4 variable heavy and light chains + CDRs)

| What: anti-BTLA XENP020882 9C6_H1.1IL1 | sequence | SEQ ID NO: |
|---|---|---|
| Variable heavy (vh) domain | QVQLVQSGAEVKKPGASVKVSCKVSGFSLT<ins>GYGVN</ins>WVRQAPGQGLEWMGM<ins>IWIDGSTDYNSKFQG</ins>RLSIN KDNSKSTVYMELSSLRSEDTAVYYCARD<ins>RPDGRAMDY</ins>WGQGTMVTVSS | 38298 |
| vhCDR1 | GYGVN | 38299 |
| vhCDR2 | MIWIDGSTDYNSKFQG | 38300 |
| vhCDR3 | DRPDGRAMDY | 38301 |
| Variable light (vl) domain | SIVMTQSPDSLAVSLGERATINCKAS<ins>QSVSNDVA</ins>WYQQKPGQSPKLLIY<ins>YASNRYT</ins>GVPDRFTGSGYGTD FTLTISSLQAEDVAVYFC<ins>QQDYSSPT</ins>FGGGTKLEIK | 38302 |
| vlCDR1 | KASQSVSNDVA | 38303 |
| vlCDR2 | YASNRYT | 38304 |
| vlCDR3 | QQDYSSPT | 38305 |

Figure 13A (anti-TIM3 variable heavy and light chains + CDRs)

| What: anti-TIM3 XENP21503 1D10_H0L0 | sequence | SEQ ID NO: |
|---|---|---|
| Variable heavy (vh) domain | EVQLVESGGGLVKPGGSLKFSCAASGFAFSSFIMSWVRQTPEKRLEWVAYISSDGASTFYPDTMKGRFTI SRDNAKNTLYLQMSSLKSEDTAMYYCTRLGAYWGQGTLVTVSA | 38306 |
| vhCDR1 | SFDM | 38307 |
| vhCDR2 | YISSDGASTFYPDTMKG | 38308 |
| vhCDR3 | LGAY | 38309 |
| Variable light (vl) domain | DVVMTQTPLTLSVTIGQPASISCKSSQSLLDSDGKTYLNWLLQRPGQSPKRLIYLVSKLDSGVPDRFTGS GSGTDFTLKISRVEAEDLGVYYCWQGTHFPYTFGGGTKLEIK | 38310 |
| vlCDR1 | KSSQSLLDSDGKTYLN | 38311 |
| vlCDR2 | VSKLDS | 38312 |
| vlCDR3 | WQGTHFPYT | 38313 |

Figure 13B

| What: anti-TIM3 XENP21492 1D12_H0L0 | sequence | SEQ ID NO: |
|---|---|---|
| Variable heavy (vh) domain | EVQLVESGGGLVKPGGSLKFSCAASGFAFSSFIMSWVRQTPEKRLEWVAYISSDGASTFYPDTMKGRFTI SRDNAKNTLYLQMSSLKSEDTAMYYCTRLGAYWGQGTLVTVSA | 38314 |
| vhCDR1 | SFDMS | 38315 |
| vhCDR2 | YISSDGASTFYPDTMKG | 38316 |
| vhCDR3 | LGAY | 38317 |
| Variable light (vl) domain | DIVLTQSPASLAVSLGQRATISCRASESVEYYGTSLMQWYQQKPGQPPKLLIYAASNVESGVPARFSGSG SGTDFSLNIHPVEEDDIAMYFCQQSRKVPWTFGGGTKLEIK | 38318 |
| vlCDR1 | RASESVEYYGTSLQ | 38319 |
| vlCDR2 | AASNVES | 38320 |
| vlCDR3 | QQSRKVPWT | 38321 |

Figure 13C (anti-TIM3 variable heavy and light chains + CDRs)

| What: anti-TIM3 XENP21189 3H3_H1L2.1 | sequence | SEQ ID NO: |
|---|---|---|
| Variable heavy (vh) domain | QVTLKESGPVLVKPTETLTLTCTVSGFSLNGYGVNWVRQPPGKGLEWLAMIWGDGSTDYNSALKSRLTIS KDNSKSQVVLTMTNMDPVDTATYYCARSYYTSDEDYWGQGTLVTVSS | 38322 |
| vhCDR1 | GYGVN | 38323 |
| vhCDR2 | MIWGDGSTDYNSALKS | 38324 |
| vhCDR3 | SYYTSDEDY | 38325 |
| Variable light (vl) domain | DIVMTQSPDSLAVSLGERATINCKSSQSLLNSRTRKNYLAWYQQKPGQSPKLLIYWASTRESGVPDRFTG SGSGTDFTLTISSLQAEDVAVYYCKQSYSLRTFGGGTKVEIK | 38326 |
| vlCDR1 | KSSQSLLNSRTRKNYLA | 38327 |
| vlCDR2 | WASTRES | 38328 |
| vlCDR3 | KQSYSLRT | 38329 |

Figure 13D

| What: anti-TIM3 XENP21493 6C8_H0L0 | sequence | SEQ ID NO: |
|---|---|---|
| Variable heavy (vh) domain | QVQLKESGPGLVAPSQSLSITCTVSGFSLNGYGVNWVRQPPGKGLEWLGMIWGDGSTDYNSALKSRLSIS KDNSKSQVFLKMNSLQTDDTARYYCARSYYTSDEDYWGQGTLVTVSA | 38330 |
| vhCDR1 | GYGVN | 38331 |
| vhCDR2 | MIWGDGSTDYNSALKS | 38332 |
| vhCDR3 | SYYTSDEDY | 38333 |
| Variable light (vl) domain | DIVMTQSQKFMSTSVGDRVSVTCKASQNVGSNVAWCQQKPGQSPKALIYSASFRYSGVPDRFTGSGSGTD FTLTISNVQSEDLAEYFCQQYNSYPYTFGGGTKLEIK | 38334 |
| vlCDR1 | KASQNVGSNVA | 38335 |
| vlCDR2 | SASFRYS | 38336 |
| vlCDR3 | QQYNSYPYT | 38337 |

Figure 13E (anti-TIM3 variable heavy and light chains + CDRs)

| What: anti-TIM3 XENP21494 6D9H0_1D12_0 | sequence | SEQ ID NO: |
|---|---|---|
| Variable heavy (vh) domain | QVQLKQSGPGLVQPSQSLSITCTVSGFSLTSYGVHWVRQSPGKGLEWLGVIWSGGSTEYNAAFISRLSIS KDNSKSQVFFKMNSLQADDTAIYYCARGGLLSPFDYWGQGTTLTVSS | 38338 |
| vhCDR1 | SYGVH | 38339 |
| vhCDR2 | VIWSGGSTEYNAAFIS | 38340 |
| vhCDR3 | GGLLSPFDY | 38341 |
| Variable light (vl) domain | DIVLTQSPASLAVSLGQRATISCRASESVEYYGTSLMQWYQQKPGQPPKLLIYAASNVESGVPARFSGSG SGTDFSLNIHPVEEDDIAMYFCQQSRKVPWTFGGGTKLEIK | 38342 |
| vlCDR1 | RASESVEYYGTSLMQ | 38343 |
| vlCDR2 | AASNVES | 38344 |
| vlCDR3 | QQSRKVPWT | 38345 |

Figure 13F

| What: anti-TIM3 XENP21495 7A9_H0L0 | sequence | SEQ ID NO: |
|---|---|---|
| Variable heavy (vh) domain | EVKLLESGGGLVQPGGSLKLSCAASGFDFSRYWMSWVRQAPGKGLEWIGEINPDSSTINYTPSLKDKFLI SRDNAKNTLYLQMSKVRSEDTALYYCARPNGYYVGTIFPFAYWGQGTLVTVSA | 38346 |
| vhCDR1 | RYWMS | 38347 |
| vhCDR2 | EINPDSSTINYTPSLKD | 38348 |
| vhCDR3 | PNGYYVGTIFPFAY | 38349 |
| Variable light (vl) domain | QAVVTQESALTTSPGETVTLTCRSSTGAVTTSNYANWVQEKPDHLFTGLIGGTNNRAPGVPARFSGSLIG DKAALTITGAQTEDEAIYFCALWYSNHWVFGGGTKLTVLG | 38350 |
| vlCDR1 | RSSTGAVTTSNYAN | 38351 |
| vlCDR2 | GTNNRAP | 38352 |
| vlCDR3 | ALWYSNHWV | 38353 |

Figure 13G (anti-TIM3 variable heavy and light chains + CDRs)

| What: anti-TIM3 XENP21496 7B11_H0L0 | sequence | SEQ ID NO: |
|---|---|---|
| Variable heavy (vh) domain | QVQLKQSGPGLVQPSQSLSITCTVSGFSLTSYAVNWVRQSPGKGLEWLGVIWSGGSTDYNAAFISRLSIS KDNSKSQVFFKMNSLQANDTAIYYCVSLYYRYDGFDYWGQGTLVTVSA | 38354 |
| vhCDR1 | SYAVN | 38355 |
| vhCDR2 | VIWSGGSTDYNAAFIS | 38356 |
| vhCDR3 | LYYRYDGFDY | 38357 |
| Variable light (vl) domain | DIVLTQSQKFLSTSVGDRVSVTCKASQNVGTHVARYQQKPGQSPKALVYSASYRYSGVPDRFTGSGSGTD FTLTISNVQSEDLAEYFCQQYNSYPLTFGGGTKLEIK | 38358 |
| vlCDR1 | KASQNVGTHVA | 38359 |
| vlCDR2 | SASYRYS | 38360 |
| vlCDR3 | QQYNSYPLT | 38361 |

Figure 13H

| What: anti-TIM3 XENP21501 B11var_H0L0 | sequence | SEQ ID NO: |
|---|---|---|
| Variable heavy (vh) domain | QVQLKQSGPGLVQPSQSLSITCTVSGFSLTSYAVNWVRQSPGKGLEWLGVIWSGGSTDYNAAFISRLSIS KDNSKSQVFFKMNSLQADDTAIYYCVSLYYRYDGFDYWGQGTLVTVSA | 38362 |
| vhCDR1 | SYAVN | 38363 |
| vhCDR2 | VIWSGGSTDYNAAFIS | 38364 |
| vhCDR3 | LYYRYDGFDY | 38365 |
| Variable light (vl) domain | DIVLTQSQKFLSTSVGDRVSVTCKASQNVGTHVARYQQKPGQSPKALVYSASYRYSGVPDRFTGSGSGTD FTLTISNVQSEDLAEYFCQQYNSYPLTFGGGTKLEIK | 38366 |
| vlCDR1 | KASQNVGTHVA | 38367 |
| vlCDR2 | SASYRYS | 38368 |
| vlCDR3 | QQYNSYPLT | 38369 |

Figure 13I (anti-TIM3 variable heavy and light chains + CDRs)

| What: anti-TIM3 XENP21502 7C2_H0L0 | sequence | SEQ ID NO: |
|---|---|---|
| Variable heavy (vh) domain | EVKVVESGGGLVKPGGSLKLSCAASGFTFSRYAMSWVRQTPEKRLEWVASISSGGSTYYPDSVQGRFTIS RDNARNILYLQMSSLRSEDTAMYYCARGDYEGYFDYWGQGTSLTVSS | 38370 |
| vhCDR1 | RYAMS | 38371 |
| vhCDR2 | SISSGGSTYYPDSVQG | 38372 |
| vhCDR3 | GDYEGYFDY | 38373 |
| Variable light (vl) domain | DIVMTQSPSSLAMSVGQKVTMSCKSSQSLLNSINQKNYLAWYQQKPGQSPKLLVYFASTRESGVPDRFIG SGSGTDFTLTISSVQAEDLADYFCQQHYSTPLTFGAGTKLELK | 38374 |
| vlCDR1 | KSSQSLLNSINQKNYLA | 38375 |
| vlCDR2 | FASTRES | 38376 |
| vlCDR3 | QQHYSTPLT | 38377 |

Figure 14A (CTLA-4 X PD-1)

XENP19738

XENP019738_ipilimumab_H3L0-1G6_L1.210_H1.288 Fab-Fc Heavy Chain (SEQ ID NOS 38378-38382)
EVQLVESGGGLVKPGGSLRLSCAASGFTFSSYYMHWVRQAPGKGLEWVSFISYDGNNKYYADSVKGRFTISRDNAKNSLYLQMNSLRAEDTAVYYCARTGWLGPFDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVKHEDPEVKFNWYVDGVEVHNAKTKPREEYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWEQGDVFSCSVMHEALHNHYTQKSLSLSPGK XENP019738_ipilimumab_H3L0-1G6_L1.210_H1.288 scFv-Fc Heavy Chain (SEQ ID NOS 38383-38392, linker disclosed as SEQ ID NO: 37708)
EIVLTQSPATLSASPGERVTLTCRASQSVGRDVAWYQQKPGQAPRLLINYASHRYTGVPDRFTGSGYGTEFTLTISSVQSEDFGVYYCQQEFSSPRTFGCGTKVEIK/GKPGSGKPGSGKPGS/
EVQLVESGGGLVKPGGSLRLSCVASGFTFSNYWMNWVRQAPGKCLEWVAEIRLYSNNYATHYAESVKGRFTISRDDSKSTLYLQMNLKTEDTGVYYCTRYYGNYGGYFDYWGRGTLVTVSS/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLITVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLITVDKSRWQQGNVFSCSVMHEALHNHYTQKSLSLSPGK XENP019738_ipilimumab_H3L0-1G6_L1.210_H1.288 Light Chain (SEQ ID NOS 38393-38397)
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK/RTVAAPSVFIFPPSDEQLKS
GTASVVCLLNNFYPREAKVQWKVDNALQSGNSQESVTEQDSKDSTYSLSSTLTLSKADYEKHKVYACEVTHQGLSSPVTKSFNRGEC

Figure 14B

XENP19739

XENP019739_ipilimumab_H3L0-1G6_H1.279_L1.194 Fab-Fc Heavy Chain (SEQ ID NOS 38398-38402)
EVQLVESGGGLVKPGGSLRLSCAASGFTFSSYYMHWVRQAPGKGLEWVSFISYDGNNKYYADSVKGRFTISRDNAKNSLYLQMNSLRAEDTAVYYCARTGWLGPFDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVKHEDPEVKFNWYVDGVEVHNAKTKPREEYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWEQGDVFSCSVMHEALHNHYTQKSLSLSPGK XENP019739_ipilimumab_H3L0-1G6_H1.279_L1.194 scFv-Fc Heavy Chain (SEQ ID NOS 38403-38412, linker disclosed as SEQ ID NO: 37708)
EVQLVESGGGLVKPGGSLRLSCVASGFTFSNYWMNWVRQAPGKGLEWVAEIRLYSNNYATHYAESVKGRFTISRDDSKSTLYLQMNLKTEDTGVYYCTRYYGNYGGYFDYWGRGTLVTVSS/GKPGSG
KPGSGKPGS/EIVLTQSPATLSASPGERVTLTCRASQSVGRDVAWYQQKPGQAPRLLINYASHRYTGVPDRFTGSGYGTEFTLTISSVQSEDFGVYYCQQDFSSPRTFGGGTKVEIK/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLITVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLITVDKSRWQQGNVFSCSVMHEALHNHYTQKSLSLSPGK XENP019739_ipilimumab_H3L0-1G6_H1.279_L1.194 Light Chain (SEQ ID NOS 38413-38417)
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK/RTVAAPSVFIFPPSDEQLKS
GTASVVCLLNNFYPREAKVQWKVDNALQSGNSQESVTEQDSKDSTYSLSSTLTLSKADYEKHKVYACEVTHQGLSSPVTKSFNRGEC Figure 14C (CTLA-4 X PD-1)

XENP19741

XENP019741_ipilimumab_H3L0-1G6_L1.194_H1.279 Fab-Fc Heavy Chain (SEQ ID NOS 38418-38422)
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQEGDVFSCSVMHEALHNHYTQKSLSLSPGK XENP019741_ipilimumab_H3L0-1G6_L1.194_H1.279 scFv-Fc Heavy Chain (SEQ ID NOS 38423-38432, linker disclosed as SEQ ID NO: 37708)
EIVLTQSPATLSASPGERVTLTCRASQSVGNDYAWYQQKPGQAPRLLINYASHRYTGVPDRFTGSSGYGTEFTLTISSVQSEDFGVYYCQQDFSSPRTFGGGTKVEIK/GKPGSGKPGSGKPGS/
EVQLVESGGGLVKPGGSLRLSCVASGFTFSNYWMSWVRQAPGKGLEWVAEIRLYSNTAFHYAESVKGRFTISRDDSKSTLYLQMNLKTEDTGVYYCTRYIGNYGSFFDYWGRGTLVTVSS/EPKSSD
KTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK XENP019741_ipilimumab_H3L0-1G6_L1.194_H1.279 Light Chain (SEQ ID NOS 38433-38437)
EIVLTQSPGTLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK/RTVAAPSVFIFPPSDEQLKS
GTASVVCLLNNFYPREAKVQWKVDNALQSGNSQESVTEQDSKDSTYSLSSTLTLSKADYEKHKVYACEVTHQGLSSPVTKSFNRGEC

Figure 14D

XENP20053

XENP020053_ipilimumab_H3L0.22-1G6_L1.194_H1.279 Fab-Fc Heavy Chain (SEQ ID NOS 38438-38442)
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQEGDVFSCSVMHEALHNHYTQKSLSLSPGK XENP020053_ipilimumab_H3L0.22-1G6_L1.194_H1.279 scFv-Fc Heavy Chain (SEQ ID NOS 38443-38452, linker disclosed as SEQ ID NO: 37708)
EIVLTQSPATLSASPGERVTLTCRASQSVGNDYAWYQQKPGQAPRLLINYASHRYTGVPDRFTGSSGYGTEFTLTISSVQSEDFGVYYCQQDFSSPRTFGGGTKVEIK/GKPGSGKPGSGKPGS/
EVQLVESGGGLVKPGGSLRLSCVASGFTFSNYWMSWVRQAPGKGLEWVAEIRLYSNTAFHYAESVKGRFTISRDDSKSTLYLQMNLKTEDTGVYYCTRYIGNYGSFFDYWGRGTLVTVSS/EPKSSD
KTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK XENP020053_ipilimumab_H3L0.22-1G6_L1.194_H1.279 Light Chain (SEQ ID NOS 38453-38457)
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK/RTVAAPSVFIFPPSDEQLKS
GTASVVCLLNNFYPREAKVQWKVDNALQSGNSQESVTEQDSKDSTYSLSSTLTLSKADYEKHKVYACEVTHQGLSSPVTKSFNRGEC Figure 14E (CTLA-4 X PD-1)

XENP20066

XENP020066 ipilimumab_H3_L0.22-1G6_H1.279_L1.194 Fab-Fc Heavy Chain (SEQ ID NOS 38458-38462)
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQEGNVFSCSVMHEALHNHYTQKSLSLSPGK XENP020066 ipilimumab_H3_L0.22-1G6_H1.279_L1.194 scFv-Fc Heavy Chain (SEQ ID NOS 38463-38472, linker disclosed as SEQ ID NO: 37708)
EVQLVESGGGLVKPGGSLRLSCVASGFTFSNYWMNWVRQAPGKGLEWVAEIRLYSNNYATHYAESVKGRFTISRDDSKSTLYLQMNLKTEDTGVYYCTRYYGNYGGYFDVWGRGTLVTVSS/GKPGSSG
KPGSGKPGSGKPGS/EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK XENP020066 ipilimumab_H3_L0.22-1G6_H1.279_L1.194 Light Chain (SEQ ID NOS 38473-38477)
EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSFWTFGQGTKVEIK/RTVAAPSVFIFPPSDEQLKS
GTASVVCLLNNFYPREAKVQWKVDNALQSGNSQESVTEQDSKDSTYSLSSTLTLSKADYEKHKVYACEVTHQGLSSPVTKSFNRGEC

Figure 14F

XENP20130

XENP020130 ipilimumab_H3_L0.22-1G6_H1.210_H1.288 Fab-Fc Heavy Chain (SEQ ID NOS 38478-38482)
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQEGNVFSCSVMHEALHNHYTQKSLSLSPGK XENP020130 ipilimumab_H3_L0.22-1G6_H1.210_H1.288 scFv-Fc Heavy Chain (SEQ ID NOS 38483-38492, linker disclosed as SEQ ID NO: 37708)
EIVLTQSPGTLSLSPGERATLSCRASQSVSSSYLAWYQQKPGQAPRLLINYASHRYTSNNYATHYAESVKGRFTISRDDSKSTLYLQMNLKTEDTGVYYCQQEFSSPRTFGCGTKVEIK/GKPGSGKPGSGKPGS/
EVQLVESGGGLVKPGGSLRLSCVASGFTFSNYWMNWVRQAPGKCLEWVAEIRLYSNNYATHYAESVKGRFTISRDDSKSTLYLQMNLKTEDTGVYYCTRYYGNYGGYFDVWGRGTKVEIK/GKPGSSGKPGSGKPGS/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK XENP020130 ipilimumab_H3_L0.22-1G6_H1.210_H1.288 Light Chain (SEQ ID NOS 38493-38497)
EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSFWTFGQGTKVEIK/RTVAAPSVFIFPPSDEQLKS
GTASVVCLLNNFYPREAKVQWKVDNALQSGNSQESVTEQDSKDSTYSLSSTLTLSKADYEKHKVYACEVTHQGLSSPVTKSFNRGEC Figure 14G (CTLA-4 X PD-1)

XENP020146

XENP020146 ipilimumab_H3_L0.22-1G6_H1.280_L1.224 Fab-Fc Heavy Chain (SEQ ID NOS 38498-38502)
EVQLVESGGGLVKPGGSLRLSCAASGFTFSSYEMHWVRQAPGKGLEWVSFISYDGNNKYYADSVKGRFTISRDNAKNSLYLQMNSLRAEDTAVYYCARTGWLGPFDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQEGDVFSCSVMHEALHNHYTQKSLSLSPGK XENP020146 ipilimumab_H3_L0.22-1G6_H1.280_L1.224 scFv-Fc Heavy Chain (SEQ ID NOS 38503-38512, linker disclosed as SEQ ID NO: 37708)
EVQLVESGGGLVKPGGSLRLTCVASGFTFSNYWMHWVRQAPGKGLEWVAEIRLYSNNYATHYAESVKGRFTISRDDSKSTLYLQMNNLKTEDTGVYYCTRXYGNYGGYFDVWGRGTLVTVSS/GKPGSG
KPGSGKPGSGKPGS/EIVLTQSPATLSVSPGERVTLTCRASQSVGNDYAWYQQKPGQAPRLLINYASHRYTSVPDRFTGSGYGTEFTLTISSVQSEDFAVYYCQQDWSSPRTFGGGTKVEIK/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK XENP020146 ipilimumab_H3_L0.22-1G6_H1.280_L1.224 Light Chain (SEQ ID NOS 38513-38517)
EIVLTQSPGTLSLSPGERATLSCRASQSVSSYLAWYQQKPGQAPRLLIYGAFSRATGIPDRFSGSGSGTDFTLTISRLEPEDFAVYYCQQYGSSPWTFGQGTKVEIK/RTVAAPSVFIFPPSDEQLKS
GTASVVCLLNNFYPREAKVQWKVDNALQSGNSQESVTEQDSKDSTYSLSSTLTLSKADYEKHKVYACEVTHQGLSSPVTKSFNRGEC

Figure 14H

XENP20717

XENP020717 ipilimumab_H3_L0.22-1G6_L1.194_H1.279_M428L/N434S Fab-Fc Heavy Chain (SEQ ID NOS 38518-38522)
EVQLVESGGGLVKPGGSLRLSCAASGFTFSSYEMHWVRQAPGKGLEWVSFISYDGNNKYYADSVKGRFTISRDNAKNSLYLQMNSLRAEDTAVYYCARTGWLGPFDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQEGDVFSCSVMHEALHNHYTQKSLSLSPGK XENP020717 ipilimumab_H3_L0.22-1G6_L1.194_H1.279_M428L/N434S scFv-Fc Heavy Chain (SEQ ID NOS 38523-38532, linker disclosed as SEQ ID NO: 37708)
EVQLVESGGGLVKPGGSLRLTCVASGFTFSNYWMHWVRQAPGKGLEWVAEIRLYSNNYATHYAESVKGRFTISRDDSKSTLYLQMNNLKTEDTGVYYCQQDFSSPRTFGGGTKVEIK/GKPGSGKPGSGKPGS/
EIVLTQSPATLSASPGERVTLTCRASQSVGNDYAWYQQKPGQAPRLLINYASHRYTGVPDRFTGSGYGTEFTLTISSVQSEDFGVYYCQQDFSSPRTFGGGTKVEIK/GKPGSGKPGSGKPGS/
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK XENP020717 ipilimumab_H3_L0.22-1G6_L1.194_H1.279_M428L/N434S Light Chain (SEQ ID NOS 38533-38537)
EIVLTQSPGTLSLSPGERATLSCRASQSVSSYLAWYQQKPGQAPRLLIYGAFSRATGIPDRFSGSGSGTDFTLTISRLEPEDFAVYYCQQYGSSEWTFGQGTKVEIK/RTVAAPSVFIFPPSDEQLKS
GTASVVCLLNNFYPREAKVQWKVDNALQSGNSQESVTEQDSKDSTYSLSSTLTLSKADYEKHKVYACEVTHQGLSSPVTKSFNRGEC Figure 14I (CTLA-4 X PD-1)

XENP22836

XENP022836 2E9_H1L1_Fab-[CTLA-4]_H3.23_L0.129_scFv HC-Fab (SEQ ID NOS 38538-38542)
QVQLVQSGAEVKKPGASVKVSCKASGYAFTNYWLGWVRQAPGQGLEWMGNFYPGSSNTYNEKFQGRVTMTADKSISTAYMELSRLRSDDTAVYFCARHYGTNYRYFDVWGAGTLVTVSS/ASTKGPSV
FPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISR
TPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWQEGDVFSCSVMHEALHNHYTQKSLSLSPGK

XENP022836 2E9_H1L1_Fab-[CTLA-4]_H3.23_L0.129_scFv HC-scFV (SEQ ID NOS 38543-38552, linker disclosed as SEQ ID NO: 37708)
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSS/GKPGSGKPGS
GKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK/EPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPS
REQMTKNQVKLTCLVKGFYPSDIAVEWESNGQPENNYKTTPPVLDSDGSFFLYSKLTVDKSRWQQGNVFSCSVMHEALHNHYTQKSLSLSPGK XENP022836 2E9_H1L1_Fab-[CTLA-4]_H3.23_L0.129_scFv Light Chain (SEQ ID NOS 38553-38557)
DIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK/RTVAAPSVFIFPPSDEQLKSG
TASVVCLLNNFYPREAKVQWKVDNALQSGNSQESVTEQDSKDSTYSLSSTLTLSKADYEKHKVYACEVTHQGLSSPVTKSFNRGEC Figure 15A (LAG-3 X PD-1)

XENP20206

XENP020206_2A11_H1L2-1G6_L1.194_H1.279 Fab-Fc Heavy Chain (SEQ ID NOS 38558-38562)
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQALDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQQGDVFSCSVMHEALHNHYTQKSLSLSPGK XENP020206_2A11_H1L2-1G6_L1.194_H1.279 scFv-Fc Heavy Chain (SEQ ID NOS 38563-38572, linker disclosed as SEQ ID NO: 37708)
EIVLTQSPATLSASPGERVTLTCRASQSVGNEVAWYQQKPGQAPRLLINYASHRYTGVPDRFTGSGYGTEFTLTISSVQSEDFGVYYCQQEFSSPRTFGGGTKVEIK/GKPGSGKPGSGKPGS/
EVQLVESGGGLVKPGGSLRLSCVASGFTFSNYWMNWVRQAPGKGLEWVAEIRLYSNYATHYAESVKGRFTISRDDSKSTLYLQMNLKTEDTGVYYCTRYYGNYGGYFDVWGRGTLVTVSS/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK XENP020206_2A11_H1L2-1G6_L1.194_H1.279 Light Chain (SEQ ID NOS 38573-38577)
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGT
ASVVCLLNNFYPREAKVQWKVDNALQSGNSQESVTEQDSKDSTYSLSSTLTLSKADYEKHKVYACEVTHQGLSSPVTKSFNRGEC

Figure 15B

XENP21582

XENP021582_2A11_H1_L2.91_Fab-1G6_L1.194_H1.279 Fab-Fc Heavy Chain (SEQ ID NOS 38578-38582)
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQALDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQQGDVFSCSVMHEALHNHYTQKSLSLSPGK XENP021582_2A11_H1_L2.91_Fab-1G6_L1.194_H1.279 scFv-Fc Heavy Chain (SEQ ID NOS 38583-38592, linker disclosed as SEQ ID NO: 37708)
EIVLTQSPATLSASPGERVTLTCRASQSVGNDVAWYQQKPGQAPRLLINYASHRYTGVPDRFTGSGYGTEFTLTISSVQSEDFGVYYCQQEFSSPRTFGGGTKVEIK/GKPGSGKPGSGKPGS/
EVQLVESGGGLVKPGGSLRLSCVASGFTFSNYWMNWVRQAPGKGLEWVAEIRLYSNYATHYAESVKGRFTISRDDSKSTLYLQMNLKTEDTGVYYCTRYYGNYGGYFDVWGRGTLVTVSS/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK XENP021582_2A11_H1_L2.91_Fab-1G6_L1.194_H1.279 Light Chain (SEQ ID NOS 38593-38597)
DIQMTQSPAFLSVTPGEKVTITCQASQDIGNYLNWFQQKPGQTVKLLIYYTSRLHSGVPSRFSGSGSGTDYTFTISSLEAEDAATYFCQQGNTLPYTFGGGTKVEIK/RTVAAPSVFIFPPSDEQLKSG
TASVVCLLNNFYPREAKVQWKVDNALQSGNSQESVTEQDSKDSTYSLSSTLTLSKADYEKHKVYACEVTHQGLSSPVTKSFNRGEC Figure 15C (LAG-3 X PD-1)

XENP21584

XENP021584_2A11_H1_L2.93_Fab-1G6_L1.194_H1.279 Fab-Fc Heavy Chain (SEQ ID NOS 38598-38602)
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQALDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWEQGDVFSCSVMHEALHNHYTQKSLSLSPGK XENP021584_2A11_H1_L2.93_Fab-1G6_L1.194_H1.279 scFv-Fc Heavy Chain (SEQ ID NOS 38603-38612, linker disclosed as SEQ ID NO: 37708)
EIVLTQSPATLSASPGERVTLTCRASQSVGNDVAWYQQKPGQAPRLLINYASHRYTGVPDRFTGSGYGTEFTLTISSVQSEDFGVYYCQQEFSSPRTFGGGTKVEIK/GKPGSGKPGSGKPGS/
EVQLVESGGGLVKPGGSLRLSCVASGFTFSNYWMNWVRQAPGKGLEWVAEIRLYSNNYATHYAESVKGRFTISRDDSKSTLYLQMNLKTEDTGVYCTRXYGNYGGYFDVWGRGTLVTVSS/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPEVLDSDGSFFLYSKLTVDKSRWQQGNVFSCSVMHEALHNHYTQKSLSLSPGK XENP021584_2A11_H1_L2.93_Fab-1G6_L1.194_H1.279 Light Chain (SEQ ID NOS 38613-38617)
DIQMTQSPAFLSVTPGEKVTITCQASQDIGNYLRWFQQKPDQTPKLLIYYTSRLESGVPSRFSGSGSGTDYTFTISSLEAEDAATYFCQQGNILPYTFGGGTKVEIK/RTVAAPSVFIFPPSDEQLKSG
TASVVCLLNNFYPREAKVQWKVDNALQSGNSQESVTEQDSKDSTYSLSSTLTLSKADYEKHKVYACEVTHQGLSSPVTKSFNRGEC

Figure 15D

XENP21588

XENP021588_2A11_H1_L2.97_Fab-1G6_L1.194_H1.279 Fab-Fc Heavy Chain (SEQ ID NOS 38618-38622)
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQALDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWEQGDVFSCSVMHEALHNHYTQKSLSLSPGK >XENP021588_2A11_H1_L2.97_Fab-1G6_L1.194_H1.279 scFv-Fc Heavy Chain (SEQ ID NOS 38623-38632, linker disclosed as SEQ ID NO: 37708)
EIVLTQSPATLSASPGERVTLTCRASQSVGNDVAWYQQKPGQAPRLLINYASHRYTGVPDRFTGSGYGTEFTLTISSVQSEDFGVYYCQQEFSSPRTFGGGTKVEIK/GKPGSGKPGSGKPGS/
EVQLVESGGGLVKPGGSLRLSCVASGFTFSNYWMNWVRQAPGKGLEWVAEIRLYSNNYATHYAESVKGRFTISRDDSKSTLYLQMNLKTEDTGVYYCTRXYGNYGGYFDVWGRGTLVTVSS/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPEVLDSDGSFFLYSKLTVDKSRWQQGNVFSCSVMHEALHNHYTQKSLSLSPGK XENP021588_2A11_H1_L2.97_Fab-1G6_L1.194_H1.279 Light Chain (SEQ ID NOS 38633-38637)
DIQMTQSPAFLSVTPGEKVTITCQASQDIGNYLRWFQQKPDQTPKLLIYYTSRLESGVPSRFSGSGSGTDYTFTISSLEAEDAATYYCQQGNILPYTFGGGTKVEIK/RTVAAPSVFIFPPSDEQLKSG
TASVVCLLNNFYPREAKVQWKVDNALQSGNSQESVTEQDSKDSTYSLSSTLTLSKADYEKHKVYACEVTHQGLSSPVTKSFNRGEC Figure 15E (LAG-3 X PD-1)

XENP22123

XENP022123_2A11_H1_L2.122_Fab-1G6_L1.194_H1.279 Fab-Fc Heavy Chain (SEQ ID NOS 38638-38642)
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQALDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQEGDVFSCSVMHEALHNHYTQKSLSLSPGK XENP022123_2A11_H1_L2.122_Fab-1G6_L1.194_H1.279 scFv-Fc Heavy Chain (SEQ ID NOS 38643-38652, linker disclosed as SEQ ID NO: 37708)
EIVLTQSPATLSASPGERVTLTCRASQSVGNDVAWYQQKPGQAPRLLINYASHRYTGVPDRFTGSGYGTEFTLTISSVQSEDFGVYYCQQFSSSPRTFGGGTKVEIK/GKPGSGKPGSGKPGS/
EVQLVESGGGLVKPGGSLRLSCVASGFTFSNYWMNWVRQAPGKGLEWVAEIRLYSNYATHYAESVKGRFTISRDDSKSTLYLQMNLKTEDTGVYYCTRYYGNYGGYFDVWGRGTLVTVSS/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK XENP022123_2A11_H1_L2.122_Fab-1G6_L1.194_H1.279 Light Chain (SEQ ID NOS 38653-38657)
DIQMTQSPAFLSVTPGEKVTITCQASQDIGNYLNWFQQKPGQTPKLLIYYTSRLHSGVPSRFSGSGSGTDYTFTISSLEAEDAATYFCQQGNTLPYTFGGGTKVEIK/RTVAAPSVFIFPPSDEQLKSG
TASVVCLLNNFYPREAKVQWKVDNALQSGNSQESVTEQDSKDSTYSLSSTLTLSKADYEKHKVYACEVTHQGLSSPVTKSFNRGEC

Figure 15F

XENP22124

XENP022124_2A11_H1_L2.123_Fab-1G6_L1.194_H1.279 Fab-Fc Heavy Chain (SEQ ID NOS 38658-38662)
EVQLVQSGAEVKKPGATVKISCKASGFNIKDYYMHWVQQAPGKGLEWMGWIDEENGDTEYAPKFQGRVTITADTSTNTAYMELSSLRSEDTAVYYCYARGVRQALDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQEGDVFSCSVMHEALHNHYTQKSLSLSPGK XENP022124_2A11_H1_L2.123_Fab-1G6_L1.194_H1.279 scFv-Fc Heavy Chain (SEQ ID NOS 38663-38672, linker disclosed as SEQ ID NO: 37708)
EIVLTQSPATLSASPGERVTLTCRASQSVGNDVAWYQQKPGQAPRLLINYASHRYTGVPDRFTGSGYGTEFTLTISSVQSEDFGVYYCQQFSSSPRIFGGGTKVEIK/GKPGSGKPGSGKPGS/
EVQLVESGGGLVKPGGSLRLSCVASGFTFSNMNRWVRQAPGKGLEWVAEIRLYSNNYATHYAESVKGRFTISRDDSKSTLYLQMNLKTEDTGVYYCTRYYGNYGGYFDVWGRGTLVTVSS/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK XENP022124_2A11_H1_L2.123_Fab-1G6_L1.194_H1.279 Light Chain (SEQ ID NOS 38673-38677)
DIQMTQSPAFLSVTPGEKVTITCQASQDIGNYLNWFQQKPGQSPKLLIYYTSRLHSGVPSRFSGSGSGTDYTFTISSLEAEDAATYFCQQGNTLPYTFGGGTKVEIK/RTVAAPSVFIFPPSDEQLKSG
TASVVCLLNNFYPREAKVQWKVDNALQSGNSQESVTEQDSKDSTYSLSSTLTLSKADYEKHKVYACEVTHQGLSSPVTKSFNRGEC Figure 15G (LAG-3 X PD-1)

XENP22125

XENP022125_2A11_H1_L2.124_Fab-1G6_L1.194_H1.279 Fab-Fc Heavy Chain (SEQ ID NOS 38678-38682)
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYAREVRQALDHWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWEEQGDVFSCSVMHEALHNHYTQKSLSLSPGK XENP022125_2A11_H1_L2.124_Fab-1G6_L1.194_H1.279 scFv-Fc Heavy Chain (SEQ ID NOS 38683-38692, linker disclosed as SEQ ID NO: 37708)
EIVLTQSPATLSASPGERVTLTCRASQSVGNDVAWYQQKPGQAPRLLINYASHRYTGVPDRFTGSGYGTEFTLTISSVQSEDFGVYYCQQEFSSERTFGGGTKVEIK/GKPGSGKPGSGKPGSGKPGS/
EVQLVESGGGLVKPGGSLRLSCVASGFTFSNYWMNWVRQAPGKGLEWVAEIRLYSNNYATHYAESVKGRFTISRDDSKSTLYLQMNLKTEDTGVYYCTRYYGNYGGYFDWGRGTLVTVSS/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK XENP022125_2A11_H1_L2.124_Fab-1G6_L1.194_H1.279 Light Chain (SEQ ID NOS 38693-38697)
DIQMTQSPAFLSVTPGEKVTITCQASQDIGNYLNWFQQKPGKVPKLLIYYTSRLHSGVPSRFSGSGSGTDYTFTISSLEAEDAATYFCQQENTLPYTFGGGTKVEIK/RTVAAPSVFIFPPSDEQLKSG
TASVVCLLNNFYPREAKVQWKVDNALQSGNSQESVTEQDSKDSTYSLSSTLTLSKADYEKHKVYACEVTHQGLSSPVTKSFNRGEC

Figure 15H

XENP22604

XENP022604_7G8_H3.30_L1.34-1G6_L1.194_H1.279 Fab-Fc Heavy Chain (SEQ ID NOS 38698-38702)
EVQLVESGGGLVQPGGSLRLSCAASGFTFDDAWMSWVRQAPGKGLEWVAEISTKANNHAIYYAESVKGRFTISRDDSKSSVYLQMNSLRAEDTAVYYCTRLATWNWYFDVWGQGTTVTVSS/ASTKGPS
VFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMIS
RTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK XENP022604_7G8_H3.30_L1.34-1G6_L1.194_H1.279 scFv-Fc Heavy Chain (SEQ ID NOS 38703-38712, linker disclosed as SEQ ID NO: 37708)
EIVLTQSPATLSASPGERVTLTCRASQSVGNDVAWYQQKPGQAPRLLINYASHRYTGVPDRFTGSGYGTEFTLTISSVQSEDFGVYYCQQDFSSERTFGGGTKVEIK/GKPGSGKPGSGKPGSGKPGS/
EVQLVESGGGLVKPGGSLRLSCVASGFTFSNYWMNWVRQAPGKGLEWVAEIRLYSNNYATHYAESVKGRFTISRDDSKSTLYLQMNLKTEDTGVYYCTRYYGNYGGYFDWGRGTLVTVSS/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK XENP022604_7G8_H3.30_L1.34-1G6_L1.194_H1.279 Light Chain (SEQ ID NOS 38713-38717)
DIVLTQSPSSLSASVGDRVTITCRASQSVDYDGDSYMNWYQQKPGKPPKLLIYAASELESGIPARFSGSGSGTDFTLTISSLQPEDFATYCQQSNEDPFTFGSGTKLEIK/RTVAAPSVFIFPPSDEQ
LKSGTASVVCLLNNFYPREAKVQWKVDNALQSGNSQESVTEQDSKDSTYSLSSTLTLSKADYEKHKVYACEVTHQGLSSPVTKSFNRGEC

Figure 15I (LAG-3 X PD-1)

XENP022672

XENP022672_2A11_H1.144_L2.142_Fab-1G6_L1.194_H1.279 Fab-Fc Heavy Chain (SEQ ID NOS 38718-38722)
EVQLVQSGAEVKKPGATVKISCKASGFNIKDYFMHWVQQAPGKGLEWMGWIDPELGETEYAPKFQGRVTITADTSTNTAYMELSSLRSEDTAVYYCYARGVYQALDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQQGDVFSCSVMHEALHNHYTQKSLSLSPGK XENP022672_2A11_H1.144_L2.142_Fab-1G6_L1.194_H1.279 scFv-Fc Heavy Chain (SEQ ID NOS 38723-38732, linker disclosed as SEQ ID NO: 37708)
EIVLTQSPATLSASPGERVTLTCRASQSVGNDVAWYQQKPGQAPRLLINYASHRYTGVPDRFTGSGYGTEFTLTISSVQSEDFGVYYCQQEFSSPRTFGGGTKVEIK/GKPGSGKPGSGKPGSGKPGS/
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYCTRYYGNYGGYFDWGRGTLVTVSS/EPKSSD
KTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLITVDKSRWQQGNVFSCSVMHEALHNHYTQKSLSLSPGK XENP022672_2A11_H1.144_L2.142_Fab-1G6_L1.194_H1.279 Light Chain (SEQ ID NOS 38733-38737)
DIQMTQSPAFLSVTPGEKVTITCQASQDIGNYLNWFQQKPGQTVKLLIYETSYLHSGVPSRFSGSGSGTDYTFTISSLEAEDAATYFCQQGNILPYTFGGGTKVEIK/RTVAAPSVFIFPPSDEQLKSG
TASVVCLLNNFYPREAKVQWKVDNALQSGNSQESVTEQDSKDSTYSLSSTLTLSKADYEKHKVYACEVTHQGLSSPVTKSFNRGEC

Figure 15J

XENP22847

XENP022847_7G8_H3.30_L1.34_Fab-1G6_L1.194_H1.279_scFv M428L/N434S Fab-Fc Heavy Chain (SEQ ID NOS 38738-38742)
EVQLVESGGGLVQPGGSLRLSCAASGFTFDDAWMSWVRQAPGKGLEWVAEISFKANGHATVYAESVKGRFTISRDDSKSSVYLQMNSLRAEDTAVYYCTRLATWDNVFDVWGQGTTVTVSS/ASTKGPSVFPLAPSSKSTSGGTA
ALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHN
AKTKPREEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEA
LHSHYTQKSLSLSPGK XENP022847_7G8_H3.30_L1.34_Fab-1G6_L1.194_H1.279_scFv M428L/N434S scFv-Fc Heavy Chain (SEQ ID NOS 38743-38752, linker disclosed as SEQ ID NO: 37708)
EIVLTQSPATLSASPGERVTLTCRASQSVGNDVAWYQQKPGQAPRLLINYASHRYTGVPDRFTGSGYGTEFTLTISSVQSEDFGVYYCQQEFSSPRTFGGGTKVEIK/GKPGSGKPGSGKPGSGKPGS/EVQLVESGGGLVKPGG
SLRLSCVASGFTFSNYWMNWVRQAPGKGLEWVAEIRLYSNNYATHYAESVKGRFTISRDDSKSTLYLQMNNLKTEDTGVYCTRYYGNYGGYFDWGRGTLVTVSS/EPKSSDKTHTCPPCPAPPVAGPSVFLFPPKPKDTLMIS
RTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLD
SDGSFFLYSKLITVDKSRWQQGNVFSCSVMHEALHSHYTQKSLSLSPGK XENP022847_7G8_H3.30_L1.34_Fab-1G6_L1.194_H1.279_scFv M428L/N434S Light Chain (SEQ ID NOS 38753-38757)
DIVLTQSPSSLSASVGDRVTITCRASQSVYDYQDSKMQWYQQKPGKPPKLLIYAASNLESGIPARFSGSGSGTDFTLTISSLQPEDFATYYCQQSNEDPFTFGSGTKLEIK/RTVAAPSVFIFPPSDEQLKSGTASVVCLLNNFY
PREAKVQWKVDNALQSGNSQESVTEQDSKDSTYSLSSTLTLSKADYEKHKVYACEVTHQGLSSPVTKSFNRGEC Figure 15K (LAG-3 X PD-1)

XENP22849

XENP022849_2A11_H1.144_L2.142_Fab-1G6_L1.194_H1.279_scFv_M428L/N434S Fab-Fc Heavy Chain (SEQ ID NOS 38758-38762)
EVQLVQSGAEVKKPGATVKISCKASGFNIKDYFMHWVQQAPGKGLEWMGWIDPENGDTEYAPKFQGRVTITADTSTNTAYMELSSLRSEDTAVYYCYARGVYQALDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQEGDVFSCSVLHEALHSHYTQKSLSLSPGK XENP022849_2A11_H1.144_L2.142_Fab-1G6_L1.194_H1.279_scFv_M428L/N434S scFv-Fc Heavy Chain (SEQ ID NOS 38763-38772, linker disclosed as SEQ ID NO: 37708)
EIVLTQSPATLSASPGERVLTCRASQSVGNEVAWYQQKPGQAPRLLINYASHRYTGVPDRFTGSGYGTEFTLTISSVQSEDFGVYYCQQEFSSPRTFGGGTKVEIK/GKPGSGKPGSGKPGSGKPGS/
EVQLVESGGGLVKPGGSLRLSCVASGFTFSNYWMNWVRQAPGKGLEWVAEIRLKSNNYATHYAESVKGRFTISRDDSKSTLYLQMNLKTEDIGVYYCTRYYGNYGGYFDYWGRGTLVTVSS/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK >XENP022849_2A11_H1.144_L2.142_Fab-1G6_L1.194_H1.279_scFv_M428L/N434S Light Chain (SEQ ID NOS 38773-38777)
DIQMTQSPAFLSVTPGEKVTITCQASQDIGNILNWFQQKPGQTVKLLIYETSYLHSGVPSRFSGSGSGTDYTFTISSLEAEDAATYFCQQGNTLFYTFGGGTKVEIK/RTVAAPSVFIFPPSDEQLKSG
TASVVCLLNNFYPREAKVQWKVDNALQSGNSQESVTEQDSKDSTYSLSSTLTLSKADYEKHKVYACEVTHQGLSSPVTKSFNRGEC Figure 16A (BTLA X PD-1)

XENP20895

XENP020895_9C6_H0L0-1G6_L1.194_H1.279 Fab-Fc Heavy Chain (SEQ ID NOS 38778-38782)
QVQLKESGPGLVAPSQSLSITCTVSGFSLTGYGVNWVRQPPGKGLEWLGMIWGDGSTDYNSALKRSLSINKDNSKSQVFLKMNSLQTDDTARYYCARDRDGRAMDYWGQTSVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQEGDVFSCSVMHEALHNHYTQKSLSLSPGK XENP020895_9C6_H0L0-1G6_L1.194_H1.279 scFv-Fc Heavy Chain (SEQ ID NOS 38783-38792, linker disclosed as SEQ ID NO: 37708)
EIVLTQSPATLSASPGERVTLTCRASQSVGNDVAWYQQKPGQAPRLLINYASHRYTGVPDRFTGSSYGTEFTLTISSVQSEDFGVYYCQQDFSSPRTFGGGTKVEIK/GKPGSGKPGSGKPGS/
EVQLVESGGGLVKPGGSLRLSCVASGFTFSNYWMNWVRQAPKGLEWVAEIRLYSNNYATHYAESVKGRFTISRDDSKSTLYLQMNNLKTEDTGVYYCTRYYGNYGGYFDVWGRGTLVTVSS/EPKSSD
KTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK XENP020895_9C6_H0L0-1G6_L1.194_H1.279 Light Chain (SEQ ID NOS 38793-38797)
SIVMTQTPKFLIVSAGDRVTITCKASQSVSNDVAWYQQKPGQSPKLLIYYASNRYTGVPDRFTGSGYGTDFTFTISTVQAEDLAVYFCQQDNSSPTFGGGTKLEIK/RTVAAPSVFIFPPSDEQLKSGT
ASVVCLLNNFYPREAKVQWKVDNALQSGNSQESVTEQDSKDSTYSLSSTLTLSKADYEKHKVYACEVTHQGLSSPVTKSFNRGEC

Figure 16B

XENP21220

XENP021220_9C6_H1.1_L1-1G6_L1.194_H1.279 Fab-Fc Heavy Chain (SEQ ID NOS 38798-38802)
QVQLKESGAEVKKPGASVKVSCKVSGFSLTGYGVNWVRQAPGQGLEWMGMIWGDGSTDYNSKFQGRVTMTKDNSKSTVYMELSSLRSEDTAVYYCARDRDGRAMDYWGQGTMVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQEGDVFSCSVMHEALHNHYTQKSLSLSPGK XENP021220_9C6_H1.1_L1-1G6_L1.194_H1.279 scFv-Fc Heavy Chain (SEQ ID NOS 38803-38812, linker disclosed as SEQ ID NO: 37708)
EIVLTQSPATLSASPGERVTLTCRASQSVGNDVAWYQQKPGQAPRLLINYASHRYTGVPDRFTGSSYGTEFTLTISSVQSEDFGVYYCQQDFSSPRTFGGGTKVEIK/GKPGSGKPGSGKPGS/
EVQLVESGGGLVKPGGSLRLSCVASGFTFSNYWMNWVRQAPKGLEWVAEIRLYSNNYATHYAESVKGRFTISRDDSKSTLYLQMNNLKTEDTGVYYCTRYYGNYGGYFDVWGRGTLVTVSS/EPKSSD
KTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK XENP021220_9C6_H1.1_L1-1G6_L1.194_H1.279 Light Chain (SEQ ID NOS 38813-38817)
SIVMTQSPDSLAVSLGERATINCKASQSVSNDVAWYQQKPGQSPKLLIYYASNRYTGVPDRFTGSGYGTDFTLTISSLQAEDVAVYFCQQDNSSPTFGGGTKLEIK/RTVAAPSVFIFPPSDEQLKSGT
ASVVCLLNNFYPREAKVQWKVDNALQSGNSQESVTEQDSKDSTYSLSSTLTLSKADYEKHKVYACEVTHQGLSSPVTKSFNRGEC Figure 16C (BTLA x PD-1)

XENP21221

XENP021221_9C6_H1.11_L1.194_H1-1G6_L1.194_H1.279 Fab-Fc Heavy Chain (SEQ ID NOS 38818-38822)
QVQLVQSGAEVKKPGASVKVSCKVSGGTAALGCLVKDYFPEPVTVSWNSGALTSGVHTFPAVLQSSGLYSLSSVVTVPSSLGTQTYICNVNHKPSDTKVDKKVEPKSCDKTHTCPPCPAPPVAGPSVFLFPPKPKDTLMISRTP
LAPSSKSTSGGTAALGCLVKDYFPEPVTVSWNSGALTSGVHTFPAVLQSSGLYSLSSVVTVPSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESDGQ
PENNYKTTPPVLDSDGSFFLYSKLTVDKSRWQEGNVFSCSVMHEALHNHYTQKSLSLSPGK XENP021221_9C6_H1.11_L1.194_H1-1G6_L1.194_H1.279 scFv-Fc Heavy Chain (SEQ ID NOS 38823-38832, linker disclosed as SEQ ID NO: 37708)
EIVLTQSPATLSASPGERVTLTCRASQSVRNDVAWYQQKPGQAPRLLINYASHRYTGVPDRFTGSGYGTEFTLTISSVQSEDFGVYYCQQFSSRTFGGGTKVEIK/GKPGSGKPGSGKPGS/
EVQLVESGGGLVKPGGSLRLSCVASGFTFSNYWMNWVRQAPGKGLEWVAEIRLYSNYATHYAESVKGRFTISRDDSKSTLYLQMNNLKTEDTGVYYCTRYGNYGGYFDVWGRGTLVTVSS/EPKSSD
KTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK XENP021221_9C6_H1.11_L1.194_H1-1G6_L1.194_H1.279 Light Chain (SEQ ID NOS 38833-38837)
SIVMTQSPDSLAVSLGERATINCKASQSVSNDVAWYQQKPGQSPKLLIYYASNRYTGVPDRFTGSGYGTDFTLTISSLQAEDVAVYFCQQDYSSPTFGGGTKLEIK/RTVAAPSVFIFPPSDEQLKSGT
ASVVCLLNNFYPREAKVQWKVDNALQSGNSQESVTEQDSKDSTYSLSSTLTLSKADYEKHKVYACEVTHQGLSSPVTKSFNRGEC

Figure 16D

XENP22858

XENP022858_9C6_H1.1_L1_Fab-1G6_L1.194_H1.279 scFv M428L/N434S Fab-Fc Heavy Chain (SEQ ID NOS 38838-38842)
QVQLKESGAEVKKPGASVKVSCKVSGYTFTGYVMNWVRQAPGQGLEWMGMIWLDGSTDYNSKFQGRVTMTKDNSKSTVYMELSSLRSEDTAVYYCARRRDGRAMDYWGQGTMVTVSS/ASTKGPSVFP
LAPSSKSTSGGTAALGCLVKDYFPEPVTVSWNSGALTSGVHTFPAVLQSSGLYSLSSVVTVPSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESDGQ
PENNYKTTPPVLDSDGSFFLYSKLTVDKSRWQEGNVFSCSVMHEALHNHYTQKSLSLSPGK XENP022858_9C6_H1.1_L1_Fab-1G6_L1.194_H1.279 scFv M428L/N434S scFv-Fc Heavy Chain (SEQ ID NOS 38843-38852, linker disclosed as
SEQ ID NO: 37708)
EIVLTQSPATLSASPGERVTLTCRASQSVRNDVAWYQQKPGQAPRLLINYASHRYTGVPDRFTGSGYGTEFTLTISSVQSEDFGVYYCQQFSSRTFGGGTKVEIK/GKPGSGKPGSGKPGS/
EVQLVESGGGLVKPGGSLRLSCVASGFTFSNYWMNWVRQAPGKGLEWVAEIRLYSNYATHYAEVKGRFTISRDDSKSTLYLQMNNLKTEDTGVYYCTRYGNYGGYFDVWGRGTLVTVSS/EPKSSD
KTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK XENP022858_9C6_H1.1_L1_Fab-1G6_L1.194_H1.279 scFv M428L/N434S Light Chain (SEQ ID NOS 38853-38857)
SIVMTQSPDSLAVSLGERATINCKASQSVSNDVAWYQQKPGQSPKLLIYYASNRYTGVPDRFTGSGYGTDFTLTISSLQAEDVAVYFCQQDYSSPTFGGGTKLEIK/RTVAAPSVFIFPPSDEQLKSGT
ASVVCLLNNFYPREAKVQWKVDNALQSGNSQESVTEQDSKDSTYSLSSTLTLSKADYEKHKVYACEVTHQGLSSPVTKSFNRGEC

Figure 17A

XENP20153

>XENP020153 2A11_H1L2-[CTLA-4]_H3.4_L0.12 Fab-Fc Heavy Chain (SEQ ID NOS 38858-38862)
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQALDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQEGDVFSCSVMHEALHNHYTQKSLSLSPGK >XENP020153 2A11_H1L2-[CTLA-4]_H3.4_L0.12 scFv-Fc Heavy Chain (SEQ ID NOS 38863-38872, linker disclosed as SEQ ID NO: 37708)
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS/GKPGSGKPGS
GKPGSGKPGS/EIVLTQSPGTLSVSPGERATLSCRASQSVGSSYLAWYQQKPGQAPRLLIYGAFSRATGIPDRFSGSGSGTDFLTISRLEPEDFAVYYCQQYGSSPWTFGQGTKVEIK/EPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPS
REQMTKNQVKLTCLVKGFYPSDIAVEWESNGQPENNYKTTPPVLDSDGSFFLYSKLTVDKSRWQQGNVFSCSVMHEALHNHYTQKSLSLSPGK >XENP020153 2A11_H1L2-[CTLA-4]_H3.4_L0.12 Light Chain (SEQ ID NOS 38873-38877)
DIQMTQSPAFLSVTPGEKVTITCQASQDIGNYLNWFQQKPDQTVKLLIYTTSPLHSGVPSRFSGSGSGTDYTFTISSLEAEDAATYFCQQGNNLPYTFGGGTKVEIK/RTVAAPSVFIFPPSDEQLSG
TASVVCLLNNFYPREAKVQWKVDNALQSGNSQESVTEQDSKDSTYSLSSTLTLSKADYEKHKVYACEVTHQGLSSPVTKSFNRGEC

Figure 17B

XENP20833

>XENP020833 7G8_H3L1 Fab-[CTLA-4]_H3.23_L0.129 Fab-Fc Heavy Chain (SEQ ID NOS 38878-38882)
EVQLVESGGGLVQPGGSLRLSCAASGFTFSDAWMEWVRQAPGKGLEWVAEIRTKAANHATTYAESVKGRFTISRDDSKSSVYLQMNSLRAEDTAVYYCTRLANWDWYFDVWGQGTTVTVSS/ASTKGPS
VFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMIS
RTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK >XENP020833 7G8_H3L1 Fab-[CTLA-4]_H3.23_L0.129 scFv-Fc Heavy Chain (SEQ ID NOS 38883-38892, linker disclosed as SEQ ID NO: 37708)
EVQLVESGGGLVQPGGSLRLSCAASGFTFSSYEMHWVRQAPGKGLEWVSFISYDGNYKYYADSVKGRFTISRDNAKNSLYLQMNSLRAEDTAVYYCARGEHLGPFDLWGQGTMVTVSS/GKPGSGKPGS
GKPGSGKPGS/EIVLTQSPGTLSVSPATLSLSPGERATLSCRASQSVGSSYLAWYQQKPGQAPRLLIYGASSRATGIPDRFSGSGSGTDFLTISRLEPEDFAVYYCQQYGSSPWTFGQGTKVEIK/EPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPS
REQMTKNQVKLTCLVKGFYPSDIAVEWESNGQPENNYKTTPPVLDSDGSFFLYSKLTVDKSRWQQGNVFSCSVMHEALHNHYTQKSLSLSPGK >XENP020833 7G8_H3L1 Fab-[CTLA-4]_H3.23_L0.129 Light Chain (SEQ ID NOS 38893-38897)
DTVLTQSPSSLSASVGDRVTITCRASQSVEYDCDSYMHWYQQKPGKPPKLLIYAASNLESGIPARLSGSGSGTDFLTISSLQPEDFATYYCQQSNEDPFTFGSGTKLEIK/RTVAAPSVFIFPPSDEQ
LKSGTASVVCLLNNFYPREAKVQWKVDNALQSGNSQESVTEQDSKDSTYSLSSTLTLSKADYEKHKVYACEVTHQGLSSPVTKSFNRGEC

Figure 17C

XENP21859

>XENP021859_2A11_H1_L2.47_Fab-[CTLA-4]_H3.23_L0.129 Fab-Fc Heavy Chain (SEQ ID NOS 38898-38902)
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQALDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQEGDVFSCSVMHEALHNHYTQKSLSLSPGK >XENP021859_2A11_H1_L2.47_Fab-[CTLA-4]_H3.23_L0.129 scFv-Fc Heavy Chain (SEQ ID NOS 38903-38912, linker disclosed as SEQ ID NO: 37708)
EVQLVESGGGLVKPGGSLRLSCAASGFTFSSYTMHWVRQAPGKGLEWVSFISTDGNYKYYADSVKGRFTISRDNAKNSLYLQMNSLRAEDTAVYYCARGGHLGFDLWGQGTMVTVSS/GKPGSGKPGS
GKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK/EPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPS
REQMTKNQVKLTCLVKGFYPSDIAVEWESNGQPENNYKTTPPVLDSDGSFFLYSKLTVDKSRWQQGNVFSCSVMHEALHNHYTQKSLSLSPGK >XENP021859_2A11_H1_L2.47_Fab-[CTLA-4]_H3.23_L0.129 Light Chain (SEQ ID NOS 38913-38917)
DIQMTQSPAFLSVTPGEKVTITCQASQDIGNYLNWFQQKPDQTVKLLIYYTSHLRSGVPSRFSGSGSGTDYTFTISSLEAEDAATYFCQQGNTLPYTFGGGTKVEIK/RTVAAPSVFIFPPSDEQLKSG
TASVVCLLNNFYPREAKVQWKVDNALQSGNSQESVTEQDSKDSTYSLSSTLTLSKADYEKHKVYACEVTHQGLSSPVTKSFNRGEC

Figure 17D

XENP21860

>XENP021860_2A11_H1_L2.50_Fab-[CTLA-4]_H3.23_L0.129 Fab-Fc Heavy Chain (SEQ ID NOS 38918-38922)
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQALDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQEGDVFSCSVMHEALHNHYTQKSLSLSPGK >XENP021860_2A11_H1_L2.50_Fab-[CTLA-4]_H3.23_L0.129 scFv-Fc Heavy Chain (SEQ ID NOS 38923-38932, linker disclosed as SEQ ID NO: 37708)
EVQLVESGGGLVKPGGSLRLSCAASGFTFSSYTMHWVRQAPGKGLEWVSFISTDGNYKYYADSVKGRFTISRDNAKNSLYLQMNSLRAEDTAVYYCARGGHLGFDLWGQGTMVTVSS/GKPGSGKPGS
GKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK/EPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPS
REQMTKNQVKLTCLVKGFYPSDIAVEWESNGQPENNYKTTPPVLDSDGSFFLYSKLTVDKSRWQQGNVFSCSVMHEALHNHYTQKSLSLSPGK >XENP021860_2A11_H1_L2.50_Fab-[CTLA-4]_H3.23_L0.129 Light Chain (SEQ ID NOS 38933-38937)
DIQMTQSPAFLSVTPGEKVTITCQASQDIGNYLNWFQQKPDQTVKLLIYYTSYLESGVPSRFSGSGSGTDYTFTISSLEAEDAATYFCQQNTLPYTFGGGTKVEIK/RTVAAPSVFIFPPSDEQLKSG
TASVVCLLNNFYPREAKVQWKVDNALQSGNSQESVTEQDSKDSTYSLSSTLTLSKADYEKHKVYACEVTHQGLSSPVTKSFNRGEC

Figure 17E

XENP21895

>XENP021895_7G8_H3.18_L1-[CTLA-4]_H3.23_L0.129 Fab-Fc Heavy Chain   (SEQ ID NOS 38938-38942)
EVQLVESGGGLVQPGGSLRLSCAASGFTFDDAWMDWVRQAPGKGLEWVAEISTKANHATYAESVKGRFTISRDDSKSSVYLQMNSLRAEDTAVYYCTRLATWDWYFDVWGQGTTVTVSS/ASTKGPS
VFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMIS
RTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWQEGDVFSCSVMHEALHNHYTQKSLSLSPGK >XENP021895_7G8_H3.18_L1-[CTLA-4]_H3.23_L0.129 scFv-Fc Heavy Chain   (SEQ ID NOS 38943-38952, linker disclosed as SEQ ID NO:
37708)
EVQLVESGGGLVKPGGSLRLSCAASGFTFSSYMHWVRQAPGKGLEWVSFISVDGNYKYYADSVKGRFTISRDNAKNSLYLQMNSLRAEDTAVYCARGGHLGFDLWGQGTMTVSS/GKPGSGKPGS
GKPGSGKPGS/EIVLTQSPATLSLSPGERATLSCRASQSVYGSSYLAWYQQKPGQAPRLLIYGASSRATGIPDRFSGSGSGTDFTLTISRLEPEDFAVYYCQQYGSSPWTFGQGTKVEIK/EPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPS
REQMTKNQVKLTCLVKGFYPSDIAVEWESNGQPENNYKTTPPVLDSDGSFFLYSKLTVDKSRWQQGNVFSCSVMHEALHNHYTQKSLSLSPGK >XENP021895_7G8_H3.18_L1-[CTLA-4]_H3.23_L0.129 Light Chain   (SEQ ID NOS 38953-38957)
DIVLTQSPSSLSASVGDRVTITCRASQSVLRDGSYMNWYQQKPGKPPKLLIYAASNLESGIPARLSGSGSGTDFTLTISSLQPEDFATYYCQQSNEDPFTFGSGTKLEIK/RTVAAPSVFIFPPSDEQ
LKSGTASVVCLLNNFYPREAKVQWKVDNALQSGNSQESVTEQDSKDSTYSLSSTLTLSKADYEKHKVYACEVTHQGLSSPVTKSFNRGEC

Figure 17F

XENP21896

>XENP021896_7G8_H3.18_L1.11-[CTLA-4]_H3.23_L0.129 Fab-Fc Heavy Chain   (SEQ ID NOS 38958-38962)
EVQLVESGGGLVQPGGSLRLSCAASGFTFDDAWMDWVRQAPGKGLEWVAEISTKANHATYAESVKGRFTISRDDSKSSVYLQMNSLRAEDTAVYYCTRLATWDWYFDVWGQGTTVTVSS/ASTKGPS
VFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMIS
RTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWQEGDVFSCSVMHEALHNHYTQKSLSLSPGK >XENP021896_7G8_H3.18_L1.11-[CTLA-4]_H3.23_L0.129 scFv-Fc Heavy Chain   (SEQ ID NOS 38963-38972, linker disclosed as SEQ ID NO:
37708)
EVQLVESGGGLVKPGGSLRLSCAASGFTFSSYMHWVRQAPGKGLEWVSFISVDGNYKYYADSVKGRFTISRDNAKNSLYLQMNSLRAEDTAVYCARGGHLGFDLWGQGTMTVSS/GKPGSGKPGS
GKPGSGKPGS/EIVLTQSPATLSLSPGERATLSCRASQSVYGSSYLAWYQQKPGQAPRLLIYGASSRAHGIPDRFSGSGSGTDFTLTISRLEPEDFAVYYCQQYGSSRWTFGQGTKVEIK/EPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPS
REQMTKNQVKLTCLVKGFYPSDIAVEWESNGQPENNYKTTPPVLDSDGSFFLYSKLTVDKSRWQQGNVFSCSVMHEALHNHYTQKSLSLSPGK >XENP021896_7G8_H3.18_L1.11-[CTLA-4]_H3.23_L0.129 Light Chain   (SEQ ID NOS 38973-38977)
DIVLTQSPSSLSASVGDRVTITCRASQSVLRDGSYMNWYQQKPGKPPKLLIYAASELESGIPARLSGSGSGTDFTLTISSLQPEDFATYYCQQSNEDPFTFGSGTKLEIK/RTVAAPSVFIFPPSDEQ
LKSGTASVVCLLNNFYPREAKVQWKVDNALQSGNSQESVTEQDSKDSTYSLSSTLTLSKADYEKHKVYACEVTHQGLSSPVTKSFNRGEC

Figure 17G

XENP21902

>XENP021902_7G8_H3.23_L1.11-[CTLA-4]_H3.23_L0.129 Fab-Fc Heavy Chain  (SEQ ID NOS 38978-38982)
EVQLVESGGGLVQPGGSLRLSCAASGFTFSDAWMEWVRQAPGKGLEWVAEISTKAXNHATYYAESVKGRFTISRDDSKSSVYLQMNSLRAEDTAVYYCTRLATWDWYEDVWGQGTTVTVSS/ASTKGPS
VFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMIS
RTPEVTCVVVDVSHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK >XENP021902_7G8_H3.23_L1.11-[CTLA-4]_H3.23_L0.129 scFv-Fc Heavy Chain  (SEQ ID NOS 38983-38992, linker disclosed as SEQ ID NO:
37708)
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPEDLWGQGTMVTVSS/GKPGSGKPGS
GKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK/EPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPS
REQMTKNQVKLTCLVKGFYPSDIAVEWESNGQPENNYKTTPPVLDSDGSFFLYSKLTVDKSRWQQGNVFSCSVMHEALHNHYTQKSLSLSPGK >XENP021902_7G8_H3.23_L1.11-[CTLA-4]_H3.23_L0.129 Light Chain  (SEQ ID NOS 38993-38997)
DIVLTQSPSSLSASVGDRVTITCRASQSVYDGDSYMNWYQQKPGKPPKLLIYAASELESGIPARLSGSGSGTDFTLTISSLQPEDFATYYCQQSNEDPFTFGSGTKLEIK/RTVAAPSVFIFPPSDEQ
LKSGTASVVCLLNNFYPREAKVQWKVDNALQSGNSQESVTEQDSKDSTYSLSSTLTLSKADYEKHKVYACEVTHQGLSSPVTKSFNRGEC

Figure 17H

XENP21904

>XENP021904_7G8_H3.28_L1-[CTLA-4]_H3.23_L0.129 Fab-Fc Heavy Chain  (SEQ ID NOS 38998-39002)
EVQLVESGGGLVQPGGSLRLSCAASGFTFDDAWMEWVRQAPGKGLEWVAEISTKAXNHATYYAESVKGRFTISRDDSKSSVYLQMNSLRAEDTAVYYCTRLATWDWYEDVWGQGTTVTVSS/ASTKGPS
VFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMIS
RTPEVTCVVVDVSHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK >XENP021904_7G8_H3.28_L1-[CTLA-4]_H3.23_L0.129 scFv-Fc Heavy Chain  (SEQ ID NOS 39003-39012, linker disclosed as SEQ ID NO:
37708)
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPEDLWGQGTMVTVSS/GKPGSGKPGS
GKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK/EPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPS
REQMTKNQVKLTCLVKGFYPSDIAVEWESNGQPENNYKTTPPVLDSDGSFFLYSKLTVDKSRWQQGNVFSCSVMHEALHNHYTQKSLSLSPGK >XENP021904_7G8_H3.28_L1-[CTLA-4]_H3.23_L0.129 Light Chain  (SEQ ID NOS 39013-39017)
DIVLTQSPSSLSASVGDRVTITCRASQSVYDGDSYMNWYQQKPGKPPKLLIYAASNLESGIPARLSGSGSGTDFTLTISSLQPEDFATYYCQQSNEDPFTFGSGTKLEIK/RTVAAPSVFIFPPSDEQ
LKSGTASVVCLLNNFYPREAKVQWKVDNALQSGNSQESVTEQDSKDSTYSLSSTLTLSKADYEKHKVYACEVTHQGLSSPVTKSFNRGEC

Figure 17I

XENP21905

>XENP021905_7G8_H3.28_L1.11-[CTLA-4]_H3.23_L0.129 Fab-Fc Heavy Chain  (SEQ ID NOS 39018-39022)
EVQLVESGGGLVQPGGSLRLSCAASGFTFDDAWMDWVRQAPGKGLEWVAEISTKAYNHATYYAESVKGRFTISRDDSKSSVYLQMNSLRAEDTAVYYCTRLATWDWYFDVWGQGTTVTVSS/ASTKGPS
VFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMIS
RTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK >XENP021905_7G8_H3.28_L1.11-[CTLA-4]_H3.23_L0.129 scFv-Fc Heavy Chain  (SEQ ID NOS 39023-39032, linker disclosed as SEQ ID NO:
37708)
EVQLVESGGGLVKPGGSLRLSCAASGFTFSSYTMHWVRQAPGKGLEWVSEISYDGNYKYYADSVKGRFTISRDNAKNSLYLQMNSLRAEDTAVYYCARGGHLGFFDLWGQGTMVTVSS/GKPGSGKPGS
GKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK/EPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPS
REQMTKNQVKLTCLVKGFYPSDIAVEWESNGQPENNYKTTPPVLDSDGSFFLYSKLTVDKSRWQQGNVFSCSVMHEALHNHYTQKSLSLSPGK >XENP021905_7G8_H3.28_L1.11-[CTLA-4]_H3.23_L0.129 Light Chain  (SEQ ID NOS 39033-39037)
DIVLTQSPSSLSASVGDRVTITCRASQSVEDGDSYMNWYQQKPGKPPKLLIYAASELESGIPARLSGSGSGTDFTLTISSLQPEDFATYYCQQSNEDPFTFGSGTKLEIK/RTVAAPSVFIFPPSDEQ
LKSGTASVVCLLNNFYPREAKVQWKVDNALQSGNSQESVTEQDSKDSTYSLSSTLTLSKADYEKHKVYACEVTHQGLSSPVTKSFNRGEC

Figure 17J

XENP21906

>XENP021906_7G8_H3.28_L1.13-[CTLA-4]_H3.23_L0.129 Fab-Fc Heavy Chain  (SEQ ID NOS 39038-39042)
EVQLVESGGGLVQPGGSLRLSCAASGFTFDDAWMDWVRQAPGKGLEWVAEISTKAYNRATYYAESVKGRFTISRDDSKSSVYLQMNSLRAEDTAVYYCTRLATWDWYFDVWGQGTTVTVSS/ASTKGPS
VFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMIS
RTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK >XENP021906_7G8_H3.28_L1.13-[CTLA-4]_H3.23_L0.129 scFv-Fc Heavy Chain  (SEQ ID NOS 39043-39052, linker disclosed as SEQ ID NO:
37708)
EVQLVESGGGLVKPGGSLRLSCAASGFTFSSYTMHWVRQAPGKGLEWVSEISYDGNYKYYADSVKGRFTISRDNAKNSLYLQMNSLRAEDTAVYYCARGGHLGFFDLWGQGTMVTVSS/GKPGSGKPGS
GKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK/EPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPS
REQMTKNQVKLTCLVKGFYPSDIAVEWESNGQPENNYKTTPPVLDSDGSFFLYSKLTVDKSRWQQGNVFSCSVMHEALHNHYTQKSLSLSPGK >XENP021906_7G8_H3.28_L1.13-[CTLA-4]_H3.23_L0.129 Light Chain  (SEQ ID NOS 39053-39057)
DIVLTQSPSSLSASVGDRVTITCRASQSVEHDGDSYMNWYQQKPGKPPKLLIYAASELESGIPARLSGSGSGTDFTLTISSLQPEDFATYYCQQSNEDPFTFGSGTKLEIK/RTVAAPSVFIFPPSDEQ
LKSGTASVVCLLNNFYPREAKVQWKVDNALQSGNSQESVTEQDSKDSTYSLSSTLTLSKADYEKHKVYACEVTHQGLSSPVTKSFNRGEC

Figure 17K

XENP22505

>XENP022505_2A11_H1.125_L2.113_Fab-[CTLA-4]_H3.23_L0.129 Fab-Fc Heavy Chain (SEQ ID NOS 39058-39062)
EVQLVQSGAEVKKPGATVKISCKASGFNIKHYFMHWVQQAPGKGLEWMGWIDPYLGETEYARKFQGRVTITADTSTNTAYMELSSLRSEDTAVYYCYARGVYQALDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWEQGDVFSCSVMHEALHNHYTQKSLSLSPGK >XENP022505_2A11_H1.125_L2.113_Fab-[CTLA-4]_H3.23_L0.129 scFv-Fc Heavy Chain (SEQ ID NOS 39063-39072, linker disclosed as SEQ ID NO: 37708)
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSS/GKPGSGKPGS
GKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK/EPKSSDKTH
TCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPS
REQMKNQVKLTCLVKGFYPSDIAVEWESNGQPENNYKTTPPVLDSDGSFFLYSKLTVDKSRWQQGNVFSCSVMHEALHNHYTQKSLSLSPGK >XENP022505_2A11_H1.125_L2.113_Fab-[CTLA-4]_H3.23_L0.129 Light Chain (SEQ ID NOS 39073-39077)
DIQMTQSPAFLSVTPGEKVTITCQASQDIGNYLNWFQQKPDQTVKLLIYETSYLHSGVPSRFSGSGSGTDYTFTISSLEAEDAATYFCQQGNTLPYTFGGGTKVEIK/RTVAAPSVFIFPPSDEQLKSG
TASVVCLLNNFYPREAKVQWKVDNALQSGNSQESVTEQDSKDSTYSLSSTLTLSKADYEKHKVYACEVTHQGLSSPVTKSFNRGEC

Figure 17L

XENP22510

>XENP022510_2A11_H1_L2.25_Fab-[CTLA-4]_H3.23_L0.129 Fab-Fc Heavy Chain (SEQ ID NOS 39078-39082)
EVQLVQSGAEVKKPGATVKISCKASGFNIKDYYMHWVQQAPGKGLEWMGWIDPENGETEYARKFQGRVTITADTSTNTAYMELSSLRSEDTAVYYCYARGVYQALDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWEQGDVFSCSVMHEALHNHYTQKSLSLSPGK >XENP022510_2A11_H1_L2.25_Fab-[CTLA-4]_H3.23_L0.129 scFv-Fc Heavy Chain (SEQ ID NOS 39083-39092, linker disclosed as SEQ ID NO: 37708)
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSS/GKPGSGKPGS
GKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK/EPKSSDKTH
TCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPS
REQMKNQVKLTCLVKGFYPSDIAVEWESNGQPENNYKTTPPVLDSDGSFFLYSKLTVDKSRWQQGNVFSCSVMHEALHNHYTQKSLSLSPGK >XENP022510_2A11_H1_L2.25_Fab-[CTLA-4]_H3.23_L0.129 Light Chain (SEQ ID NOS 39093-39097)
DIQMTQSPAFLSVTPGEKVTITCQASQDIGNHLNWFQQKPDQTVKLLIYYTSRLHSGVPSRFSGSGSGTDYTFTISSLEAEDAATYFCQQGNTLPYTFGGGTKVEIK/RTVAAPSVFIFPPSDEQLKSG
TASVVCLLNNFYPREAKVQWKVDNALQSGNSQESVTEQDSKDSTYSLSSTLTLSKADYEKHKVYACEVTHQGLSSPVTKSFNRGEC

Figure 17M

XENP22602

>XENP022602_7G8_H3.30_L1.34-[CTLA-4]_H3.23_L0.129 Fab-Fc Heavy Chain (SEQ ID NOS 39098-39102)
EVQLVESGGGLVQPGGSLRLSCAASGFTFDDAWMSWVRQAPGKGLEWVAEISRANNEATYYAESVKGRFTISRDDSKSSVYLQMNSLRAEDTAVYYCTRLATWDWYEDVWGQGTTVTVSS/ASTKGPS
VFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMIS
RTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWQQGNVFSCSVMHEALHNHYTQKSLSLSPGK >XENP022602_7G8_H3.30_L1.34-[CTLA-4]_H3.23_L0.129 scFv-Fc Heavy Chain (SEQ ID NOS 39103-39112, linker disclosed as SEQ ID NO: 37708)
EVQLVESGGGLVKPGGSLRLSCAASGFTFSSYTMHWVRQAPGKGLEWVSEISYDGNYKYYADSVKGRFTISRDNAKNSLYLQMNSLRAEDTAVYYCARGGHLGEFDLWGQGTMVTVSS/GKPGSGKPGS
GKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK/EPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPS
REQMTKNQVKLTCLVKGFYPSDIAVEWESNGQPENNYKTTPPVLDSDGSFFLYSKLTVDKSRWQQGNVFSCSVMHEALHNHYTQKSLSLSPGK >XENP022602_7G8_H3.30_L1.34-[CTLA-4]_H3.23_L0.129 Light Chain (SEQ ID NOS 39113-39117)
DIVLTQSPSSLSASVGDRVTITCRASQSVYDGDSYMRWYQQKPGKPPKLLIYAASELESGIPARFSGSGSGTDFTLTISSLQPEDFATYYCQQSNEDPFTFGSGTKLEIK/RTVAAPSVFIFPPSDEQ
LKSGTASVVCLLNNFYPREAKVQWKVDNALQSGNSQESVTEQDSKDSTYSLSSTLTLSKADYEKHKVYACEVTHQGLSSPVTKSFNRGEC

Figure 17N

XENP22675

>XENP022675_2A11_H1.144_L2.142_Fab-[CTLA-4]_H3.23_L0.129 Fab-Fc Heavy Chain (SEQ ID NOS 39118-39122)
EVQLVQSGAEVKKPGATVKISCKASGFNIKDYFMHWVQQAPGKGLEWMGWIDPELGDTEYAPKFQGRVTITADTSTNTAYMELSSLRSEDTAVYYCYARGVYQALDYWGQGTLVTVSS/ASTKGPSVFP
LAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTP
EVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWQQGNVFSCSVMHEALHNHYTQKSLSLSPGK >XENP022675_2A11_H1.144_L2.142_Fab-[CTLA-4]_H3.23_L0.129 scFv-Fc Heavy Chain (SEQ ID NOS 39123-39132, linker disclosed as SEQ ID NO: 37708)
EVQLVESGGGLVKPGGSLRLSCAASGFTFSSYTMHWVRQAPGKGLEWVSEISYDGNYKYYADSVKGRFTISRDNAKNSLYLQMNSLRAEDTAVYYCARGGHLGEFDLWGQGTMVTVSS/GKPGSGKPGS
GKPGSGKPGS/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK/EPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPS
REQMTKNQVKLTCLVKGFYPSDIAVEWESNGQPENNYKTTPPVLDSDGSFFLYSKLTVDKSRWQQGNVFSCSVMHEALHNHYTQKSLSLSPGK >XENP022675_2A11_H1.144_L2.142_Light Chain (SEQ ID NOS 39133-39137)
DIQMTQSPAFLSVTPGEKVTITCQASQDIGNYLNWFQQKPGQTVKLLIYETSYLHSGVPSRFSGSGSGTDYTFTISSLEAEDAATYFCQQGNTLPYTFGGGTKVEIK/RTVAAPSVFIFPPSDEQLKSG
TASVVCLLNNFYPREAKVQWKVDNALQSGNSQESVTEQDSKDSTYSLSSTLTLSKADYEKHKVYACEVTHQGLSSPVTKSFNRGEC

Figure 17O

XENP22841

>XENP022841_7G8_H3.30_L1.34_Fab-[CTLA-4]_H3.23_L0.129_scFv_M428L/N434S Fab-Fc Heavy Chain (SEQ ID NOS 39138-39142)
EVQLVESGGGLVQPGGSLRLSCAASGFTFDDAWMSWVRQAPGKGLEWVAKISWANWHATYYAESYKGRFTISRDDSKSSVYLQMNSLRAEDTAVYYCTRLATWDWYFDVWGQGTTVTVSS/ASTKGPS
VFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMIS
RTPEVTCVVVDVSHEDPEVKFNWYVDGVEVHNAKTKPREEYNSTYRVVSVLTVLHQDWLNGKEYKCKVSNKALPAPIEKTISKAKGQPREPQVYTLPPSREEMTKNQVSLTCLVKGFYPSDIAVEWES
DGQPENNYKTTPPVLDSDGSFFLYSKLTVDKSRWEQGDVFSCSVLHEALHSHYTQKSLSLSPGK >XENP022841_7G8_H3.30_L1.34_Fab-[CTLA-4]_H3.23_L0.129_scFv_M428L/N434S scFv-Fc Heavy Chain (SEQ ID NOS 39143-39152, linker disclosed as SEQ ID NO: 37708)
EVQLVESGGGLVKPGGSLRLSCAASGFTFSSYEMHWVRQAPGKGLEWVSFISYDGNYKYYADSVKGRFTISRDNAKNSLYLQMNSLRAEDTAVYYCARGGHLGPDLWGQGTMVTVSS/<u>GKPGSGKPGS</u>
<u>GKPGSGKPGS</u>/EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK/EPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPS
REQMTKNQVSLTCLVKGFYPSDIAVEWESNGQPENNYKTTPPVLDSDGSFFLYSKLTVDKSRWQQGNVFSCSVLHEALHSHYTQKSLSLSPGK >XENP022841_7G8_H3.30_L1.34_Fab-[CTLA-4]_H3.23_L0.129_scFv_M428L/N434S Light Chain (SEQ ID NOS 39153-39157)
DIVLTQSPSSLSASVGDRVTITCRASQSVDYDGDSYMNWYQQKPGKPPKLLIYAASELESGIPARFSGSGSGTDFLTISSLQPEDFATYYCQQSNEDFTFGSGTKLEIK/RTVAAPSVFIFPPSDEQ
LKSGTASVVCLLNNFYPREAKVQWKVDNALQSGNSQESVTEQDSKDSTYSLSSTLTLSKADYEKHKVYACEVTHQGLSSPVTKSFNRGEC

XENP22843

Figure 19A depict cytokine release assay (A: IL-2, G: IFNγ) after SEB stimulation of human PBMCs and treatment with an anti-PD-1 x anti-CTLA-4 bispecific antibody.

Figure 20A-C depicts CD45+ events, CD4+ events and CD8+ events on Day 14 after human PBMCs were engrafted into NSG mice on Day 0 followed by dosing with the indicated test articles on Day 1.

Figure 22

| XENP | Clone | VH | VL | KD (M) | ka (1/Ms) | kd (1/s) |
|---|---|---|---|---|---|---|
| Experiment #1 | | | | | | |
| 16275 | mAb8213 | H0 | L0 | 4.94E-09; 5.93E-09 | 7.34E04; 8.63E04 | 3.63E-04; 5.12E-04 |
| 17973 | ABTIM3 | H0 | L0 | 1.74E-09; 2.75E-09 | 1.45E05; 1.97E05 | 2.52E-04; 5.42E-04 |
| 20850 | 1D12 | H1 | L1 | 9.07E-09 | 2.45E05 | 2.22E-03 |
| 20851 | 1D12 | H1 | L2 | 2.84E-08 | 1.72E05 | 4.87E-03 |
| 20853 | 3H3 | H1 | L1 | 4.49E-09 | 1.04E05 | 4.66E-04 |
| 20854 | 3H3 | H1 | L2 | 7.64E-09 | 7.07E04 | 5.40E-04 |
| 20855 | 3H3 | H2 | L1 | 5.16E-09 | 1.97E05 | 1.02E-03 |
| 20856 | 3H3 | H2 | L2 | 1.30E-08 | 1.11E05 | 1.44E-03 |
| 20857 | 3H3 | H3 | L1 | 7.11E-09 | 1.04E05 | 7.39E-04 |
| 20858 | 3H3 | H3 | L2 | 1.57E-08 | 8.16E04 | 1.28E-03 |
| 20859 | 3H3 | H4 | L1 | 4.50E-09 | 1.53E05 | 6.88E-04 |
| 20860 | 3H3 | H4 | L2 | 8.20E-09 | 9.15E04 | 7.50E-04 |
| 20861 | 7B11 | H1 | L1 | 1.07E-08 | 2.86E05 | 3.06E-03 |
| 20862 | 7B11 | H1 | L2 | 1.24E-08 | 1.37E05 | 1.70E-03 |
| 20863 | 7B11 | H2 | L1 | 9.24E-09 | 2.77E05 | 2.56E-03 |
| 20864 | 7B11 | H2 | L2 | 1.85E-08 | 1.34E05 | 2.48E-03 |
| 20865 | 7C2 | H1 | L1 | 5.90E-09 | 3.01E05 | 1.78E-03 |
| Experiment #2 | | | | | | |
| 16275 | mAb8213 | H0 | L0 | 8.37E-10 | 1.84E05 | 1.54E-04 |
| 21188 | 3H3 | H1 | L1.1 | 5.34E-09 | 1.38E05 | 7.35E-04 |
| 21189 | 3H3 | H1 | L2.1 | 2.61E-09 | 1.54E05 | 4.00E-04 |
| 21190 | 3H3 | H2 | L1.1 | 8.61E-09 | 2.93E05 | 2.52E-03 |
| 21191 | 3H3 | H2 | L2.1 | 6.90E-09 | 2.52E05 | 1.74E-03 |
| 21192 | 3H3 | H3 | L1.1 | 1.25E-08 | 1.14E05 | 1.42E-03 |
| 21193 | 3H3 | H3 | L2.1 | 6.32E-09 | 1.56E05 | 9.87E-04 |
| 21194 | 3H3 | H4 | L1.1 | 4.60E-09 | 1.80E05 | 8.26E-04 |
| 21195 | 3H3 | H4 | L2.1 | 2.50E-09 | 1.78E05 | 4.45E-04 |
| 21196 | 7B11 | H1 | L1.1 | 3.11E-08 | 4.32E05 | 1.34E-02 |
| 21201 | 7B11 | H1 | L2.1 | 3.76E-08 | 3.87E05 | 1.45E-02 |
| 21202 | 7B11 | H2.1 | L1.1 | 3.25E-08 | 5.00E05 | 1.63E-02 |
| 21203 | 7B11 | H2.1 | L2.1 | 2.66E-08 | 4.80E05 | 1.28E-02 |
| 21204 | 7C2 | H1.1 | L1.1 | 9.41E-10 | 1.56E06 | 1.47E-03 |
| Experiment #3 | | | | | | |
| 16275 | mAb8213 | H0 | L0 | 8.50E-11 | 1.86E05 | 1.58E-05 |
| 21492 | 1D12 | H0 | L0 | 1.07E-07 | 1.97E05 | 2.11E-02 |
| 21495 | 7A9 | H0 | L0 | 3.06E-08 | 2.03E05 | 6.21E-03 |
| 21496 | 7B11 | H0 | L0 | 2.24E-08 | 2.61E05 | 5.84E-03 |
| 21501 | 7B11var | H0 | L0 | 2.02E-08 | 2.90E05 | 5.84E-03 |
| 21502 | 7C2 | H0 | L0 | 6.43E-09 | 2.68E06 | 1.72E-02 |

Figure 23A

| Full-length mAb XENP | scFv XENP | VH | VL | scFv orientation | Human PD-1 mAb $K_D$ (M) | scFv $T_m$ (°C) |
|---|---|---|---|---|---|---|
| 17906 | 17922 | H1 | L1 | VH-VL | 1.49E-07 | 56.5 |
| 18094 | 18493 | H1.1 | L1 | VH-VL | 1.62E-07 | 56.5 |
| 18095 | 18494 | H1.2 | L1 | VH-VL | 1.59E-07 | 57.0 |
| 18096 | 18495 | H1.3 | L1 | VH-VL | 1.86E-07 | 55.0 |
| 18101 | 18496 | H1.4 | L1 | VH-VL | 1.66E-07 | 56.5 |
| 18102 | 18501 | H1.5 | L1 | VH-VL | 1.79E-07 | 56.0 |
| 18103 | 18502 | H1.6 | L1 | VH-VL | 1.43E-07 | 56.0 |
| 18104 | 18503 | H1.7 | L1 | VH-VL | 1.18E-07 | 56.0 |
| 18105 | 18504 | H1.8 | L1 | VH-VL | 1.21E-07 | 57.0 |
| 18106 | 18505 | H1.9 | L1 | VH-VL | 1.91E-07 | 54.5 |
| 18107 | 18506 | H1.10 | L1 | VH-VL | 2.80E-07 | |
| 18108 | 18507 | H1.11 | L1 | VH-VL | 1.22E-07 | 56.5 |
| 18109 | 18508 | H1.12 | L1 | VH-VL | 1.48E-07 | 56.0 |
| 18110 | 18509 | H1.13 | L1 | VH-VL | 1.65E-07 | 55.5 |
| 18111 | 18510 | H1.14 | L1 | VH-VL | 1.59E-07 | 55.5 |
| 18112 | 18511 | H1.15 | L1 | VH-VL | 1.30E-07 | 55.5 |
| 18113 | 18512 | H1.16 | L1 | VH-VL | 1.39E-07 | 55.0 |
| 18114 | 18513 | H1.17 | L1 | VH-VL | 5.15E-07 | |
| 18115 | 18514 | H1.18 | L1 | VH-VL | 1.20E-07 | 55.5 |
| 18116 | 18515 | H1.19 | L1 | VH-VL | 1.70E-07 | 56.0 |
| 18117 | 18516 | H1.20 | L1 | VH-VL | 1.47E-07 | |
| 18118 | 18517 | H1.21 | L1 | VH-VL | 2.04E-07 | |
| 18119 | 18518 | H1.22 | L1 | VH-VL | 1.24E-07 | 55.5 |
| 18120 | 18519 | H1.23 | L1 | VH-VL | 1.39E-06 | |
| 18121 | 18520 | H1.24 | L1 | VH-VL | 1.84E-07 | |
| 18122 | 18521 | H1.25 | L1 | VH-VL | 1.71E-07 | |
| 18123 | 18522 | H1.26 | L1 | VH-VL | 1.20E-07 | 54.5 |
| 18124 | 18523 | H1.27 | L1 | VH-VL | 2.02E-07 | 55.0 |
| 18125 | 18524 | H1.28 | L1 | VH-VL | 9.64E-08 | 56.0 |
| 18126 | 18525 | H1.29 | L1 | VH-VL | 1.51E-07 | |
| 18127 | 18526 | H1.30 | L1 | VH-VL | 2.01E-07 | |
| 18128 | 18527 | H1.31 | L1 | VH-VL | 1.83E-07 | |
| 18129 | 18528 | H1.32 | L1 | VH-VL | 2.53E-07 | |
| 18130 | 18529 | H1.33 | L1 | VH-VL | 1.87E-07 | |
| 18131 | 18530 | H1.34 | L1 | VH-VL | 1.45E-07 | |
| 18132 | 18531 | H1.35 | L1 | VH-VL | 2.19E-07 | |
| 18133 | 18532 | H1.36 | L1 | VH-VL | 2.18E-07 | |
| 18134 | 18533 | H1.37 | L1 | VH-VL | 2.63E-07 | |
| 18135 | 18534 | H1.38 | L1 | VH-VL | 2.12E-07 | |
| 18136 | 18535 | H1.39 | L1 | VH-VL | 1.90E-07 | |
| 18137 | 18536 | H1.40 | L1 | VH-VL | 3.78E-07 | |
| 18138 | 18537 | H1.41 | L1 | VH-VL | 1.60E-07 | |
| 18139 | 18538 | H1.42 | L1 | VH-VL | 1.74E-07 | |
| 18140 | 18539 | H1.43 | L1 | VH-VL | 1.64E-07 | |

Figure 23B

| Full-length mAb XENP | scFv XENP | VH | VL | scFv orientation | Human PD-1 mAb $K_D$ (M) | scFv $T_m$ (°C) |
|---|---|---|---|---|---|---|
| 18141 | 18540 | H1.44 | L1 | VH-VL | Weak | 55.0 |
| 18142 | 18541 | H1.45 | L1 | VH-VL | 1.34E-07 | 51.0 |
| 18143 | 18542 | H1.46 | L1 | VH-VL | 1.10E-07 | 56.5 |
| 18144 | 18543 | H1.47 | L1 | VH-VL | 1.11E-07 | |
| 18145 | 18544 | H1.48 | L1 | VH-VL | 9.01E-08 | |
| 18146 | 18545 | H1.49 | L1 | VH-VL | 1.33E-07 | 56.0 |
| 18147 | 18546 | H1.50 | L1 | VH-VL | 1.44E-07 | 56.5 |
| 18148 | 18547 | H1.51 | L1 | VH-VL | 1.17E-07 | 51.0 |
| 18149 | 18548 | H1.52 | L1 | VH-VL | 9.92E-08 | 57.0 |
| 18150 | 18549 | H1.53 | L1 | VH-VL | 1.36E-07 | 55.5 |
| 18151 | 18550 | H1.54 | L1 | VH-VL | 1.70E-07 | |
| 18152 | 18551 | H1.55 | L1 | VH-VL | 1.31E-07 | |
| 18153 | 18552 | H1.56 | L1 | VH-VL | Weak | |
| 18154 | 18553 | H1.57 | L1 | VH-VL | 3.66E-07 | |
| 18155 | 18554 | H1.58 | L1 | VH-VL | Weak | |
| 18156 | 18555 | H1.59 | L1 | VH-VL | 1.65E-06 | |
| 18157 | 18556 | H1.60 | L1 | VH-VL | 1.84E-07 | |
| 18158 | 18557 | H1.61 | L1 | VH-VL | Weak | |
| 18159 | 18558 | H1.62 | L1 | VH-VL | 1.37E-07 | |
| 18160 | 18559 | H1.63 | L1 | VH-VL | 1.00E-07 | 56.0 |
| 18161 | 18560 | H1.64 | L1 | VH-VL | 1.75E-07 | |
| 18162 | 18561 | H1.65 | L1 | VH-VL | 2.76E-07 | |
| 18163 | 18562 | H1.66 | L1 | VH-VL | 2.02E-07 | |
| 18164 | 18563 | H1.67 | L1 | VH-VL | 8.12E-07 | |
| 18165 | 18564 | H1.68 | L1 | VH-VL | 2.23E-07 | |
| 18166 | 18565 | H1.69 | L1 | VH-VL | 1.82E-07 | |
| 18167 | 18566 | H1.70 | L1 | VH-VL | 1.97E-07 | |
| 18168 | 18567 | H1.71 | L1 | VH-VL | 4.53E-07 | |
| 18169 | 18568 | H1.72 | L1 | VH-VL | 4.29E-07 | |
| 18170 | 18569 | H1.73 | L1 | VH-VL | 1.79E-07 | 54.5 |
| 18171 | 18570 | H1.74 | L1 | VH-VL | 1.45E-07 | 55.5 |
| 18172 | 18571 | H1.75 | L1 | VH-VL | 1.65E-07 | 53.0 |
| 18173 | 18572 | H1.76 | L1 | VH-VL | 1.41E-07 | 55.5 |
| 18174 | 18573 | H1.77 | L1 | VH-VL | 1.25E-07 | 54.0 |
| 18175 | 18574 | H1.78 | L1 | VH-VL | 1.09E-07 | 53.5 |
| 18176 | 18575 | H1.79 | L1 | VH-VL | 2.52E-07 | |
| 18177 | 18576 | H1.80 | L1 | VH-VL | 1.91E-07 | |
| 18178 | 18577 | H1.81 | L1 | VH-VL | 2.13E-07 | |
| 18179 | 18578 | H1.82 | L1 | VH-VL | 2.40E-07 | |
| 18180 | 18579 | H1.83 | L1 | VH-VL | Weak | |
| 18181 | 18580 | H1.84 | L1 | VH-VL | 1.03E-07 | 55.5 |
| 18182 | 18581 | H1.85 | L1 | VH-VL | 8.62E-08 | 55.0 |
| 18183 | 18582 | H1.86 | L1 | VH-VL | 8.39E-08 | 55.5 |
| 18184 | 18583 | H1.87 | L1 | VH-VL | 9.43E-08 | 54.0 |

Figure 23C

| Full-length mAb XENP | scFv XENP | VH | VL | scFv orientation | Human PD-1 mAb $K_D$ (M) | scFv $T_m$ (°C) |
|---|---|---|---|---|---|---|
| 18185 | 18584 | H1.88 | L1 | VH-VL | 8.51E-08 | 56.0 |
| 18186 | 18585 | H1.89 | L1 | VH-VL | 8.09E-08 | 54.5 |
| 18187 | 18586 | H1.90 | L1 | VH-VL | 7.54E-08 | 55.0 |
| 18188 | 18587 | H1.91 | L1 | VH-VL | 1.04E-07 | 54.5 |
| 18189 | 18588 | H1.92 | L1 | VH-VL | 1.07E-07 | |
| 18190 | 18589 | H1.93 | L1 | VH-VL | 1.21E-07 | |
| 18191 | 18590 | H1.94 | L1 | VH-VL | 8.46E-08 | |
| 18192 | 18591 | H1.95 | L1 | VH-VL | 9.15E-08 | |
| 18193 | 18592 | H1.96 | L1 | VH-VL | 6.42E-08 | |
| 18194 | 18593 | H1.97 | L1 | VH-VL | 8.23E-08 | |
| 18195 | 18594 | H1.98 | L1 | VH-VL | 2.41E-07 | 56.0 |
| 18196 | 18595 | H1.99 | L1 | VH-VL | 2.10E-07 | 56.5 |
| 18201 | 18596 | H1.100 | L1 | VH-VL | 2.51E-07 | 55.0 |
| 18202 | 18601 | H1.101 | L1 | VH-VL | 2.32E-07 | 58.0 |
| 18203 | 18602 | H1.102 | L1 | VH-VL | 2.15E-07 | 56.0 |
| 18204 | 18603 | H1.103 | L1 | VH-VL | 2.89E-07 | |
| 18205 | 18604 | H1.104 | L1 | VH-VL | 1.98E-07 | 56.0 |
| 18206 | 18605 | H1.105 | L1 | VH-VL | 2.57E-07 | 53.5 |
| 18207 | 18606 | H1.106 | L1 | VH-VL | 1.85E-07 | 54.5 |
| 18208 | 18607 | H1.107 | L1 | VH-VL | 2.33E-07 | 55.5 |
| 18209 | 18608 | H1.108 | L1 | VH-VL | 2.07E-07 | 55.0 |
| 18210 | 18609 | H1.109 | L1 | VH-VL | 2.38E-07 | 54.5 |
| 18211 | 18610 | H1.110 | L1 | VH-VL | 1.78E-07 | 56.0 |
| 18212 | 18611 | H1.111 | L1 | VH-VL | 1.56E-07 | 55.5 |
| 18213 | 18612 | H1.112 | L1 | VH-VL | 1.60E-07 | 55.0 |
| 18214 | 18613 | H1.113 | L1 | VH-VL | 1.65E-07 | 55.0 |
| 18215 | 18614 | H1.114 | L1 | VH-VL | 2.79E-07 | 55.0 |
| 18216 | 18615 | H1.115 | L1 | VH-VL | 1.93E-07 | 55.0 |
| 18217 | 18616 | H1.116 | L1 | VH-VL | 1.80E-07 | 54.0 |
| 18218 | 18617 | H1.117 | L1 | VH-VL | 1.80E-07 | 56.0 |
| 18219 | 18618 | H1.118 | L1 | VH-VL | 2.51E-07 | 55.0 |
| 18220 | 18619 | H1.119 | L1 | VH-VL | 1.57E-07 | 55.5 |
| 18221 | 18620 | H1.120 | L1 | VH-VL | 1.64E-07 | 54.0 |
| 18222 | 18621 | H1.121 | L1 | VH-VL | 1.53E-07 | 53.5 |
| 18223 | 18622 | H1.122 | L1 | VH-VL | 1.67E-07 | 54.5 |
| 18224 | 18623 | H1.123 | L1 | VH-VL | 1.71E-07 | 52.5 |
| 18225 | 18624 | H1.124 | L1 | VH-VL | 1.51E-07 | 53.0 |
| 18226 | 18625 | H1.125 | L1 | VH-VL | 1.88E-07 | 53.0 |
| 18227 | 18626 | H1.126 | L1 | VH-VL | 1.45E-07 | 53.5 |
| 18228 | 18627 | H1.127 | L1 | VH-VL | 1.60E-07 | 52.5 |
| 18229 | 18628 | H1.128 | L1 | VH-VL | 1.51E-07 | 55.0 |
| 18230 | 18629 | H1.129 | L1 | VH-VL | 1.81E-07 | |
| 18231 | 18630 | H1.130 | L1 | VH-VL | 1.41E-07 | 56.0 |
| 18232 | 18631 | H1.131 | L1 | VH-VL | 1.34E-07 | 55.5 |

Figure 23D

| Full-length mAb XENP | scFv XENP | VH | VL | scFv orientation | Human PD-1 mAb $K_D$ (M) | scFv $T_m$ (°C) |
|---|---|---|---|---|---|---|
| 18233 | 18632 | H1.132 | L1 | VH-VL | 1.92E-07 | |
| 18234 | 18633 | H1.133 | L1 | VH-VL | 1.97E-07 | 55.5 |
| 18235 | 18634 | H1.134 | L1 | VH-VL | 2.20E-07 | |
| 18236 | 18635 | H1.135 | L1 | VH-VL | 1.53E-07 | 54.5 |
| 18237 | 18636 | H1.136 | L1 | VH-VL | 2.00E-07 | |
| 18238 | 18637 | H1.137 | L1 | VH-VL | 1.16E-07 | 57.0 |
| 18239 | 18638 | H1.138 | L1 | VH-VL | 1.42E-07 | 55.5 |
| 18240 | 18639 | H1.139 | L1 | VH-VL | 1.62E-07 | 56.5 |
| 18241 | 18640 | H1.140 | L1 | VH-VL | 1.18E-07 | 57.0 |
| 18242 | 18641 | H1.141 | L1 | VH-VL | 1.53E-07 | 55.5 |
| 18243 | 18642 | H1.142 | L1 | VH-VL | 1.70E-07 | 56.5 |
| 18244 | 18643 | H1.143 | L1 | VH-VL | 1.34E-07 | |
| 18245 | 18644 | H1.144 | L1 | VH-VL | 1.50E-07 | 55.0 |
| 18246 | 18645 | H1.145 | L1 | VH-VL | 1.42E-07 | 57.0 |
| 18247 | 18646 | H1.146 | L1 | VH-VL | 1.44E-07 | 54.0 |
| 18248 | 18647 | H1.147 | L1 | VH-VL | 1.28E-07 | 55.0 |
| 18249 | 18648 | H1.148 | L1 | VH-VL | 1.32E-07 | 56.0 |
| 18250 | 18649 | H1.149 | L1 | VH-VL | 1.27E-07 | 54.5 |
| 18251 | 18650 | H1.150 | L1 | VH-VL | 1.23E-07 | 55.5 |
| 18252 | 18651 | H1.151 | L1 | VH-VL | 1.12E-07 | 57.0 |
| 18253 | 18652 | H1.152 | L1 | VH-VL | 8.58E-08 | 56.5 |
| 18254 | 18653 | H1.153 | L1 | VH-VL | 1.66E-07 | 55.5 |
| 18255 | 18654 | H1.154 | L1 | VH-VL | 1.37E-07 | 56.5 |
| 18256 | 18655 | H1.155 | L1 | VH-VL | 9.70E-08 | 56.5 |
| 18257 | 18656 | H1.156 | L1 | VH-VL | 2.80E-07 | |
| 18258 | 18657 | H1.157 | L1 | VH-VL | 1.51E-07 | 57.0 |
| 18259 | 18658 | H1.158 | L1 | VH-VL | 1.32E-07 | 56.5 |
| 18260 | 18659 | H1.159 | L1 | VH-VL | 1.39E-07 | 56.0 |
| 18261 | 18660 | H1.160 | L1 | VH-VL | 1.28E-07 | 57.0 |
| 18262 | 18661 | H1.161 | L1 | VH-VL | 1.53E-07 | 56.5 |
| 18263 | 18662 | H1.162 | L1 | VH-VL | 2.78E-07 | |
| 18264 | 18663 | H1.163 | L1 | VH-VL | 1.07E-07 | 55.5 |
| 18265 | 18664 | H1.164 | L1 | VH-VL | 2.16E-07 | |
| 18266 | 18665 | H1.165 | L1 | VH-VL | Weak | |
| 18267 | 18666 | H1.166 | L1 | VH-VL | 2.43E-07 | |
| 18268 | 18667 | H1.167 | L1 | VH-VL | Weak | |
| 18269 | 18668 | H1.168 | L1 | VH-VL | Weak | |
| 18270 | 18669 | H1.169 | L1 | VH-VL | 7.90E-06 | |
| 18271 | 18670 | H1.170 | L1 | VH-VL | Weak | |
| 18272 | 18671 | H1.171 | L1 | VH-VL | Weak | |
| 18273 | 18672 | H1.172 | L1 | VH-VL | Weak | |
| 18274 | 18673 | H1.173 | L1 | VH-VL | Weak | |
| 18275 | 18674 | H1.174 | L1 | VH-VL | Weak | |
| 18276 | 18675 | H1.175 | L1 | VH-VL | Weak | |

Figure 23E

| Full-length mAb XENP | scFv XENP | VH | VL | scFv orientation | Human PD-1 mAb $K_D$ (M) | scFv $T_m$ (°C) |
|---|---|---|---|---|---|---|
| 18277 | 18676 | H1.176 | L1 | VH-VL | 1.32E-07 | 56.0 |
| 18278 | 18677 | H1.177 | L1 | VH-VL | Weak | |
| 18279 | 18678 | H1.178 | L1 | VH-VL | Weak | |
| 18280 | 18679 | H1.179 | L1 | VH-VL | 3.40E-07 | |
| 18281 | 18680 | H1.180 | L1 | VH-VL | Weak | |
| 18282 | 18681 | H1.181 | L1 | VH-VL | Weak | |
| 18283 | 18682 | H1.182 | L1 | VH-VL | Weak | |
| 18284 | 18683 | H1.183 | L1 | VH-VL | Weak | |
| 18285 | 18684 | H1.184 | L1 | VH-VL | Weak | |
| 18286 | 18685 | H1.185 | L1 | VH-VL | Weak | |
| 18287 | 18686 | H1.186 | L1 | VH-VL | Weak | |
| 18288 | 18687 | H1.187 | L1 | VH-VL | Weak | |
| 18289 | 18688 | H1.188 | L1 | VH-VL | 1.61E-07 | 56.5 |
| 18290 | 18689 | H1.189 | L1 | VH-VL | Weak | |
| 18291 | 18690 | H1.190 | L1 | VH-VL | Weak | |
| 18292 | 18691 | H1.191 | L1 | VH-VL | Weak | |
| 18293 | 18692 | H1.192 | L1 | VH-VL | Weak | |
| 18294 | 18693 | H1.193 | L1 | VH-VL | Weak | |
| 18295 | 18694 | H1.194 | L1 | VH-VL | Weak | |
| 18296 | 18695 | H1.195 | L1 | VH-VL | 5.81E-07 | |
| 18301 | 18696 | H1.196 | L1 | VH-VL | Weak | |
| 18302 | 18701 | H1.197 | L1 | VH-VL | 6.15E-07 | |
| 18303 | 18702 | H1.198 | L1 | VH-VL | Weak | |
| 18304 | 18703 | H1.199 | L1 | VH-VL | Weak | |
| 18305 | 18704 | H1.200 | L1 | VH-VL | 1.77E-07 | |
| 18306 | 18705 | H1.201 | L1 | VH-VL | Weak | |
| 18307 | 18706 | H1.202 | L1 | VH-VL | Weak | |
| 18308 | 18707 | H1.203 | L1 | VH-VL | 3.95E-07 | |
| 18309 | 18708 | H1.204 | L1 | VH-VL | Weak | |
| 18310 | 18709 | H1.205 | L1 | VH-VL | Weak | |
| 18311 | 18710 | H1.206 | L1 | VH-VL | Weak | |
| 18312 | 18711 | H1.207 | L1 | VH-VL | Weak | |
| 18313 | 18712 | H1.208 | L1 | VH-VL | Weak | |
| 18314 | 18713 | H1.209 | L1 | VH-VL | Weak | |
| 18315 | 18714 | H1.210 | L1 | VH-VL | Weak | |
| 18316 | 18715 | H1.211 | L1 | VH-VL | 1.40E-07 | 58.5 |
| 18317 | 18716 | H1.212 | L1 | VH-VL | 1.24E-07 | |
| 18318 | 18717 | H1.213 | L1 | VH-VL | Weak | |
| 18319 | 18718 | H1.214 | L1 | VH-VL | Weak | |
| 18320 | 18719 | H1.215 | L1 | VH-VL | Weak | |
| 18321 | 18720 | H1.216 | L1 | VH-VL | Weak | |
| 18322 | 18721 | H1.217 | L1 | VH-VL | Weak | |
| 18323 | 18722 | H1.218 | L1 | VH-VL | Weak | |
| 18324 | 18723 | H1.219 | L1 | VH-VL | Weak | |

Figure 23F

| Full-length mAb XENP | scFv XENP | VH | VL | scFv orientation | Human PD-1 mAb $K_D$ (M) | scFv $T_m$ (°C) |
|---|---|---|---|---|---|---|
| 18325 | 18724 | H1.220 | L1 | VH-VL | Weak | |
| 18326 | 18725 | H1.221 | L1 | VH-VL | Weak | |
| 18327 | 18726 | H1.222 | L1 | VH-VL | Weak | |
| 18328 | 18727 | H1.223 | L1 | VH-VL | Weak | |
| 18329 | 18728 | H1.224 | L1 | VH-VL | Weak | |
| 18330 | 18729 | H1.225 | L1 | VH-VL | Weak | |
| 18331 | 18730 | H1.226 | L1 | VH-VL | Weak | |
| 18332 | 18731 | H1.227 | L1 | VH-VL | Weak | |
| 18333 | 18732 | H1.228 | L1 | VH-VL | Weak | |
| 18334 | 18733 | H1.229 | L1 | VH-VL | Weak | |
| 18335 | 18734 | H1.230 | L1 | VH-VL | Weak | |
| 18336 | 18735 | H1.231 | L1 | VH-VL | Weak | |
| 18337 | 18736 | H1.232 | L1 | VH-VL | Weak | |
| 18338 | 18737 | H1.233 | L1 | VH-VL | Weak | |
| 18339 | 18738 | H1.234 | L1 | VH-VL | Weak | |
| 18340 | 18739 | H1.235 | L1 | VH-VL | Weak | |
| 18341 | 18740 | H1.236 | L1 | VH-VL | Weak | |
| 18342 | 18741 | H1.237 | L1 | VH-VL | 1.95E-07 | |
| 18343 | 18742 | H1.238 | L1 | VH-VL | 1.16E-07 | 57.0 |
| 18344 | 18743 | H1 | L1.1 | VH-VL | 1.11E-07 | 56.5 |
| 18345 | 18744 | H1 | L1.2 | VH-VL | 1.20E-07 | 54.5 |
| 18346 | 18745 | H1 | L1.3 | VH-VL | 1.07E-07 | 55.0 |
| 18347 | 18746 | H1 | L1.4 | VH-VL | 8.73E-08 | 57.0 |
| 18348 | 18747 | H1 | L1.5 | VH-VL | 1.02E-07 | 56.5 |
| 18349 | 18748 | H1 | L1.6 | VH-VL | 1.12E-07 | 57.0 |
| 18350 | 18749 | H1 | L1.7 | VH-VL | 1.40E-07 | 55.5 |
| 18351 | 18750 | H1 | L1.8 | VH-VL | 1.40E-07 | 56.0 |
| 18352 | 18751 | H1 | L1.9 | VH-VL | 1.24E-07 | 57.0 |
| 18353 | 18752 | H1 | L1.10 | VH-VL | 1.44E-07 | 54.5 |
| 18354 | 18753 | H1 | L1.11 | VH-VL | 1.46E-07 | 56.0 |
| 18355 | 18754 | H1 | L1.12 | VH-VL | 1.39E-07 | 58.0 |
| 18356 | 18755 | H1 | L1.13 | VH-VL | 1.46E-07 | |
| 18357 | 18756 | H1 | L1.14 | VH-VL | 9.95E-08 | 57.5 |
| 18358 | 18757 | H1 | L1.15 | VH-VL | 1.21E-07 | 56.5 |
| 18359 | 18758 | H1 | L1.16 | VH-VL | 2.86E-07 | |
| 18360 | 18759 | H1 | L1.17 | VH-VL | 1.13E-07 | 54.5 |
| 18361 | 18760 | H1 | L1.18 | VH-VL | 2.71E-07 | |
| 18362 | 18761 | H1 | L1.19 | VH-VL | 2.84E-07 | |
| 18363 | 18762 | H1 | L1.20 | VH-VL | 1.75E-07 | |
| 18364 | 18763 | H1 | L1.21 | VH-VL | 1.22E-07 | 58.0 |
| 18365 | 18764 | H1 | L1.22 | VH-VL | 3.33E-07 | |
| 18366 | 18765 | H1 | L1.23 | VH-VL | 8.20E-08 | 59.0 |
| 18367 | 18766 | H1 | L1.24 | VH-VL | 4.46E-07 | |
| 18368 | 18767 | H1 | L1.25 | VH-VL | 4.09E-07 | |

Figure 23G

| Full-length mAb XENP | scFv XENP | VH | VL | scFv orientation | Human PD-1 mAb $K_D$ (M) | scFv $T_m$ (°C) |
|---|---|---|---|---|---|---|
| 18369 | 18768 | H1 | L1.26 | VH-VL | Weak | |
| 18370 | 18769 | H1 | L1.27 | VH-VL | 3.73E-07 | |
| 18371 | 18770 | H1 | L1.28 | VH-VL | 1.22E-07 | |
| 18372 | 18771 | H1 | L1.29 | VH-VL | Weak | |
| 18373 | 18772 | H1 | L1.30 | VH-VL | Weak | |
| 18374 | 18773 | H1 | L1.31 | VH-VL | Weak | |
| 18375 | 18774 | H1 | L1.32 | VH-VL | 7.36E-07 | |
| 18376 | 18775 | H1 | L1.33 | VH-VL | Weak | |
| 18377 | 18776 | H1 | L1.34 | VH-VL | 1.45E-06 | |
| 18378 | 18777 | H1 | L1.35 | VH-VL | 4.28E-07 | |
| 18379 | 18778 | H1 | L1.36 | VH-VL | Weak | |
| 18380 | 18779 | H1 | L1.37 | VH-VL | Weak | |
| 18381 | 18780 | H1 | L1.38 | VH-VL | Weak | |
| 18382 | 18781 | H1 | L1.39 | VH-VL | 5.45E-07 | |
| 18383 | 18782 | H1 | L1.40 | VH-VL | Weak | |
| 18384 | 18783 | H1 | L1.41 | VH-VL | Weak | |
| 18385 | 18784 | H1 | L1.42 | VH-VL | Weak | |
| 18386 | 18785 | H1 | L1.43 | VH-VL | Weak | |
| 18387 | 18786 | H1 | L1.44 | VH-VL | Weak | |
| 18388 | 18787 | H1 | L1.45 | VH-VL | Weak | |
| 18389 | 18788 | H1 | L1.46 | VH-VL | 2.19E-07 | |
| 18390 | 18789 | H1 | L1.47 | VH-VL | 1.06E-07 | 55.0 |
| 18391 | 18790 | H1 | L1.48 | VH-VL | 1.35E-07 | |
| 18392 | 18791 | H1 | L1.49 | VH-VL | 1.49E-07 | |
| 18393 | 18792 | H1 | L1.50 | VH-VL | 1.17E-07 | 57.0 |
| 18394 | 18793 | H1 | L1.51 | VH-VL | 1.09E-07 | 55.5 |
| 18395 | 18794 | H1 | L1.52 | VH-VL | 9.28E-08 | 54.0 |
| 18396 | 18795 | H1 | L1.53 | VH-VL | 1.46E-07 | |
| 18401 | 18796 | H1 | L1.54 | VH-VL | 4.49E-07 | |
| 18402 | 18801 | H1 | L1.55 | VH-VL | Weak | |
| 18403 | 18802 | H1 | L1.56 | VH-VL | Weak | |
| 18404 | 18803 | H1 | L1.57 | VH-VL | Weak | |
| 18405 | 18804 | H1 | L1.58 | VH-VL | Weak | |
| 18406 | 18805 | H1 | L1.59 | VH-VL | Weak | |
| 18407 | 18806 | H1 | L1.60 | VH-VL | Weak | |
| 18408 | 18807 | H1 | L1.61 | VH-VL | Weak | |
| 18409 | 18808 | H1 | L1.62 | VH-VL | Weak | |
| 18410 | 18809 | H1 | L1.63 | VH-VL | Weak | |
| 18411 | 18810 | H1 | L1.64 | VH-VL | 1.79E-07 | |
| 18412 | 18811 | H1 | L1.65 | VH-VL | 2.91E-07 | |
| 18413 | 18812 | H1 | L1.66 | VH-VL | 3.29E-07 | |
| 18414 | 18813 | H1 | L1.67 | VH-VL | 1.46E-07 | 54.0 |
| 18415 | 18814 | H1 | L1.68 | VH-VL | 1.60E-07 | |
| 18416 | 18815 | H1 | L1.69 | VH-VL | Weak | |

Figure 23H

| Full-length mAb XENP | scFv XENP | VH | VL | scFv orientation | Human PD-1 mAb $K_D$ (M) | scFv $T_m$ (°C) |
|---|---|---|---|---|---|---|
| 18417 | 18816 | H1 | L1.70 | VH-VL | 1.34E-07 | |
| 18418 | 18817 | H1 | L1.71 | VH-VL | 3.71E-07 | |
| 18419 | 18818 | H1 | L1.72 | VH-VL | 6.40E-07 | |
| 18420 | 18819 | H1 | L1.73 | VH-VL | 1.52E-07 | |
| 18421 | 18820 | H1 | L1.74 | VH-VL | 1.75E-07 | |
| 18422 | 18821 | H1 | L1.75 | VH-VL | 1.78E-07 | |
| 18423 | 18822 | H1 | L1.76 | VH-VL | 1.33E-07 | 56.5 |
| 18424 | 18823 | H1 | L1.77 | VH-VL | 3.78E-07 | |
| 18425 | 18824 | H1 | L1.78 | VH-VL | Weak | |
| 18426 | 18825 | H1 | L1.79 | VH-VL | Weak | |
| 18427 | 18826 | H1 | L1.80 | VH-VL | Weak | |
| 18428 | 18827 | H1 | L1.81 | VH-VL | 2.54E-07 | |
| 18429 | 18828 | H1 | L1.82 | VH-VL | 7.67E-08 | |
| 18430 | 18829 | H1 | L1.83 | VH-VL | 1.07E-05 | |
| 18431 | 18830 | H1 | L1.84 | VH-VL | 5.39E-07 | |
| 18432 | 18831 | H1 | L1.85 | VH-VL | 1.56E-07 | |
| 18433 | 18832 | H1 | L1.86 | VH-VL | 1.24E-07 | 55.5 |
| 18434 | 18833 | H1 | L1.87 | VH-VL | 2.51E-07 | |
| 18435 | 18834 | H1 | L1.88 | VH-VL | 1.40E-07 | 56.0 |
| 18436 | 18835 | H1 | L1.89 | VH-VL | 6.50E-07 | |
| 18437 | 18836 | H1 | L1.90 | VH-VL | 1.22E-06 | |
| 18438 | 18837 | H1 | L1.91 | VH-VL | 1.79E-07 | |
| 18439 | 18838 | H1 | L1.92 | VH-VL | 4.04E-07 | |
| 18440 | 18839 | H1 | L1.93 | VH-VL | 7.76E-07 | |
| 18441 | 18840 | H1 | L1.94 | VH-VL | 8.48E-08 | 53.0 |
| 18442 | 18841 | H1 | L1.95 | VH-VL | 1.23E-07 | 54.5 |
| 18443 | 18842 | H1 | L1.96 | VH-VL | 1.30E-07 | 55.5 |
| 18444 | 18843 | H1 | L1.97 | VH-VL | 1.06E-07 | 56.5 |
| 18445 | 18844 | H1 | L1.98 | VH-VL | 1.84E-07 | |
| 18446 | 18845 | H1 | L1.99 | VH-VL | 1.48E-06 | |
| 18447 | 18846 | H1 | L1.100 | VH-VL | 9.17E-08 | 55.5 |
| 18448 | 18847 | H1 | L1.101 | VH-VL | 1.35E-07 | |
| 18449 | 18848 | H1 | L1.102 | VH-VL | 1.06E-07 | 55.0 |
| 18450 | 18849 | H1 | L1.103 | VH-VL | 9.46E-08 | 60.0 |
| 18451 | 18850 | H1 | L1.104 | VH-VL | 1.08E-07 | 57.0 |
| 18452 | 18851 | H1 | L1.105 | VH-VL | 1.02E-07 | 55.0 |
| 18453 | 18852 | H1 | L1.106 | VH-VL | 1.01E-07 | 57.5 |
| 18454 | 18853 | H1 | L1.107 | VH-VL | Weak | |
| 18455 | 18854 | H1 | L1.108 | VH-VL | Weak | |
| 18456 | 18855 | H1 | L1.109 | VH-VL | Weak | |
| 18457 | 18856 | H1 | L1.110 | VH-VL | Weak | |
| 18458 | 18857 | H1 | L1.111 | VH-VL | Weak | |
| 18459 | 18858 | H1 | L1.112 | VH-VL | 1.92E-07 | |
| 18460 | 18859 | H1 | L1.113 | VH-VL | Weak | |

Figure 23I

| Full-length mAb XENP | scFv XENP | VH | VL | scFv orientation | Human PD-1 mAb $K_D$ (M) | scFv $T_m$ (°C) |
|---|---|---|---|---|---|---|
| 18461 | 18860 | H1 | L1.114 | VH-VL | 2.87E-07 | |
| 18462 | 18861 | H1 | L1.115 | VH-VL | Weak | |
| 18463 | 18862 | H1 | L1.116 | VH-VL | 5.60E-08 | 55.5 |
| 18464 | 18863 | H1 | L1.117 | VH-VL | 1.58E-07 | 58.0 |
| 18465 | 18864 | H1 | L1.118 | VH-VL | 7.90E-08 | 51.00, 58.00 |
| 18466 | 18865 | H1 | L1.119 | VH-VL | 4.88E-08 | 54.0 |
| 18467 | 18866 | H1 | L1.120 | VH-VL | 7.74E-08 | 50.50, 57.00 |
| 18468 | 18867 | H1 | L1.121 | VH-VL | 1.08E-07 | 54.5 |
| 18469 | 18868 | H1 | L1.122 | VH-VL | 9.36E-08 | 51.0 |
| 18470 | 18869 | H1 | L1.123 | VH-VL | 1.32E-07 | 49.00, 59.00 |
| 18471 | 18870 | H1 | L1.124 | VH-VL | 8.70E-08 | 53.5 |
| 18472 | 18871 | H1 | L1.125 | VH-VL | 1.06E-07 | 53.0 |
| 18473 | 18872 | H1 | L1.126 | VH-VL | 7.34E-08 | 51.0 |
| 18474 | 18873 | H1 | L1.127 | VH-VL | 1.10E-07 | 55.5 |
| 18475 | 18874 | H1 | L1.128 | VH-VL | 1.07E-07 | 57.0 |
| 18476 | 18875 | H1 | L1.129 | VH-VL | 1.00E-07 | 57.0 |
| 18477 | 18876 | H1 | L1.130 | VH-VL | 1.18E-07 | 54.5 |
| 18478 | 18877 | H1 | L1.131 | VH-VL | 1.96E-07 | 55.5 |
| 18479 | 18878 | H1 | L1.132 | VH-VL | 1.51E-07 | 55.0 |
| 18480 | 18879 | H1 | L1.133 | VH-VL | 1.32E-07 | 54.0 |
| 18481 | 18880 | H1 | L1.134 | VH-VL | 1.97E-07 | 57.0 |
| 18482 | 18881 | H1 | L1.135 | VH-VL | 1.56E-07 | 54.5 |
| 18483 | 18882 | H1 | L1.136 | VH-VL | 2.41E-07 | 56.5 |
| 18484 | 18883 | H1 | L1.137 | VH-VL | 1.87E-07 | 56.0 |
| 18485 | 18884 | H1 | L1.138 | VH-VL | 2.05E-07 | 56.0 |
| 18486 | 18885 | H1 | L1.139 | VH-VL | 1.76E-07 | 54.0 |
| 18487 | 18886 | H1 | L1.140 | VH-VL | 2.52E-07 | |
| 18488 | 18887 | H1 | L1.141 | VH-VL | 2.05E-07 | 57.0 |
| 18489 | 18888 | H1 | L1.142 | VH-VL | 1.09E-07 | 54.0 |
| 18490 | 18889 | H1 | L1.143 | VH-VL | 2.36E-07 | |
| 18491 | 18890 | H1 | L1.144 | VH-VL | 1.83E-07 | 57.0 |
| 18492 | 18891 | H1 | L1.145 | VH-VL | 1.63E-07 | 54.0 |
| 18892 | 18895 | H0 | L0 | VH-VL | 1.24E-07 | 62.0 |
| N/A | 18896 (rvs scFv) | H1 | L1 | VL-VH | | 58.5 |
| N/A | 18921 | H1 | L3 | VH-VL | | 55.0 |
| N/A | 18922 | H1 | L4 | VH-VL | | 57.0 |
| N/A | 18923 | H1 | L5 | VH-VL | | 60.0 |
| N/A | 18924 | H2 | L1 | VH-VL | | |
| N/A | 18925 | H2 | L2 | VH-VL | | |
| N/A | 18926 | H2 | L3 | VH-VL | | |
| N/A | 18927 | H2 | L4 | VH-VL | | |
| N/A | 18928 | H2 | L5 | VH-VL | | |
| N/A | 18929 | H3 | L1 | VH-VL | | |
| N/A | 18930 | H3 | L2 | VH-VL | | |

Figure 23J

| Full-length mAb XENP | scFv XENP | VH | VL | scFv orientation | Human PD-1 mAb K$_D$ (M) | scFv T$_m$ (°C) |
|---|---|---|---|---|---|---|
| N/A | 18931 | H3 | L3 | VH-VL | | |
| N/A | 18932 | H3 | L4 | VH-VL | | |
| N/A | 18933 | H3 | L5 | VH-VL | | |
| N/A | 18934 | H4 | L1 | VH-VL | | |
| N/A | 18935 | H4 | L2 | VH-VL | | |
| N/A | 18936 | H4 | L3 | VH-VL | | |
| N/A | 18937 | H4 | L4 | VH-VL | | |
| N/A | 18938 | H4 | L5 | VH-VL | | |
| 18910 | N/A | H1.90 | L1.119 | VH-VL | 1.254E-08 | |
| 18911 | N/A | H1.90 | L1.23 | VH-VL | 2.278E-08 | |
| 18912 | N/A | H1.90 | L1.67 | VH-VL | 3.224E-08 | |
| 18913 | N/A | H1.90 | L1.94 | VH-VL | 2.27E-08 | |
| 18914 | N/A | H1.90 | L1.116 | VH-VL | 1.634E-08 | |
| 18915 | N/A | H1.155 | L1.119 | VH-VL | 1.971E-08 | |
| 18980 | 19064 | H1.239 | L1 | VH-VL | | 56.5 |
| 18981 | 19065 | H1.240 | L1 | VH-VL | | 56.5 |
| 18982 | 19066 | H1.241 | L1 | VH-VL | | 57.0 |
| 18983 | 19067 | H1.242 | L1 | VH-VL | | 56.5 |
| 18984 | 19068 | H1.243 | L1 | VH-VL | | 55.0 |
| 18985 | 19069 | H1.244 | L1 | VH-VL | | 55.5 |
| 18986 | 19070 | H1.245 | L1 | VH-VL | | 56.0 |
| 18987 | 19071 | H1.246 | L1 | VH-VL | | 54.0 |
| 18988 | 19072 | H1.247 | L1 | VH-VL | | 56.5 |
| 18989 | 19073 | H1.248 | L1 | VH-VL | | 55.0 |
| 18990 | 19074 | H1.249 | L1 | VH-VL | | 54.0 |
| 18991 | 19075 | H1.250 | L1 | VH-VL | | 56.0 |
| 18992 | 19076 | H1.251 | L1 | VH-VL | 6.054E-08 | 57.0 |
| 18993 | 19077 | H1.252 | L1 | VH-VL | | 56.5 |
| 18994 | 19078 | H1.253 | L1 | VH-VL | | 55.0 |
| 18995 | 19079 | H1.254 | L1 | VH-VL | | 56.5 |
| 18996 | 19080 | H1.255 | L1 | VH-VL | | |
| 19001 | 19081 | H1.256 | L1 | VH-VL | | 56.0 |
| 19002 | 19082 | H1.257 | L1 | VH-VL | 5.607E-08 | 58.0 |
| 19003 | 19083 | H1.258 | L1 | VH-VL | | 56.0 |
| 19004 | 19084 | H1.259 | L1 | VH-VL | | |
| 19005 | 19085 | H1.260 | L1 | VH-VL | | |
| 19006 | 19086 | H1.261 | L1 | VH-VL | 7.064E-08 | 57.0 |
| 19007 | 19087 | H1.262 | L1 | VH-VL | 6.263E-08 | 57.0 |
| 19008 | 19088 | H1.263 | L1 | VH-VL | | 50.0 |
| 19009 | 19089 | H1.264 | L1 | VH-VL | | 52.0 |
| 19010 | 19090 | H1.265 | L1 | VH-VL | | 56.0 |
| 19011 | 19091 | H1.266 | L1 | VH-VL | | 55.0 |
| 19012 | 19092 | H1.267 | L1 | VH-VL | | |
| 19013 | 19093 | H1.268 | L1 | VH-VL | | 56.5 |

Figure 23K

| Full-length mAb XENP | scFv XENP | VH | VL | scFv orientation | Human PD-1 mAb K$_D$ (M) | scFv T$_m$ (°C) |
|---|---|---|---|---|---|---|
| 19014 | 19094 | H1.269 | L1 | VH-VL | | 54.5 |
| 19015 | 19095 | H1.270 | L1 | VH-VL | | 52.0 |
| 19016 | 19096 | H1.271 | L1 | VH-VL | 2.267E-08 | 55.5 |
| 19017 | 19101 | H1.272 | L1 | VH-VL | | 55.5 |
| 19018 | 19102 | H1.273 | L1 | VH-VL | | 52.0 |
| 19019 | 19103 | H1.274 | L1 | VH-VL | | 56.5 |
| 19020 | 19104 | H1.275 | L1 | VH-VL | | 50.0 |
| 19021 | 19105 | H1.276 | L1 | VH-VL | | |
| 19022 | 19106 | H1.277 | L1 | VH-VL | | 58.0 |
| 19023 | 19107 | H1 | L1.146 | VH-VL | 6.46E-08 | 57.0 |
| 19024 | 19108 | H1 | L1.147 | VH-VL | | 54.5 |
| 19025 | 19109 | H1 | L1.148 | VH-VL | 6.665E-08 | 58.0 |
| 19026 | 19110 | H1 | L1.149 | VH-VL | | 55.5 |
| 19027 | 19111 | H1 | L1.150 | VH-VL | 7.238E-08 | 57.5 |
| 19028 | 19112 | H1 | L1.151 | VH-VL | | |
| 19029 | 19113 | H1 | L1.152 | VH-VL | | 56.0 |
| 19030 | 19114 | H1 | L1.153 | VH-VL | | 55.0 |
| 19031 | 19115 | H1 | L1.154 | VH-VL | | 54.5 |
| 19032 | 19116 | H1 | L1.155 | VH-VL | | 55.5 |
| 19033 | 19117 | H1 | L1.156 | VH-VL | | 56.5 |
| 19034 | 19118 | H1 | L1.157 | VH-VL | | 56.0 |
| 19035 | 19119 | H1 | L1.158 | VH-VL | 9.671E-08 | 58.0 |
| 19036 | 19120 | H1 | L1.159 | VH-VL | | 52.0 |
| 19037 | 19121 | H1 | L1.160 | VH-VL | | |
| 19038 | 19122 | H1 | L1.161 | VH-VL | | 47.5 |
| 19039 | 19123 | H1 | L1.162 | VH-VL | | |
| 19040 | 19124 | H1 | L1.163 | VH-VL | | 55.5 |
| 19041 | 19125 | H1 | L1.164 | VH-VL | | 56.0 |
| 19042 | 19126 | H1 | L1.165 | VH-VL | | 58.5 |
| 19043 | 19127 | H1 | L1.166 | VH-VL | | 49.0 |
| 19044 | 19128 | H1 | L1.167 | VH-VL | | 53.0 |
| 19045 | 19129 | H1 | L1.168 | VH-VL | | 54.0 |
| 19046 | 19130 | H1 | L1.169 | VH-VL | | 67.0 |
| 19047 | 19131 | H1 | L1.170 | VH-VL | | 65.5 |
| 19048 | 19132 | H1 | L1.171 | VH-VL | | 51.5 |
| 19049 | 19133 | H1 | L1.172 | VH-VL | | 53.0 |
| 19050 | 19134 | H1 | L1.173 | VH-VL | | 54.5 |
| 19051 | 19135 | H1 | L1.174 | VH-VL | | 53.5 |
| 19052 | 19136 | H1 | L1.175 | VH-VL | | 54.0 |
| 19053 | 19137 | H1 | L1.176 | VH-VL | | 54.0 |
| 19054 | 19138 | H1 | L1.177 | VH-VL | | 56.0 |
| 19055 | 19139 | H1 | L1.178 | VH-VL | | 52.5 |
| 19056 | 19140 | H1 | L1.179 | VH-VL | | |
| 19057 | 19141 | H1 | L1.180 | VH-VL | | |

Figure 23L

| Full-length mAb XENP | scFv XENP | VH | VL | scFv orientation | Human PD-1 mAb K_D (M) | scFv T_m (°C) |
|---|---|---|---|---|---|---|
| 19058 | 19142 | H1 | L1.181 | VH-VL | | |
| 19059 | 19143 | H1 | L1.182 | VH-VL | | 52.0 |
| 19060 | 19144 | H1 | L1.183 | VH-VL | | 53.5 |
| 19061 | 19145 | H1 | L1.184 | VH-VL | | |
| 19062 | 19146 | H1 | L1.185 | VH-VL | | 55.5 |
| 19063 | 19147 | H1 | L1.186 | VH-VL | | 54.0 |
| N/A | 19148 | H1.257 | L1.152 | VH-VL | | 57.5 |
| N/A | 19149 | H1.257 | L1.151 | VH-VL | | 55.5 |
| N/A | 19150 | H1.139 | L1.134 | VH-VL | | 57.5 |
| N/A | 19151 | H1.48 | L1.187 | VH-VL | | 53.5 |
| N/A | 19152 | H1.48 | L1.151 | VH-VL | | 52.5 |
| N/A | 19153 | H1.43 | L1.159 | VH-VL | | 50.0 |
| N/A | 19154 | H1.90 | L1.119 | VH-VL | | 53.0 |
| N/A | 19155 | H1.90 | L1.23 | VH-VL | | 57.5 |
| N/A | 19156 | H1.90 | L1.67 | VH-VL | | 53.0 |
| N/A | 19157 | H1.90 | L1.94 | VH-VL | | 52.0 |
| N/A | 19158 | H1.90 | L1.116 | VH-VL | | 54.5 |
| N/A | 19159 | H1.155 | L1.119 | VH-VL | | 54.5 |
| 19160 | N/A | H1.269 | L1.116 | VH-VL | | |
| 19161 | N/A | H1.271 | L1.116 | VH-VL | 1.233E-08 | |
| 19162 | N/A | H1.272 | L1.116 | VH-VL | | |
| 19163 | N/A | H1.90 | L1.177 | VH-VL | | |
| 19164 | N/A | H1.269 | L1.177 | VH-VL | | |
| 19165 | N/A | H1.271 | L1.177 | VH-VL | 4.682E-09 | |
| 19166 | N/A | H1.272 | L1.177 | VH-VL | 6.386E-09 | |
| 19167 | N/A | H1.90 | L1.175 | VH-VL | | |
| 19168 | N/A | H1.269 | L1.175 | VH-VL | | |
| 19169 | N/A | H1.271 | L1.175 | VH-VL | | |
| 19170 | N/A | H1.272 | L1.175 | VH-VL | | |
| 19172 | 19182 | H1 | L1.190 | VH-VL | 2.577E-08 | 58.5 |
| 19173 | 19183 | H1 | L1.191 | VH-VL | | 57.0 |
| 19174 | N/A | H1.90 | L1.190 | VH-VL | 1.103E-08 | |
| 19175 | N/A | H1.90 | L1.191 | VH-VL | | |
| 19176 | N/A | H1.269 | L1.190 | VH-VL | | |
| 19177 | N/A | H1.271 | L1.190 | VH-VL | 8.287E-09 | |
| 19178 | N/A | H1.272 | L1.190 | VH-VL | 7.09E-09 | |
| 19179 | N/A | H1.269 | L1.191 | VH-VL | | |
| 19180 | N/A | H1.271 | L1.191 | VH-VL | | |
| 19181 | N/A | H1.272 | L1.191 | VH-VL | | |
| 19193 | 19203 | H1 | L1.188 | VH-VL | 2.596E-08 | |
| 19194 | 19204 | H1 | L1.189 | VH-VL | 1.366E-08 | 64.0 |
| 19195 | 19205 | H1.278 | L1.188 | VH-VL | 6.689E-09 | 66.0 |
| 19196 | 19206 | H1.278 | L1.189 | VH-VL | 4.683E-09 | 67.5 |
| 19201 | 19202 | H1.278 | L1 | VH-VL | 1.861E-08 | 60.0 |

Figure 23M

| Full-length mAb XENP | scFv XENP | VH | VL | scFv orientation | Human PD-1 mAb K$_D$ (M) | scFv T$_m$ (°C) |
|---|---|---|---|---|---|---|
| N/A | 19207 | H1.278 | L1.188 | VH-VL | | 68.0 |
| N/A | 19208 | H1.278 | L1.189 | VH-VL | | 69.5 |
| 19589 | 19618 | H1.279 | L1.189 | VH-VL | 1.254E-08 | 68.5 |
| 19590 | 19619 | H1.280 | L1.189 | VH-VL | 5.393E-09 | 69.0 |
| 19591 | 19620 | H1.281 | L1.189 | VH-VL | | 68.0 |
| 19592 | 19621 | H1.282 | L1.189 | VH-VL | 1.291E-08 | 68.5 |
| 19593 | 19622 | H1.283 | L1.189 | VH-VL | 7.859E-09 | 69.0 |
| 19594 | 19623 | H1.284 | L1.189 | VH-VL | | 70.5 |
| 19595 | 19624 | H1.285 | L1.189 | VH-VL | | 70.0 |
| 19596 | 19625 | H1.286 | L1.189 | VH-VL | 1.41E-08 | 69.5 |
| 19601 | 19626 | H1.278 | L1.192 | VH-VL | 6.268E-09 | 67.5 |
| 19602 | 19627 | H1.278 | L1.193 | VH-VL | 1.37E-08 | 69.5 |
| 19603 | 19628 | H1.278 | L1.194 | VH-VL | 7.5E-09 | 69.0 |
| 19604 | 19629 | H1.278 | L1.195 | VH-VL | | 69.5 |
| 19605 | 19630 | H1.278 | L1.196 | VH-VL | 4.443E-08 | 71.0 |
| 19606 | 19631 | H1.278 | L1.197 | VH-VL | 2.079E-08 | 69.5 |
| 19607 | 19632 | H1.278 | L1.198 | VH-VL | | 67.5 |
| 19608 | 19633 | H1.278 | L1.199 | VH-VL | | 67.5 |
| 19609 | 19634 | H1.278 | L1.200 | VH-VL | | 67.5 |
| 19610 | 19635 | H1.278 | L1.201 | VH-VL | | 67.5 |
| 19611 | 19636 | H1.278 | L1.202 | VH-VL | | 67.5 |
| 19612 | 19637 | H1.278 | L1.203 | VH-VL | | 67.5 |
| 19613 | 19638 | H1.278 | L1.204 | VH-VL | | 67.0 |
| 19614 | 19639 | H1.278 | L1.205 | VH-VL | 1.266E-08 | 68.0 |
| 19615 | 19640 | H1.278 | L1.206 | VH-VL | | 69.0 |
| 19616 | 19641 | H1.278 | L1.207 | VH-VL | | 68.5 |
| 19617 | 19642 | H1.278 | L1.208 | VH-VL | | 68.5 |
| N/A | 19643 | H1.279 | L1.189 | VL-VH | | 71.5 |
| N/A | 19644 | H1.280 | L1.189 | VL-VH | | 70.5 |
| N/A | 19645 | H1.281 | L1.189 | VL-VH | | 69.5 |
| N/A | 19646 | H1.282 | L1.189 | VL-VH | | 70.0 |
| N/A | 19647 | H1.283 | L1.189 | VL-VH | | 70.5 |
| N/A | 19648 | H1.284 | L1.189 | VL-VH | | 70.5 |
| N/A | 19649 | H1.285 | L1.189 | VL-VH | | 71.5 |
| N/A | 19650 | H1.278 | L1.192 | VL-VH | | 69.0 |
| N/A | 19651 | H1.278 | L1.193 | VL-VH | | 71.5 |
| N/A | 19652 | H1.278 | L1.194 | VL-VH | | 71.5 |
| N/A | 19653 | H1.278 | L1.195 | VL-VH | | 71.5 |
| N/A | 19654 | H1.278 | L1.196 | VL-VH | | 64.0 |
| N/A | 19655 | H1.278 | L1.197 | VL-VH | | 72.0 |
| N/A | 19664 | H1.287 | L1.209 | VH-VL | | 70.5 |
| N/A | 19665 | H1.287 | L1.209 | VL-VH | | 72.0 |
| N/A | 19666 | H1.284 | L1.194 | VH-VL | | 70.5 |
| N/A | 19667 | H1.284 | L1.194 | VL-VH | | 72.5 |

Figure 23N

| Full-length mAb XENP | scFv XENP | VH | VL | scFv orientation | Human PD-1 mAb $K_D$ (M) | scFv $T_m$ (°C) |
|---|---|---|---|---|---|---|
| N/A | 19668 | H1.288 | L1.210 | VH-VL | | 72.5 |
| N/A | 19669 | H1.288 | L1.210 | VL-VH | | 72.0 |
| 19678 | N/A | H1.279 | L1.192 | VH-VL | | |
| 19679 | N/A | H1.280 | L1.192 | VH-VL | | |
| 19680 | N/A | H1.281 | L1.192 | VH-VL | | |
| 19681 | N/A | H1.282 | L1.192 | VH-VL | | |
| 19682 | N/A | H1.279 | L1.193 | VH-VL | | |
| 19683 | N/A | H1.280 | L1.193 | VH-VL | | |
| 19684 | N/A | H1.281 | L1.193 | VH-VL | | |
| 19685 | N/A | H1.282 | L1.193 | VH-VL | | |
| 19686 | 19690 | H1.279 | L1.194 | VH-VL | 7.268E-09 | 70.0 |
| 19687 | N/A | H1.280 | L1.194 | VH-VL | | |
| 19688 | N/A | H1.281 | L1.194 | VH-VL | | |
| 19689 | 19691 | H1.282 | L1.194 | VH-VL | 1.212E-08 | 70.5 |
| N/A | 19692 | H1.279 | L1.194 | VL-VH | | 71.5 |
| N/A | 19693 | H1.282 | L1.194 | VL-VH | | 71.5 |
| N/A | 21215 | H1.280 | L1.224 | VH-VL | | 65.0 |
| N/A | 21216 | H1.280 | L1.224 | VL-VH | | 66.5 |

Figure 24A

| Fab XENP | scFv XENP | VH | VL | Human CTLA-4 Fab K$_D$ (M) | Cyno CTLA-4 Fab K$_D$ (M) | Fab T$_m$ (°C) | scFv T$_m$ (°C) | VH 9-mers | Δ VH 9-mers | VL 9-mers | Δ VL 9-mers |
|---|---|---|---|---|---|---|---|---|---|---|---|
| 9950 | 19533 | H0 | L0 | 5.61E-09 | 3.29E-08 | 75.8 | 63.9 | 65 | 0 | 82 | 0 |
| 19211 | 19745 | H0.1 | L0 | 6.33E-09 | n.t. | 75.5 | 64 | 65 | 0 | 82 | 0 |
| 19212 | 19746 | H0.2 | L0 | 5.60E-09 | n.t. | 74.8 | 63 | 61 | -4 | 82 | 0 |
| 19213 | 19747 | H0.3 | L0 | 6.39E-09 | n.t. | 75 | 63.5 | 65 | 0 | 82 | 0 |
| 19214 | 19748 | H0.4 | L0 | 6.49E-09 | n.t. | 71.5 | 58 | 56 | -9 | 82 | 0 |
| 19215 | 19749 | H0.5 | L0 | 1.09E-08 | n.t. | 74.5 | n.t. | 52 | -13 | 82 | 0 |
| 19216 | 19750 | H0.6 | L0 | 6.60E-09 | n.t. | 76 | 63.5 | 56 | -9 | 82 | 0 |
| 19217 | 19751 | H0.7 | L0 | 1.55E-08 | n.t. | 75.5 | n.t. | 56 | -9 | 82 | 0 |
| 19218 | 19752 | H0.8 | L0 | 6.94E-09 | n.t. | 78 | 66 | 65 | 0 | 82 | 0 |
| 19219 | 19753 | H0.9 | L0 | 6.20E-09 | n.t. | 75.5 | 65.5 | 56 | -9 | 82 | 0 |
| 19220 | 19754 | H0.10 | L0 | 3.25E-08 | n.t. | n.t. | n.t. | 59 | -6 | 82 | 0 |
| 19221 | 19755 | H0.11 | L0 | 4.12E-08 | n.t. | n.t. | n.t. | 64 | -1 | 82 | 0 |
| 19222 | 19756 | H0.12 | L0 | 1.08E-08 | n.t. | 76 | 64.5 | 63 | -2 | 82 | 0 |
| 19223 | 19757 | H0.13 | L0 | 7.05E-08 | n.t. | n.t. | n.t. | 65 | 0 | 82 | 0 |
| 19224 | 19758 | H0.14 | L0 | 4.24E-08 | n.t. | n.t. | n.t. | 64 | -1 | 82 | 0 |
| 19225 | 19759 | H0.15 | L0 | 5.00E-07 | n.t. | n.t. | n.t. | 64 | -1 | 82 | 0 |
| 19226 | 19760 | H0.16 | L0 | 1.29E-08 | n.t. | 76.5 | 65 | 63 | -2 | 82 | 0 |
| 19227 | 19761 | H0.17 | L0 | 6.59E-08 | n.t. | n.t. | n.t. | 63 | -2 | 82 | 0 |
| 19228 | 19762 | H0.18 | L0 | 5.00E-07 | n.t. | n.t. | n.t. | 64 | -1 | 82 | 0 |
| 19229 | 19763 | H0.19 | L0 | 7.02E-09 | n.t. | 74 | 61.5 | 64 | -1 | 82 | 0 |
| 19230 | 19764 | H0.20 | L0 | 1.19E-08 | n.t. | 75.5 | n.t. | 64 | -1 | 82 | 0 |
| 19231 | 19765 | H0.21 | L0 | 5.00E-07 | n.t. | n.t. | n.t. | 64 | -1 | 82 | 0 |
| 19232 | 19766 | H0.22 | L0 | 4.09E-08 | n.t. | n.t. | n.t. | 64 | -1 | 82 | 0 |
| 19233 | 19767 | H0.23 | L0 | 5.00E-07 | n.t. | n.t. | n.t. | 64 | -1 | 82 | 0 |
| 19234 | 19768 | H0.24 | L0 | 1.13E-07 | n.t. | n.t. | n.t. | 64 | -1 | 82 | 0 |
| 19235 | 19769 | H0.25 | L0 | 5.97E-08 | n.t. | n.t. | n.t. | 74 | 9 | 82 | 0 |
| 19236 | 19770 | H0.26 | L0 | 5.70E-08 | n.t. | n.t. | n.t. | 74 | 9 | 82 | 0 |
| 19237 | 19771 | H0.27 | L0 | 6.54E-08 | n.t. | n.t. | n.t. | 68 | 3 | 82 | 0 |
| 19238 | 19772 | H0.28 | L0 | 4.33E-08 | n.t. | n.t. | n.t. | 65 | 0 | 82 | 0 |
| 19239 | 19773 | H0.29 | L0 | 5.00E-07 | n.t. | n.t. | n.t. | 68 | 3 | 82 | 0 |
| 19240 | 19774 | H0.30 | L0 | 5.00E-07 | n.t. | n.t. | n.t. | 65 | 0 | 82 | 0 |
| 19241 | 19775 | H0.31 | L0 | 5.00E-07 | n.t. | n.t. | n.t. | 63 | -2 | 82 | 0 |
| 19242 | 19776 | H0.32 | L0 | 2.87E-08 | n.t. | n.t. | n.t. | 65 | 0 | 82 | 0 |
| 19243 | 19777 | H0.33 | L0 | 5.00E-07 | n.t. | n.t. | n.t. | 65 | 0 | 82 | 0 |
| 19244 | 19778 | H0.34 | L0 | 5.00E-07 | n.t. | n.t. | n.t. | 63 | -2 | 82 | 0 |
| 19245 | 19779 | H0.35 | L0 | 2.31E-08 | n.t. | n.t. | n.t. | 63 | -2 | 82 | 0 |
| 19246 | 19780 | H0.36 | L0 | 4.92E-09 | n.t. | 74 | 62.5 | 61 | -4 | 82 | 0 |
| 19247 | 19781 | H0.37 | L0 | 5.53E-08 | n.t. | n.t. | n.t. | 60 | -5 | 82 | 0 |
| 19248 | 19782 | H0.38 | L0 | 3.63E-08 | n.t. | n.t. | n.t. | 66 | 1 | 82 | 0 |
| 19249 | 19783 | H0.39 | L0 | 2.64E-08 | n.t. | n.t. | n.t. | 68 | 3 | 82 | 0 |
| 19250 | 19784 | H0.40 | L0 | 2.80E-09 | n.t. | 61.5 | 66.5 | 66 | 1 | 82 | 0 |
| 19251 | 19785 | H0.41 | L0 | 1.55E-08 | n.t. | 63 | n.t. | 65 | 0 | 82 | 0 |
| 19252 | 19786 | H0.42 | L0 | 4.66E-08 | n.t. | n.t. | n.t. | 65 | 0 | 82 | 0 |
| 19253 | 19787 | H0.43 | L0 | 4.42E-08 | n.t. | n.t. | n.t. | 65 | 0 | 82 | 0 |
| 19254 | 19788 | H0.44 | L0 | 5.00E-07 | n.t. | n.t. | n.t. | 65 | 0 | 82 | 0 |
| 19255 | 19789 | H0.45 | L0 | 1.40E-08 | n.t. | 71 | n.t. | 65 | 0 | 82 | 0 |
| 19256 | 19790 | H0.46 | L0 | 5.00E-07 | n.t. | n.t. | n.t. | 65 | 0 | 82 | 0 |
| 19257 | 19791 | H0.47 | L0 | 5.00E-07 | n.t. | n.t. | n.t. | 65 | 0 | 82 | 0 |
| 19258 | 19792 | H0.48 | L0 | 5.01E-08 | n.t. | n.t. | n.t. | 65 | 0 | 82 | 0 |

Figure 24B

| Fab XENP | scFv XENP | VH | VL | Human CTLA-4 Fab K$_D$ (M) | Cyno CTLA-4 Fab K$_D$ (M) | Fab T$_m$ (°C) | scFv T$_m$ (°C) | VH 9-mers | Δ VH 9-mers | VL 9-mers | Δ VL 9-mers |
|---|---|---|---|---|---|---|---|---|---|---|---|
| 19259 | 19793 | H0.49 | L0 | 5.00E-07 | n.t. | n.t. | n.t. | 65 | 0 | 82 | 0 |
| 19260 | 19794 | H0.50 | L0 | 1.41E-09 | n.t. | n.t. | 66.5 | 65 | 0 | 82 | 0 |
| 19261 | 19795 | H0.51 | L0 | 8.43E-09 | n.t. | n.t. | 57.5 | 65 | 0 | 82 | 0 |
| 19262 | 19796 | H0.52 | L0 | 1.13E-08 | 3.69E-08 | 74.5 | n.t. | 65 | 0 | 82 | 0 |
| 19263 | 19801 | H0.53 | L0 | 1.27E-08 | n.t. | n.t. | n.t. | 65 | 0 | 82 | 0 |
| 19264 | 19802 | H0.54 | L0 | 5.00E-07 | n.t. | n.t. | n.t. | 65 | 0 | 82 | 0 |
| 19265 | 19803 | H0.55 | L0 | 3.43E-08 | n.t. | n.t. | n.t. | 65 | 0 | 82 | 0 |
| 19266 | 19804 | H0.56 | L0 | 5.95E-08 | n.t. | n.t. | n.t. | 65 | 0 | 82 | 0 |
| 19267 | 19805 | H0.57 | L0 | 9.15E-09 | n.t. | 62.5 | 62 | 65 | 0 | 82 | 0 |
| 19268 | 19806 | H0.58 | L0 | 3.93E-09 | n.t. | 58.5 | 59 | 65 | 0 | 82 | 0 |
| 19269 | 19807 | H0.59 | L0 | 1.91E-09 | n.t. | 73 | 60 | 65 | 0 | 82 | 0 |
| 19270 | 19808 | H0.60 | L0 | 7.46E-09 | n.t. | 63.5 | 59.5 | 65 | 0 | 82 | 0 |
| 19271 | 19809 | H0.61 | L0 | n.t. | n.t. | n.t. | n.t. | 65 | 0 | 82 | 0 |
| 19272 | 19810 | H0.62 | L0 | 5.48E-08 | n.t. | n.t. | n.t. | 56 | -9 | 82 | 0 |
| 19273 | 19811 | H0.63 | L0 | 3.66E-09 | n.t. | 58 | 59 | 65 | 0 | 82 | 0 |
| 19274 | 19812 | H0.64 | L0 | 2.04E-08 | n.t. | n.t. | n.t. | 65 | 0 | 82 | 0 |
| 19275 | 19813 | H0.65 | L0 | 5.00E-07 | n.t. | n.t. | n.t. | 56 | -9 | 82 | 0 |
| 19276 | 19814 | H0.66 | L0 | 2.08E-08 | n.t. | 59.5 | n.t. | 65 | 0 | 82 | 0 |
| 19277 | 19815 | H0.67 | L0 | 1.10E-08 | n.t. | 58.5 | n.t. | 65 | 0 | 82 | 0 |
| 19278 | 19816 | H0.68 | L0 | 7.32E-09 | n.t. | 62 | 63.5 | 65 | 0 | 82 | 0 |
| 19279 | 19817 | H0.69 | L0 | 1.79E-08 | n.t. | 58 | n.t. | 65 | 0 | 82 | 0 |
| 19280 | 19818 | H0.70 | L0 | 1.42E-08 | n.t. | 56.5 | n.t. | 71 | 6 | 82 | 0 |
| 19281 | 19819 | H0.71 | L0 | 3.00E-08 | n.t. | n.t. | n.t. | 64 | -1 | 82 | 0 |
| 19282 | 19820 | H0.72 | L0 | 5.00E-07 | n.t. | n.t. | n.t. | 64 | -1 | 82 | 0 |
| 19283 | 19821 | H0.73 | L0 | 2.07E-09 | n.t. | 76 | 64.5 | 64 | -1 | 82 | 0 |
| 19284 | 19822 | H0.74 | L0 | 1.24E-08 | n.t. | 59 | n.t. | 64 | -1 | 82 | 0 |
| 19285 | 19823 | H0.75 | L0 | 3.55E-09 | n.t. | 76 | 65 | 64 | -1 | 82 | 0 |
| 19286 | 19824 | H0.76 | L0 | 1.08E-08 | n.t. | 76.5 | 65 | 64 | -1 | 82 | 0 |
| 19287 | 19825 | H0.77 | L0 | 3.42E-08 | n.t. | n.t. | n.t. | 64 | -1 | 82 | 0 |
| 19288 | 19826 | H0.78 | L0 | 2.10E-08 | n.t. | 75.5 | n.t. | 64 | -1 | 82 | 0 |
| 19289 | 19827 | H0.79 | L0 | 3.79E-08 | n.t. | n.t. | n.t. | 62 | -3 | 82 | 0 |
| 19290 | 19828 | H0.80 | L0 | 1.24E-08 | n.t. | 75.5 | n.t. | 62 | -3 | 82 | 0 |
| 19291 | 19829 | H0.81 | L0 | 5.65E-09 | n.t. | 74.5 | 63 | 59 | -6 | 82 | 0 |
| 19292 | 19830 | H0.82 | L0 | 5.13E-09 | n.t. | 73.5 | 62.5 | 56 | -9 | 82 | 0 |
| 19293 | 19831 | H0.83 | L0 | 5.33E-09 | n.t. | 72.5 | 61.5 | 56 | -9 | 82 | 0 |
| 19294 | 19832 | H0.84 | L0 | 7.94E-09 | n.t. | 67.5 | n.t. | 56 | -9 | 82 | 0 |
| 19295 | 19833 | H0.85 | L0 | 2.10E-09 | n.t. | 70 | 55.5 | 56 | -9 | 82 | 0 |
| 19296 | 19834 | H0.86 | L0 | 6.78E-09 | n.t. | 75.8 | 65 | 56 | -9 | 82 | 0 |
| 19301 | 19835 | H0.87 | L0 | 5.15E-08 | n.t. | n.t. | n.t. | 56 | -9 | 82 | 0 |
| 19302 | 19836 | H0.88 | L0 | 9.63E-09 | n.t. | 73.5 | n.t. | 58 | -7 | 82 | 0 |
| 19303 | 19837 | H0.89 | L0 | 2.12E-08 | n.t. | n.t. | n.t. | 65 | 0 | 82 | 0 |
| 19304 | 19838 | H0.90 | L0 | 7.82E-09 | n.t. | 75.5 | 55.5 | 65 | 0 | 82 | 0 |
| 19305 | 19839 | H0.91 | L0 | 6.11E-09 | n.t. | 75.5 | 65 | 61 | -4 | 82 | 0 |
| 19306 | 19840 | H0.92 | L0 | 5.72E-09 | n.t. | 73.5 | 61 | 65 | 0 | 82 | 0 |
| 19307 | 19841 | H0.93 | L0 | 5.13E-09 | n.t. | 74.5 | 63.5 | 56 | -9 | 82 | 0 |
| 19308 | 19842 | H0.94 | L0 | 5.90E-09 | n.t. | 75.5 | 64 | 56 | -9 | 82 | 0 |
| 19309 | 19843 | H0.95 | L0 | 1.02E-08 | n.t. | 76 | 64 | 56 | -9 | 82 | 0 |
| 19310 | 19844 | H0.96 | L0 | 1.53E-08 | n.t. | 77 | 65.5 | 57 | -8 | 82 | 0 |
| 19311 | 19845 | H0.97 | L0 | 6.30E-09 | 3.17E-08 | 76 | 64 | 65 | 0 | 82 | 0 |

Figure 24C

| Fab XENP | scFv XENP | VH | VL | Human CTLA-4 Fab $K_D$ (M) | Cyno CTLA-4 Fab $K_D$ (M) | Fab $T_m$ (°C) | scFv $T_m$ (°C) | VH 9-mers | Δ VH 9-mers | VL 9-mers | Δ VL 9-mers |
|---|---|---|---|---|---|---|---|---|---|---|---|
| 19312 | 19846 | H0.98 | L0 | 7.36E-09 | 3.38E-08 | 74.5 | 61.5 | 70 | 5 | 82 | 0 |
| 19313 | 19847 | H0.99 | L0 | 7.01E-09 | 3.53E-08 | 76 | 63.5 | 71 | 6 | 82 | 0 |
| 19314 | 19848 | H0.100 | L0 | 1.10E-08 | 3.14E-08 | 75.5 | n.t. | 65 | 0 | 82 | 0 |
| 19315 | 19849 | H0.101 | L0 | 2.90E-08 | 5.00E-07 | 72 | n.t. | 65 | 0 | 82 | 0 |
| 19316 | 19850 | H0.102 | L0 | 3.48E-08 | 5.00E-07 | 79 | n.t. | 65 | 0 | 82 | 0 |
| 19317 | 19851 | H0.103 | L0 | 1.02E-08 | 3.68E-08 | 77.5 | 65.5 | 65 | 0 | 82 | 0 |
| 19318 | 19852 | H0.104 | L0 | 5.00E-07 | 5.00E-07 | 72.5 | n.t. | 65 | 0 | 82 | 0 |
| 19319 | 19853 | H0.105 | L0 | 5.00E-07 | 5.00E-07 | 78.5 | n.t. | 65 | 0 | 82 | 0 |
| 19320 | 19854 | H0.106 | L0 | 2.37E-08 | 5.00E-07 | 74 | n.t. | 65 | 0 | 82 | 0 |
| 19321 | 19855 | H0.107 | L0 | 5.00E-07 | 5.00E-07 | 70 | n.t. | 65 | 0 | 82 | 0 |
| 19322 | 19856 | H0.108 | L0 | 1.67E-08 | 2.17E-08 | 76.5 | 64.5 | 65 | 0 | 82 | 0 |
| 19323 | 19857 | H0.109 | L0 | 1.51E-08 | 4.39E-08 | 77 | 65 | 65 | 0 | 82 | 0 |
| 19324 | 19858 | H0.110 | L0 | 5.00E-07 | 5.00E-07 | 76.5 | n.t. | 65 | 0 | 82 | 0 |
| 19325 | 19859 | H0.111 | L0 | 6.52E-09 | 3.30E-08 | 76 | 64 | 65 | 0 | 82 | 0 |
| 19326 | 19860 | H0.112 | L0 | 5.00E-07 | 5.00E-07 | 77 | n.t. | 65 | 0 | 82 | 0 |
| 19327 | 19861 | H0.113 | L0 | 1.12E-08 | 3.64E-08 | 76.5 | 65 | 65 | .0 | 82 | 0 |
| 19328 | 19862 | H0.114 | L0 | 3.64E-09 | 2.28E-08 | 76.5 | 64.5 | 65 | 0 | 82 | 0 |
| 19329 | 19863 | H0.115 | L0 | 1.19E-08 | 4.10E-08 | 76 | n.t. | 65 | 0 | 82 | 0 |
| 19330 | 19864 | H0.116 | L0 | 3.45E-08 | 5.00E-07 | 76 | n.t. | 65 | 0 | 82 | 0 |
| 19331 | 19865 | H0.117 | L0 | 5.00E-07 | 5.00E-07 | 76.5 | n.t. | 65 | 0 | 82 | 0 |
| 19332 | 19866 | H0.118 | L0 | 1.65E-08 | 5.00E-07 | 76 | n.t. | 65 | 0 | 82 | 0 |
| 19333 | 19867 | H0.119 | L0 | 5.00E-07 | 5.00E-07 | 73.5 | n.t. | 65 | 0 | 82 | 0 |
| 19334 | 19868 | H0.120 | L0 | 5.00E-07 | 5.00E-07 | 73.5 | n.t. | 65 | 0 | 82 | 0 |
| 19335 | 19869 | H0.121 | L0 | 5.00E-07 | 5.00E-07 | 74 | n.t. | 65 | 0 | 82 | 0 |
| 19336 | 19870 | H0.122 | L0 | 2.20E-08 | 5.00E-07 | 75.5 | n.t. | 64 | -1 | 82 | 0 |
| 19337 | 19871 | H0.123 | L0 | 2.25E-08 | 5.00E-07 | 75.5 | n.t. | 64 | -1 | 82 | 0 |
| 19338 | 19872 | H0.124 | L0 | 5.00E-07 | 5.00E-07 | 71 | n.t. | 63 | -2 | 82 | 0 |
| 19339 | 19873 | H0.125 | L0 | 3.08E-08 | 5.00E-07 | 75 | n.t. | 63 | -2 | 82 | 0 |
| 19340 | 19874 | H0.126 | L0 | 5.00E-07 | 5.00E-07 | 70.5 | n.t. | 63 | -2 | 82 | 0 |
| 19341 | 19875 | H0.127 | L0 | 3.20E-08 | 5.00E-07 | 70.5 | n.t. | 63 | -2 | 82 | 0 |
| 19342 | 19876 | H0.128 | L0 | 1.84E-08 | 5.00E-07 | 71 | n.t. | 63 | -2 | 82 | 0 |
| 19343 | 19877 | H0.129 | L0 | 5.00E-07 | 5.00E-07 | 72 | n.t. | 63 | -2 | 82 | 0 |
| 19344 | 19878 | H0.130 | L0 | 6.51E-09 | 3.93E-08 | 76 | 64 | 63 | -2 | 82 | 0 |
| 19345 | 19879 | H0.131 | L0 | 5.82E-09 | 3.40E-08 | 78 | 66.5 | 62 | -3 | 82 | 0 |
| 19346 | 19880 | H0.132 | L0 | 6.46E-09 | 3.82E-08 | 74.5 | 62.5 | 65 | 0 | 82 | 0 |
| 19347 | 19881 | H0.133 | L0 | 2.03E-08 | 4.95E-08 | 77.5 | n.t. | 62 | -3 | 82 | 0 |
| 19348 | 19882 | H0.134 | L0 | 1.58E-07 | 5.00E-07 | low signal | 64.5 | 62 | -3 | 82 | 0 |
| 19349 | 19883 | H0.135 | L0 | 6.69E-09 | 4.03E-08 | 76.5 | 64.5 | 62 | -3 | 82 | 0 |
| 19350 | 19884 | H0.136 | L0 | 7.41E-09 | 4.21E-08 | 75.5 | 63 | 62 | -3 | 82 | 0 |
| 19416 | 19885 | H0 | L0.1 | 1.14E-08 | 4.63E-08 | n.t. | n.t. | 65 | 0 | 81 | -1 |
| 19417 | 19886 | H0 | L0.2 | 6.94E-09 | 3.77E-08 | 75.5 | 62 | 65 | 0 | 81 | -1 |
| 19418 | 19887 | H0 | L0.3 | 9.31E-09 | 4.19E-08 | 75.5 | low signal | 65 | 0 | 81 | -1 |
| 19419 | 19888 | H0 | L0.4 | 1.95E-07 | 5.00E-07 | n.t. | n.t. | 65 | 0 | 81 | -1 |
| 19420 | 19889 | H0 | L0.5 | 8.28E-09 | 3.95E-08 | 76 | low signal | 65 | 0 | 79 | -3 |
| 19421 | 19890 | H0 | L0.6 | 5.00E-07 | 5.16E-08 | n.t. | n.t. | 65 | 0 | 71 | -11 |
| 19422 | 19891 | H0 | L0.7 | 1.36E-08 | 7.79E-08 | n.t. | n.t. | 65 | 0 | 78 | -4 |
| 19423 | 19892 | H0 | L0.8 | 1.07E-08 | 5.50E-08 | n.t. | n.t. | 65 | 0 | 82 | 0 |
| 19424 | 19893 | H0 | L0.9 | 8.18E-09 | 4.70E-08 | 76.5 | 64.5 | 65 | 0 | 78 | -4 |
| 19425 | 19894 | H0 | L0.10 | 8.97E-09 | 4.60E-08 | 76.5 | 64.5 | 65 | 0 | 73 | -9 |

Figure 24D

| Fab XENP | scFv XENP | VH | VL | Human CTLA-4 Fab $K_D$ (M) | Cyno CTLA-4 Fab $K_D$ (M) | Fab $T_m$ (°C) | scFv $T_m$ (°C) | VH 9-mers | Δ VH 9-mers | VL 9-mers | Δ VL 9-mers |
|---|---|---|---|---|---|---|---|---|---|---|---|
| 19426 | 19895 | H0 | L0.11 | 5.00E-07 | 5.00E-07 | n.t. | n.t. | 65 | 0 | 73 | -9 |
| 19427 | 19896 | H0 | L0.12 | 7.59E-09 | 4.14E-08 | 77 | 63.5 | 65 | 0 | 77 | -5 |
| 19428 | 19901 | H0 | L0.13 | 9.71E-09 | 5.19E-08 | 75.5 | 63 | 65 | 0 | 73 | -9 |
| 19429 | 19902 | H0 | L0.14 | 8.04E-09 | 4.90E-08 | 76 | 63.5 | 65 | 0 | 73 | -9 |
| 19430 | 19903 | H0 | L0.15 | 9.79E-09 | 5.37E-08 | 73.5 | 61 | 65 | 0 | 82 | 0 |
| 19431 | 19904 | H0 | L0.16 | 1.43E-08 | 5.23E-08 | n.t. | n.t. | 65 | 0 | 73 | -9 |
| 19432 | 19905 | H0 | L0.17 | 2.17E-08 | 4.96E-08 | n.t. | n.t. | 65 | 0 | 73 | -9 |
| 19433 | 19906 | H0 | L0.18 | 8.28E-09 | 4.59E-08 | 75.5 | 62.5 | 65 | 0 | 77 | -5 |
| 19434 | 19907 | H0 | L0.19 | 2.86E-09 | 1.64E-08 | 72 | 57.5 | 65 | 0 | 81 | -1 |
| 19435 | 19908 | H0 | L0.20 | 5.00E-07 | 9.64E-07 | n.t. | n.t. | 65 | 0 | 81 | -1 |
| 19436 | 19909 | H0 | L0.21 | 1.79E-08 | 5.00E-07 | n.t. | n.t. | 65 | 0 | 82 | 0 |
| 19437 | 19910 | H0 | L0.22 | 1.46E-08 | 5.28E-08 | n.t. | 64.5 | 65 | 0 | 91 | 9 |
| 19438 | 19911 | H0 | L0.23 | 2.02E-08 | 5.47E-08 | n.t. | n.t. | 65 | 0 | 82 | 0 |
| 19439 | 19912 | H0 | L0.24 | 1.26E-08 | 5.36E-08 | n.t. | n.t. | 65 | 0 | 81 | -1 |
| 19440 | 19913 | H0 | L0.25 | 4.60E-09 | 2.85E-08 | 76 | 64 | 65 | 0 | 81 | -1 |
| 19441 | 19914 | H0 | L0.26 | 9.55E-09 | 4.17E-08 | 76 | 64 | 65 | 0 | 81 | -1 |
| 19442 | 19915 | H0 | L0.27 | 1.20E-08 | 5.58E-08 | n.t. | n.t. | 65 | 0 | 81 | -1 |
| 19443 | 19916 | H0 | L0.28 | 5.00E-07 | 5.00E-07 | n.t. | n.t. | 65 | 0 | 81 | -1 |
| 19444 | 19917 | H0 | L0.29 | 2.09E-08 | 5.16E-08 | n.t. | n.t. | 65 | 0 | 80 | -2 |
| 19445 | 19918 | H0 | L0.30 | 1.10E-08 | 5.42E-08 | n.t. | n.t. | 65 | 0 | 80 | -2 |
| 19446 | 19919 | H0 | L0.31 | 8.90E-09 | 4.62E-08 | 76.5 | 65 | 65 | 0 | 81 | -1 |
| 19447 | 19920 | H0 | L0.32 | 8.69E-09 | 5.14E-08 | 76 | 64.5 | 65 | 0 | 80 | -2 |
| 19448 | 19921 | H0 | L0.33 | 1.37E-07 | 5.00E-07 | n.t. | n.t. | 65 | 0 | 80 | -2 |
| 19449 | 19922 | H0 | L0.34 | 4.27E-08 | 5.00E-07 | n.t. | n.t. | 65 | 0 | 81 | -1 |
| 19450 | 19923 | H0 | L0.35 | 5.00E-07 | 5.00E-07 | n.t. | n.t. | 65 | 0 | 79 | -3 |
| 19451 | 19924 | H0 | L0.36 | 1.60E-08 | 5.00E-07 | n.t. | 63.5 | 65 | 0 | 79 | -3 |
| 19452 | 19925 | H0 | L0.37 | 7.60E-09 | 3.37E-08 | 75 | 63 | 65 | 0 | 79 | -3 |
| 19453 | 19926 | H0 | L0.38 | 5.73E-08 | 5.00E-07 | n.t. | n.t. | 65 | 0 | 81 | -1 |
| 19454 | 19927 | H0 | L0.39 | 2.39E-08 | 5.00E-07 | n.t. | n.t. | 65 | 0 | 79 | -3 |
| 19455 | 19928 | H0 | L0.40 | 1.15E-08 | 3.66E-08 | 73.5 | 60.5 | 65 | 0 | 79 | -3 |
| 19456 | 19929 | H0 | L0.41 | 7.20E-09 | 3.96E-08 | 76 | 64 | 65 | 0 | 78 | -4 |
| 19457 | 19930 | H0 | L0.42 | 5.00E-07 | 5.00E-07 | n.t. | n.t. | 65 | 0 | 77 | -5 |
| 19458 | 19931 | H0 | L0.43 | 5.00E-07 | 5.00E-07 | n.t. | n.t. | 65 | 0 | 68 | -14 |
| 19459 | 19932 | H0 | L0.44 | 3.85E-08 | 5.00E-07 | n.t. | 60 | 65 | 0 | 82 | 0 |
| 19460 | 19933 | H0 | L0.45 | 7.16E-08 | 5.00E-07 | n.t. | n.t. | 65 | 0 | 82 | 0 |
| 19461 | 19934 | H0 | L0.46 | 9.56E-09 | 5.16E-08 | 72 | low signal | 65 | 0 | 74 | -8 |
| 19462 | 19935 | H0 | L0.47 | 1.91E-08 | 4.75E-08 | n.t. | n.t. | 65 | 0 | 75 | -7 |
| 19463 | 19936 | H0 | L0.48 | 9.34E-09 | 4.70E-08 | 75 | 61.5 | 65 | 0 | 74 | -8 |
| 19464 | 19937 | H0 | L0.49 | 1.10E-08 | 4.42E-08 | n.t. | n.t. | 65 | 0 | 68 | -14 |
| 19465 | 19938 | H0 | L0.50 | 9.39E-09 | 4.63E-08 | 71.5 | 58 | 65 | 0 | 73 | -9 |
| 19466 | 19939 | H0 | L0.51 | 7.20E-09 | 4.05E-08 | 75 | 62.5 | 65 | 0 | 75 | -7 |
| 19467 | 19940 | H0 | L0.52 | 7.50E-09 | 3.91E-08 | 75 | 62.5 | 65 | 0 | 74 | -8 |
| 19468 | 19941 | H0 | L0.53 | 1.87E-07 | 5.00E-07 | n.t. | n.t. | 65 | 0 | 74 | -8 |
| 19469 | 19942 | H0 | L0.54 | 2.15E-08 | 4.66E-08 | n.t. | n.t. | 65 | 0 | 76 | -6 |
| 19470 | 19943 | H0 | L0.55 | 5.00E-07 | 5.00E-07 | n.t. | n.t. | 65 | 0 | 73 | -9 |
| 19471 | 19944 | H0 | L0.56 | 5.75E-09 | 3.57E-08 | 76 | 64 | 65 | 0 | 73 | -9 |
| 19472 | 19945 | H0 | L0.57 | 7.61E-09 | 3.87E-08 | 73 | 60 | 65 | 0 | 75 | -7 |
| 19473 | 19946 | H0 | L0.58 | 7.85E-09 | 4.46E-08 | n.t. | n.t. | 65 | 0 | 66 | -16 |
| 19474 | 19947 | H0 | L0.59 | 7.36E-09 | 4.29E-08 | 75.5 | 63.5 | 65 | 0 | 75 | -7 |

Figure 24E

| Fab XENP | scFv XENP | VH | VL | Human CTLA-4 Fab K$_D$ (M) | Cyno CTLA-4 Fab K$_D$ (M) | Fab T$_m$ (°C) | scFv T$_m$ (°C) | VH 9-mers | Δ VH 9-mers | VL 9-mers | Δ VL 9-mers |
|---|---|---|---|---|---|---|---|---|---|---|---|
| 19475 | 19948 | H0 | L0.60 | 6.52E-08 | 5.00E-07 | n.t. | n.t. | 65 | 0 | 76 | -6 |
| 19476 | 19949 | H0 | L0.61 | 5.00E-07 | 5.00E-07 | n.t. | n.t. | 65 | 0 | 73 | -9 |
| 19477 | 19950 | H0 | L0.62 | 2.36E-08 | 5.40E-08 | n.t. | n.t. | 65 | 0 | 79 | -3 |
| 19478 | 19951 | H0 | L0.63 | 8.66E-09 | 5.13E-08 | 75 | 62.5 | 65 | 0 | 79 | -3 |
| 19479 | 19952 | H0 | L0.64 | 2.65E-08 | 5.00E-07 | n.t. | n.t. | 65 | 0 | 79 | -3 |
| 19480 | 19953 | H0 | L0.65 | 1.23E-08 | 4.90E-08 | n.t. | n.t. | 65 | 0 | 79 | -3 |
| 19481 | 19954 | H0 | L0.66 | 1.55E-08 | 5.53E-08 | n.t. | n.t. | 65 | 0 | 79 | -3 |
| 19482 | 19955 | H0 | L0.67 | 5.00E-08 | 5.00E-07 | n.t. | n.t. | 65 | 0 | 82 | 0 |
| 19483 | 19956 | H0 | L0.68 | 6.98E-09 | 4.30E-08 | 75.5 | 63 | 65 | 0 | 80 | -2 |
| 19484 | 19957 | H0 | L0.69 | 1.62E-08 | 4.75E-08 | n.t. | n.t. | 65 | 0 | 81 | -1 |
| 19485 | 19958 | H0 | L0.70 | 6.58E-09 | 4.02E-08 | 76 | 64.5 | 65 | 0 | 82 | 0 |
| 19486 | 19959 | H0 | L0.71 | 8.41E-09 | 4.21E-08 | 76 | 64.5 | 65 | 0 | 82 | 0 |
| 19487 | 19960 | H0 | L0.72 | 9.76E-09 | 4.90E-08 | 75 | 63 | 65 | 0 | 82 | 0 |
| 19488 | 19961 | H0 | L0.73 | 4.75E-09 | n.t. | 76.5 | 65 | 65 | 0 | 91 | 9 |
| 19489 | 19962 | H0 | L0.74 | 9.11E-09 | n.t. | 76 | 64.5 | 65 | 0 | 82 | 0 |
| 19490 | 19963 | H0 | L0.75 | 3.53E-08 | n.t. | n.t. | n.t. | 65 | 0 | 81 | -1 |
| 19491 | 19964 | H0 | L0.76 | 4.95E-08 | n.t. | n.t. | n.t. | 65 | 0 | 81 | -1 |
| 19492 | 19965 | H0 | L0.77 | 6.63E-09 | n.t. | 76.5 | 65.5 | 65 | 0 | 81 | -1 |
| 19493 | 19966 | H0 | L0.78 | 4.18E-09 | n.t. | 76.5 | 65 | 65 | 0 | 81 | -1 |
| 19494 | 19967 | H0 | L0.79 | 5.13E-09 | 3.81E-08 | 76 | 64 | 65 | 0 | 81 | -1 |
| 19495 | 19968 | H0 | L0.80 | 4.44E-09 | 2.91E-08 | 72.5 | 59.5 | 65 | 0 | 79 | -3 |
| 19496 | 19969 | H0 | L0.81 | 6.03E-09 | 3.61E-08 | 75.5 | 64 | 65 | 0 | 78 | -4 |
| 19501 | 19970 | H0 | L0.82 | 5.34E-09 | 3.25E-08 | 76 | 64 | 65 | 0 | 78 | -4 |
| 19502 | 19971 | H0 | L0.83 | 5.18E-09 | 3.14E-08 | 75.5 | 63.5 | 65 | 0 | 81 | -1 |
| 19503 | 19972 | H0 | L0.84 | 5.22E-09 | 3.20E-08 | 74 | 61.5 | 65 | 0 | 73 | -9 |
| 19504 | 19973 | H0 | L0.85 | 4.90E-09 | 3.00E-08 | 76 | 64.5 | 65 | 0 | 80 | -2 |
| 19505 | 19974 | H0 | L0.86 | 3.51E-09 | 2.65E-08 | 74.5 | 61.5 | 65 | 0 | 77 | -5 |
| 19506 | 19975 | H0 | L0.87 | 7.35E-09 | 4.11E-08 | 75.5 | 63.5 | 65 | 0 | 82 | 0 |
| 19507 | 19976 | H0 | L0.88 | 6.06E-09 | 3.73E-08 | n.t. | n.t. | 65 | 0 | 82 | 0 |
| 19508 | 19977 | H0 | L0.89 | 6.40E-09 | 3.95E-08 | 75.5 | 64.5 | 65 | 0 | 73 | -9 |
| 19509 | 19978 | H0 | L0.90 | 7.22E-09 | 3.74E-08 | 75.5 | 63 | 65 | 0 | 75 | -7 |
| 19510 | 19979 | H0 | L0.91 | 4.69E-09 | 3.06E-08 | 75 | 62.5 | 65 | 0 | 74 | -8 |
| 19511 | 19980 | H0 | L0.92 | 7.82E-09 | 4.24E-08 | 75 | 62.5 | 65 | 0 | 73 | -9 |
| 19512 | 19981 | H0 | L0.93 | 7.70E-08 | 5.00E-07 | n.t. | n.t. | 65 | 0 | 73 | -9 |
| 19513 | 19982 | H0 | L0.94 | 5.40E-07 | 5.00E-07 | n.t. | n.t. | 65 | 0 | 73 | -9 |
| 19514 | 19983 | H0 | L0.95 | 1.71E-07 | 5.00E-07 | n.t. | n.t. | 65 | 0 | 73 | -9 |
| 19515 | 19984 | H0 | L0.96 | 1.80E-09 | 1.06E-08 | 72.5 | 59.5 | 65 | 0 | 73 | -9 |
| 19516 | 19985 | H0 | L0.97 | 8.41E-08 | 5.00E-07 | n.t. | n.t. | 65 | 0 | 73 | -9 |
| 19517 | 19986 | H0 | L0.98 | 5.00E-07 | 5.00E-07 | n.t. | n.t. | 65 | 0 | 73 | -9 |
| 19518 | 19987 | H0 | L0.99 | 5.00E-07 | 5.00E-07 | n.t. | n.t. | 65 | 0 | 73 | -9 |
| 19519 | 19988 | H0 | L0.100 | 8.03E-08 | 5.00E-07 | n.t. | n.t. | 65 | 0 | 73 | -9 |
| 19520 | 19989 | H0 | L0.101 | 1.84E-08 | 6.21E-08 | n.t. | n.t. | 65 | 0 | 73 | -9 |
| 19521 | 19990 | H0 | L0.102 | 2.02E-09 | 2.20E-08 | 76 | 62 | 65 | 0 | 73 | -9 |
| 19522 | 19991 | H0 | L0.103 | 7.60E-09 | 4.24E-08 | 75.5 | 65 | 65 | 0 | 73 | -9 |
| 19523 | 19992 | H0 | L0.104 | 7.47E-08 | 5.00E-07 | n.t. | n.t. | 65 | 0 | 75 | -7 |
| 19524 | 19993 | H0 | L0.105 | 5.00E-07 | 5.00E-07 | n.t. | n.t. | 65 | 0 | 74 | -8 |
| 19525 | 19994 | H0 | L0.106 | 2.33E-08 | 3.30E-08 | n.t. | n.t. | 65 | 0 | 77 | -5 |
| 19526 | 19995 | H0 | L0.107 | 5.00E-07 | 5.00E-07 | n.t. | n.t. | 65 | 0 | 73 | -9 |
| 19527 | 19996 | H0 | L0.108 | 5.00E-07 | 5.00E-07 | n.t. | n.t. | 65 | 0 | 80 | -2 |

Figure 24F

| Fab XENP | scFv XENP | VH | VL | Human CTLA-4 Fab K$_D$ (M) | Cyno CTLA-4 Fab K$_D$ (M) | Fab T$_m$ (°C) | scFv T$_m$ (°C) | VH 9-mers | Δ VH 9-mers | VL 9-mers | Δ VL 9-mers |
|---|---|---|---|---|---|---|---|---|---|---|---|
| 19528 | 20001 | H0 | L0.109 | 5.00E-07 | 5.00E-07 | n.t. | n.t. | 65 | 0 | 77 | -5 |
| 19529 | 20002 | H0 | L0.110 | 5.00E-07 | 5.00E-07 | n.t. | n.t. | 65 | 0 | 81 | -1 |
| 19530 | 20003 | H0 | L0.111 | 4.58E-09 | 1.68E-08 | 73.5 | 60.5 | 65 | 0 | 73 | -9 |
| 19531 | 20004 | H0 | L0.112 | 6.08E-09 | 2.93E-08 | 75.5 | 63.5 | 65 | 0 | 77 | -5 |
| 19532 | 20005 | H0 | L0.113 | 6.82E-09 | 4.48E-08 | n.t. | 62 | 65 | 0 | 74 | -8 |
|  | 19534 | H0.36 | L0.50 | n.t. | n.t. | n.t. | 62.5 | 61 | -4 | 73 | -9 |
|  | 19535 | H0.36 | L0.51 | n.t. | n.t. | n.t. | 62 | 61 | -4 | 75 | -7 |
|  | 19536 | H0.37 | L0.50 | n.t. | n.t. | n.t. | 59.5 | 60 | -5 | 73 | -9 |
|  | 19537 | H0.37 | L0.113 | n.t. | n.t. | n.t. | 63.5 | 60 | -5 | 74 | -8 |
|  | 19538 | H0.134 | L0.51 | n.t. | n.t. | n.t. | 64 | 62 | -3 | 75 | -7 |
| 20006 | 19539 | H0.134 | L0.53 | 5.02E-09 | 2.00E-08 | 75.5 | 65 | 62 | -3 | 74 | -8 |
|  | 19540 | H0.134 | L0.57 | n.t. | n.t. | n.t. | 61 | 62 | -3 | 75 | -7 |
|  | 19541 | H0.137 | L0.114 | n.t. | n.t. | n.t. | 66 | 60 | -5 | 74 | -8 |
|  | 19542 | H0.138 | L0.115 | n.t. | n.t. | n.t. | 64 | 59 | -6 | 73 | -9 |
|  | 19543 | H0.139 | L0.116 | n.t. | n.t. | n.t. | 62.5 | 59 | -6 | 73 | -9 |
| 19585 | 19587 | H0.140 | L0 | 2.83E-09 | 1.76E-08 | 78.5 | 68 | 56 | -9 | 82 | 0 |
| 19586 | 19588 | H0 | L0.117 | 4.09E-09 | 2.52E-08 | 76.5 | 63.5 | 65 | 0 | 69 | -13 |
| 19544 | 19551 | H1 | L0 | 1.77E-08 | 2.51E-08 | 74.5 | 61.5 | 70 | 5 | 82 | 0 |
| 19545 | 19552 | H2 | L0 | 1.10E-07 | 5.00E-07 | n.t. | 66.5 | 69 | 4 | 82 | 0 |
| 19546 | 19553 | H3 | L0 | 2.87E-09 | 1.92E-08 | 78.3 | 65.9 | 72 | 7 | 82 | 0 |
| 19547 | 19554 | H4 | L0 | 5.00E-07 | 5.00E-07 | 67.5 | 51.8 | 71 | 6 | 82 | 0 |
| 19548 | 19555 | H0 | L1 | 7.42E-09 | 4.37E-08 | 73.5 | 59.8 | 65 | 0 | 81 | -1 |
| 19549 | 19556 | H0 | L2 | 3.15E-09 | 2.32E-08 | 75 | 61 | 65 | 0 | 81 | -1 |
| 9950 | 19550 | H0 | L0 | 5.61E-09 | 3.29E-08 | 75.8 | 63.5 | 65 | 0 | 82 | 0 |
| 20007 |  | H3 | L1 | 3.35E-09 | 1.89E-08 | 75 | n.t. | 72 | 7 | 81 | -1 |
| 20008 |  | H3 | L2 | 1.41E-09 | 1.28E-08 | 77 | n.t. | 72 | 7 | 81 | -1 |
| 20009 |  | H3 | L0.12 | 2.46E-09 | 1.71E-08 | 79 | n.t. | 72 | 7 | 77 | -5 |
| 20010 |  | H3 | L0.18 | 2.17E-09 | 1.57E-08 | 77 | n.t. | 72 | 7 | 77 | -5 |
| 20011 |  | H3 | L0.22 | 4.13E-09 | 2.46E-08 | 78.5 | n.t. | 72 | 7 | 91 | 9 |
| 20012 |  | H3 | L0.27 | 1.31E-09 | 1.04E-08 | 77.5 | n.t. | 72 | 7 | 81 | -1 |
| 20013 |  | H3 | L0.32 | 1.59E-09 | 1.48E-08 | 78.5 | n.t. | 72 | 7 | 80 | -2 |
| 20014 |  | H3 | L0.36 | 3.75E-09 | 2.39E-08 | 77.5 | n.t. | 72 | 7 | 79 | -3 |
| 20015 |  | H3 | L0.37 | 1.44E-09 | 1.06E-08 | 77 | n.t. | 72 | 7 | 79 | -3 |
| 20016 |  | H3 | L0.39 | 1.29E-08 | 3.75E-08 | 77.5 | n.t. | 72 | 7 | 79 | -3 |
| 20017 |  | H3 | L0.41 | 1.84E-09 | 1.65E-08 | 78 | n.t. | 72 | 7 | 78 | -4 |
| 20018 |  | H3 | L0.67 | 3.49E-08 | 5.00E-07 | 77.5 | n.t. | 72 | 7 | 82 | 0 |
| 20019 |  | H3 | L0.69 | 2.64E-09 | n.t. | 77.5 | n.t. | 72 | 7 | 81 | -1 |
| 20020 |  | H3 | L0.74 | 2.68E-09 | n.t. | 78.8 | n.t. | 72 | 7 | 82 | 0 |
| 20021 |  | H3 | L0.75 | 2.81E-09 | n.t. | 78 | n.t. | 72 | 7 | 81 | -1 |
| 20022 |  | H3 | L0.103 | 3.69E-09 | 2.64E-08 | 78 | n.t. | 72 | 7 | 73 | -9 |
| 20052 |  | H3 | L0.44 | 6.78E-09 | 4.20E-08 | 75.8 | n.t. | 72 | 7 | 82 | 0 |
| 20068 | 20075 | H3.1 | L0.12 | 5.37E-10 | 3.64E-09 | 81 | 69 | 68 | 3 | 77 | -5 |
| 20069 | 20076 | H3.2 | L0.12 | 6.24E-10 | 4.10E-09 | 81 | 69.5 | 68 | 3 | 77 | -5 |
| 20070 | 20077 | H3.3 | L0.12 | 2.21E-09 | 1.08E-08 | 81 | 67 | 68 | 3 | 77 | -5 |
| 20071 | 20078 | H3.4 | L0.12 | 1.37E-09 | 6.14E-09 | 81 | 69.5 | 68 | 3 | 77 | -5 |
| 20072 | 20079 | H3.5 | L0.12 | 3.72E-09 | 1.59E-08 | 81.5 | 70 | 68 | 3 | 77 | -5 |
| 20073 | 20080 | H3.6 | L0.12 | 8.14E-09 | 2.59E-08 | 81.5 | 69.5 | 68 | 3 | 77 | -5 |
| 20074 | 20081 | H3.7 | L0.12 | 1.58E-09 | 1.11E-08 | 80 | 67 | 62 | -3 | 77 | -5 |
| 20323 | 20360 | H3.9 | L0.12 | 1.16E-09 | 5.54E-09 | n.t. | 69.5 | 68 | 3 | 77 | -5 |

Figure 24G

| Fab XENP | scFv XENP | VH | VL | Human CTLA-4 Fab K$_D$ (M) | Cyno CTLA-4 Fab K$_D$ (M) | Fab T$_m$ (°C) | scFv T$_m$ (°C) | VH 9-mers | Δ VH 9-mers | VL 9-mers | Δ VL 9-mers |
|---|---|---|---|---|---|---|---|---|---|---|---|
| 20324 | 20361 | H3.10 | L0.12 | 7.08E-10 | 3.34E-09 | n.t. | 68.5 | 68 | 3 | 77 | -5 |
| 20325 | 20362 | H3.11 | L0.12 | 1.65E-09 | 6.52E-09 | n.t. | 71 | 68 | 3 | 77 | -5 |
| 20326 | 20363 | H3.12 | L0.12 | 1.20E-08 | 4.13E-08 | n.t. | 70 | 68 | 3 | 77 | -5 |
| 20327 | 20364 | H3.13 | L0.12 | 8.15E-10 | 4.56E-09 | n.t. | 70 | 68 | 3 | 77 | -5 |
| 20328 | 20365 | H3.14 | L0.12 | 3.46E-09 | 1.95E-08 | n.t. | 69.5 | 68 | 3 | 77 | -5 |
| 20329 | 20366 | H3.15 | L0.12 | 8.65E-09 | 3.62E-08 | n.t. | 71.5 | 68 | 3 | 77 | -5 |
| 20330 | 20367 | H3.16 | L0.12 | 1.56E-08 | 6.23E-08 | n.t. | 70.5 | 68 | 3 | 77 | -5 |
| 20331 | 20368 | H3.17 | L0.12 | 3.93E-09 | 2.51E-08 | n.t. | 70.5 | 68 | 3 | 77 | -5 |
| 20332 | 20369 | H3.18 | L0.12 | 1.71E-08 | 8.46E-08 | n.t. | 69.5 | 68 | 3 | 77 | -5 |
| 20333 | 20370 | H3.19 | L0.12 | 4.09E-09 | 1.60E-08 | n.t. | 71.5 | 68 | 3 | 77 | -5 |
| 20334 | 20371 | H3.20 | L0.12 | 2.59E-08 | 2.54E-06 | n.t. | 70.5 | 68 | 3 | 77 | -5 |
| 20335 | 20372 | H3.21 | L0.12 | 1.55E-09 | 9.54E-09 | n.t. | 71 | 68 | 3 | 77 | -5 |
| 20336 | 20373 | H3.22 | L0.12 | 7.49E-09 | 2.98E-08 | n.t. | 69.5 | 68 | 3 | 77 | -5 |
| 20337 | 20374 | H3.23 | L0.12 | 1.17E-09 | 4.78E-09 | n.t. | 70.5 | 68 | 3 | 77 | -5 |
| 20338 | 20375 | H3.24 | L0.12 | 8.44E-09 | 2.96E-08 | n.t. | 69.5 | 68 | 3 | 77 | -5 |
| 20339 | 20376 | H3.25 | L0.12 | 4.51E-10 | 2.75E-09 | n.t. | 69.5 | 68 | 3 | 77 | -5 |
| 20340 | 20377 | H3.26 | L0.12 | 1.97E-09 | 1.23E-08 | n.t. | 69 | 68 | 3 | 77 | -5 |
| 20341 | 20378 | H3.4 | L0.118 | 1.55E-09 | 6.67E-09 | n.t. | 70.5 | 68 | 3 | 82 | 0 |
| 20342 | 20379 | H3.4 | L0.119 | 1.89E-09 | 8.23E-09 | n.t. | 70 | 68 | 3 | 82 | 0 |
| 20343 | 20380 | H3.4 | L0.120 | 2.70E-09 | 1.06E-08 | n.t. | 70 | 68 | 3 | 86 | 4 |
| 20344 | 20381 | H3.4 | L0.121 | 1.28E-09 | 5.54E-09 | n.t. | 71 | 68 | 3 | 86 | 4 |
| 20345 | 20382 | H3.4 | L0.122 | 1.98E-09 | 8.47E-09 | n.t. | 71 | 68 | 3 | 82 | 0 |
| 20346 | 20383 | H3.4 | L0.123 | 2.74E-09 | 1.14E-08 | n.t. | 71.5 | 68 | 3 | 91 | 9 |
| 20347 | 20384 | H3.4 | L0.124 | 1.41E-09 | 5.67E-09 | n.t. | 72.5 | 68 | 3 | 91 | 9 |
| 20348 | 20385 | H3.4 | L0.125 | 3.20E-09 | 1.37E-08 | n.t. | 70.5 | 68 | 3 | 91 | 9 |
| 20349 | 20386 | H3.4 | L0.126 | 1.68E-09 | 7.52E-09 | n.t. | 71.5 | 68 | 3 | 91 | 9 |
| 20350 | 20387 | H3.4 | L0.127 | 2.46E-09 | 9.53E-09 | n.t. | 72 | 68 | 3 | 95 | 13 |
| 20351 | 20388 | H3.4 | L0.128 | 3.16E-09 | 1.33E-08 | n.t. | 72 | 68 | 3 | 91 | 9 |
| 20352 | 20389 | H3.4 | L0.129 | 1.65E-09 | 7.31E-09 | n.t. | 73 | 68 | 3 | 91 | 9 |
| 20353 | 20390 | H3.4 | L0.130 | 2.77E-09 | 1.09E-08 | n.t. | 73 | 68 | 3 | 100 | 18 |
| 20354 | 20391 | H3.4 | L0.131 | 2.70E-09 | 1.08E-08 | n.t. | 72.5 | 68 | 3 | 100 | 18 |
| 20355 | 20392 | H3.4 | L0.132 | 2.78E-09 | 1.12E-08 | n.t. | 73.5 | 68 | 3 | 100 | 18 |
| 20356 | 20393 | H3.5 | L2 | 2.17E-09 | 1.13E-08 | n.t. | 67 | 68 | 3 | 81 | -1 |
| 20357 | 20394 | H3.5 | L2.1 | 4.52E-09 | 2.41E-08 | n.t. | 67.5 | 68 | 3 | 90 | 8 |
| 20358 | 20395 | H3.5 | L2.2 | 1.90E-09 | 1.04E-08 | n.t. | 68.5 | 68 | 3 | 89 | 7 |
| 20359 | 20396 | H3.5 | L2.3 | 3.90E-09 | 2.05E-08 | n.t. | 69 | 68 | 3 | 98 | 16 |
| 20422 | 20431 | H3.21 | L0.124 | 5.55E-09 | 1.23E-08 | n.t. | 74 | 68 | 3 | 91 | 9 |
| 20423 | 20432 | H3.21 | L0.129 | 5.42E-09 | 1.36E-08 | n.t. | 74.5 | 68 | 3 | 91 | 9 |
| 20424 | 20433 | H3.21 | L0.132 | 5.27E-09 | 1.60E-08 | n.t. | 75 | 68 | 3 | 100 | 18 |
| 20425 | 20434 | H3.23 | L0.124 | 2.63E-09 | 4.99E-09 | n.t. | 73.5 | 68 | 3 | 91 | 9 |
| 20426 | 20435 | H3.23 | L0.129 | 2.97E-09 | 4.99E-09 | n.t. | 74 | 68 | 3 | 91 | 9 |
| 20427 | 20436 | H3.23 | L0.132 | 4.84E-09 | 8.89E-09 | n.t. | 74.5 | 68 | 3 | 100 | 18 |
| 20428 | 20437 | H3.25 | L0.124 | 4.80E-09 | 8.65E-09 | n.t. | 72.5 | 68 | 3 | 91 | 9 |
| 20429 | 20438 | H3.25 | L0.129 | 2.05E-09 | 3.99E-09 | n.t. | 73 | 68 | 3 | 91 | 9 |
| 20430 | 20439 | H3.25 | L0.132 | 1.80E-09 | 3.81E-09 | n.t. | 73.5 | 68 | 3 | 100 | 18 |

Figure 37A

Bottle opener backbone 1

Fab side heavy chain (SEQ ID NO:37725)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVKHEDPEVKFNWYVDGVEVHNAKTKPREEYNSTYRVVSVLTVLHQDWLNGKEYKCKVSNKALPAPI
EKTISKAKGQPREPQVYTLPPSREEMTKNQVSLTCDVSGFYPSDIAVEWESNGQPENNYKTTPPVLDSDGSFFLYSKLTVDKSRWQQGNVFSCSVMHEALHNHYTQK
SLSLSPGK scFv heavy chain (SEQ ID NO:37726)

EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKV
SNKALPAPIEKTISKADYEKHKVYACEVTHQGLSSPVTKSFNRGEC
ALHNHYTQKSLSLSPGK constant light chain (SEQ ID NO:37727)

RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Bottle opener backbone 2

Fab side heavy chain (SEQ ID NO:37728)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVKHEDPEVKFNWYVDGVEVHNAKTKPREEYNSTYRVVSVLTVLHQDWLNGKEYKCKVSNKALPAPI
EKTISKAKGQPREPQVYTLPPSREEMTKNQVSLTCDVSGFYPSDIAVEWESNGQPENNYKTTPPVLDSDGSFFLYSKLTVDKSRWQQGNVFSCSVMHEALHNHYTQK
SLSLSPGK scFv heavy chain (SEQ ID NO:37729)

EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKV
SNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHE
ALHNHYTQKSLSLSPGK

Figure 37B

Bottle opener backbone 3

Fab side heavy chain (SEQ ID NO:37731)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYKCKVSNKALPAPI
EKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQK
SLSLSPGK scFv heavy chain (SEQ ID NO:37732)

EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKV
SNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHE
ALHNHYTQKSLSLSPGK

Bottle opener backbone 4

Fab side heavy chain (SEQ ID NO:37734)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYKCKVSNKALPAPI
EKTISKAKGQPREPQVYTLPPSREEMTENEVSLTCLVKSGFYPSDIAVEWESDGQPENNYKTTPPVLDSDGSFFLYSKLEVDKSRWEQGDVFSCSVMHEALHNHYTQ
KSLSLSPGK scFv heavy chain (SEQ ID NO:37735)

EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKV
SNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHE
ALHNHYTQKSLSLSPGK

Figure 37C

Bottle opener backbone 5 (356D/358L allotype)

Fab side heavy chain (SEQ ID NO: 39158)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYKCKVSNKALPAPI
EKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQK
SLSLSPGK scFv heavy chain (SEQ ID NO: 39159)

EPKSSDKTHTCPPCPAPPVAGPSVFLFPPKPKDTLMISRTPEVTCVVVDVKHEDPEVKFNWYDGVEVHNAKTKPREEQYASTYRVVSVLTVLHQDWLNGKEYKCKV
SNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHE
ALHNHYTQKSLSLSPGK

Bottle opener backbone 6

Fab side heavy chain (SEQ ID NO: 39160)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVSHEDPEVKFNWYVDGVEVHNAKTKPREEEYASTYRVVSVLTVLHQDWLNGKEYKCKVSNKALPAPI
EKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK scFv heavy chain (SEQ ID NO: 39161)

EPKSSDKTHTCPPCPAPPVAGPSVFLFPPKPKDTLMISRTPEVTCVVVDVKHEDPEVKFNWYDGVEVHNAKTKPREEQYASTYRVVSVLTVLHQDWLNGKEYKCKV
SNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHE
ALHNHYTQKSLSLSPGK

Figure 37D

Bottle opener backbone 7

Fab side heavy chain (SEQ ID NO: 39162)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVKHEDPEVKFNWYVDGVEVHNAKTPREEEYSSTYRVVSVLTVLHQDWLNGKEYKCKVSNKALPAPI
EKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK scFv heavy chain (SEQ ID NO: 39163)

EPKSSDKTHTCPPCPAPPVAGPSVFLFPPKPKDTLMISRTPEVTCVVVDVKHEDPEVKFNWYVDGVEVHNAKTPREEQYSSTYRVVSVLTVLHQDWLNGKEYKCKV
SNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHE
ALHNHYTQKSLSLSPGK

Bottle opener backbone 8

Fab side heavy chain (SEQ ID NO: 39164)

ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCP
PCPAPEFLGGPSVFLFPPKPKDTLMISRTPEVTCVVVDVKQEDPEVQFNWYVDGVEVHNAKTPREEFNSTYRVVSVLTVLHQDWLNGKEYKCKVSNKGLPSSIEK
TISKAKGQPREPQVYTLPPSQEEMTKNQVSLTCDVSGFYPSDIAVEWESDGQPENNYKTTPPVLDSDGSFFLYSKLTVDKSRWEEGDVFSCSVMHEALHNHYTQKSL
SLSLGK scFv heavy chain (SEQ ID NO: 39165)

ESKYGPPCPPCPAPEFLGGPSVFLFPPKPKDTLMISRTPEVTCVVVDVKQEDPEVQFNWYVDGVEVHNAKTPREEQFNSTYRVVSVLTVLHQDWLNGKEYKCKVSN
KGLPSSIEKTISKAKGQPREPQVYTLPPSQEEMTKNQVKLTCLVKGFYPSDIAVEWESNGQPENNYKTTPPVLDSDGSFFLYSKLTVDKSRWQEGNVFSCSVMHEAL
HNHYTQKSLSLSLGK

Figure 37E

Bottle opener backbone 9

Fab side heavy chain (SEQ ID NO: 39166)

ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECP
PCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKT
ISKTKGQPREPQVYTLPPSREEMTKNQVSLTCDVSGFYPSDIAVEWESDGQPENNYKTTPPMLDSDGSFFLYSKLTVDKSRWQEGDVFSCSVMHEALHNHYTQKSLS
LSPGK scFv heavy chain (SEQ ID NO: 39167)

ERKCSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNK
GLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALH
NHYTQKSLSLSPGK

Bottle opener backbone 10

Fab side heavy chain (SEQ ID NO: 39168)

ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECP
PCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKT
ISKTKGQPREPQVYTLPPSREEMTKNQVSLTCDVSGFYPSDIAVEWESDGQPENNYKTTPPMLDSDGSFFLYSKLTVDKSRWQEGDVFSCSVMHEALHNHYTQKSLS
LSPGK scFv heavy chain (SEQ ID NO: 39169)

ERKCSVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNK
GLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALH
NHYTQKSLSLSPGK

Figure 38A mAb-scFv backbone 1 (356E/358M allotype)

monomer 1 (Fab-scFv side) (SEQ ID NO:37737)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPP
VAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYT
LPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK monomer 2 (Fab side) (SEQ ID NO:37738)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK constant light chain (SEQ ID NO:37739)

RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 38B mAb-scFv backbone 2

Fab-scFv-Hc - 356D/358L allotype (SEQ ID NO: 39170)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPP
VAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYT
LPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

>mAb-scFv Fab-Hc - 356D/358L allotype (SEQ ID NO: 39171)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYT
LPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK mAb-scFv backbone 3

>mAb-scFv Fab-scFv-Hc - N297A (SEQ ID NO: 39172)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPP
VAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYT
LPPSREEMTKNQVSLTCLVKGFYPSDIAVEWESDGQPENNYKTTPPVLDSDGSFFLYSKLTVDKSRWQEGDVFSCSVMHEALHNHYTQKSLSLSPGK

>mAb-scFv Fab-Hc - N297A (SEQ ID NO: 39173)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPP
VAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

Figure 38C mAb-scFv backbone 4

>mAb-scFv Fab-scFv-Hc - N297S (SEQ ID NO: 39174)
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPP
VAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYT
LPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

>mAb-scFv Fab-Hc - N297S (SEQ ID NO: 39175)
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPP
VAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYT
LPPSREQMTKNQVSLTCLVKGFYPSDIAVEWESNGQPENNYKTTPPVLDSDGSFFLYSKLTVDKSRWQQGNVFSCSVMHEALHNHYTQKSLSLSPGK mAb-scFv backbone 5 mAb-scFv Fab-scFv-IgG4-Hc (SEQ ID NO: 39176)
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPPCPAPEFLG
GPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLP
PSQEEMTKNQVSLTCLVKGFYPSDIAVEWESDGQPENNYKTTPPVLDSDGSFFLYSKLTVDKSRWEEGDVFSCSVMHEALHNHYTQKSLSLGK

>mAb-scFv Fab-IgG4-Hc (SEQ ID NO: 39177)
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPPCPAPEFLG
GPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLP
PSQEEMTKNQVSLTCLVKGFYPSDIAVEWESNGQPENNYKTTPPVLDSDGSFFLYSKLTVDKSRWQEGNVFSCSVMHEALHNHYTQKSLSLGK

Figure 38D mAb-scFv backbone 6

>mAb-scFv Fab-scFv-IgG2-Hc - without S267K (SEQ ID NO: 39178)

ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAG
PSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPP
SREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

>mAb-scFv Fab-IgG2-Hc - without S267K (SEQ ID NO: 39179)

ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCSVECPPCPAPPVAG
PSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPP
SREQMTKNQVKLTCLVKGFYPSDIAVEWESNGQPENNYKTTPPMLDSDGSFFLYSKLTVDKSRWQQGNVFSCSVMHEALHNHYTQKSLSLSPGK mAb-scFv backbone 7

>mAb-scFv Fab-scFv-IgG2-Hc - with S267K (SEQ ID NO: 39180)

ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAG
PSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPP
SREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

>mAb-scFv Fab-IgG2-Hc - with S267K (SEQ ID NO: 39181)

ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCSVECPPCPAPPVAG
PSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPP
SREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

| 1st/2nd antigens | PD-1 | CTLA-4 | TIM-3 | LAG-3 | TIGIT | BTLA |
|---|---|---|---|---|---|---|
| PD-1 | XXX | A, B, C, D, E | A, B, C, D, E | A, B, C, D, E | A, B, C, D, E | A, B, C, D, E |
| CTLA-4 | A, B, C, D, F | XXX | A, B, C, D, F | A, B, C, D, F | A, B, C, D, F | A, B, C, D, F |
| TIM-3 | A, B, C, D, G | A, B, C, D, G | XXX | A, B, C, D, G | A, B, C, D, G | A, B, C, D, G |
| LAG-3 | A, B, C, D, H | A, B, C, D, H | A, B, C, D, H | XXX | A, B, C, D, H | A, B, C, D, H |
| TIGIT | A, B, C, D, I | A, B, C, D, I | A, B, C, D, I | A, B, C, D, I | XXX | A, B, C, D, I |
| BTLA | A, B, C, D, J | A, B, C, D, J | A, B, C, D, J | A, B, C, D, J | A, B, C, D, J | XXX |

| 1st/2nd antigens | PD-1 | CTLA-4 | TIM-3 | LAG-3 | TIGIT | BTLA |
|---|---|---|---|---|---|---|
| PD-1 | XXX | A, B, C, D, E | A, B, C, D, E | A, B, C, D, E | A, B, C, D, E | A, B, C, D, E |
| CTLA-4 | A, B, C, D, F | XXX | A, B, C, D, F | A, B, C, D, F | A, B, C, D, F | A, B, C, D, F |
| TIM-3 | A, B, C, D, G | A, B, C, D, G | XXX | A, B, C, D, G | A, B, C, D, G | A, B, C, D, G |
| LAG-3 | A, B, C, D, H | A, B, C, D, H | A, B, C, D, H | XXX | A, B, C, D, H | A, B, C, D, H |
| TIGIT | A, B, C, D, I | A, B, C, D, I | A, B, C, D, I | A, B, C, D, I | XXX | A, B, C, D, I |
| BTLA | A, B, C, D, J | A, B, C, D, J | A, B, C, D, J | A, B, C, D, J | A, B, C, D, J | XXX |

(doc 3154955)

Figure 40

| 1st/2nd antigens | PD-1 | CTLA-4 | TIM-3 | LAG-3 | TIGIT | BTLA |
|---|---|---|---|---|---|---|
| PD-1 | ------ | Q, R, S | Q, R, S | Q, R, S | Q, R, S | Q, R, S |
| CTLA-4 | Q, R, T | ------ | Q, R, T | Q, R, T | Q, R, T | Q, R, T |
| TIM-3 | Q, R, U | Q, R, U | ------ | Q, R, U | Q, R, U | Q, R, U |
| LAG-3 | Q, R, V | Q, R, V | Q, R, V | ------ | Q, R, V | Q, R, V |
| TIGIT | Q, R, W | Q, R, W | Q, R, W | Q, R, W | ------ | Q, R, W |
| BTLA | Q, R, X | Q, R, X | Q, R, X | Q, R, X | Q, R, X | ------ | e.g. anti-PD1, anti-CTLA4

FIGURE 54

| XENP (bivalent mAb) | Clone | VH | VL | KD (M; human BTLA) |
|---|---|---|---|---|
| 20269 | 9C6 | H0 | L0 | 1.3E-08 |
| 20744 | 9C6 | H0 | L1 | 1.4E-08 |
| 20745 | 9C6 | H0 | L2 | 1.9E-08 |
| 20746 | 9C6 | H1 | L0 | 1.8E-08 |
| 20747 | 9C6 | H1 | L1 | 2.7E-08 |
| 20748 | 9C6 | H1 | L2 | 4.2E-08 |
| 20749 | 9C6 | H2 | L0 | 2.1E-08 |
| 20750 | 9C6 | H2 | L1 | 3.7E-08 |
| 20751 | 9C6 | H2 | L2 | 5.1E-08 |
| 20752 | 9C6 | H3 | L0 | 2.3E-08 |
| 20753 | 9C6 | H3 | L1 | 3.2E-08 |
| 20754 | 9C6 | H3 | L2 | 3.1E-08 |
| 20872 | 9C6 | H1.1 | L1 | 2.4E-08 |
| 20873 | 9C6 | H1.2 | L1 | 3.8E-08 |
| 20874 | 9C6 | H1.3 | L1 | 5.0E-08 |
| 20875 | 9C6 | H1.4 | L1 | 4.5E-08 |
| 20876 | 9C6 | H1.5 | L1 | 4.7E-08 |
| 20877 | 9C6 | H1.6 | L1 | 4.6E-08 |
| 20878 | 9C6 | H1.7 | L1 | 4.5E-08 |
| 20879 | 9C6 | H1.8 | L1 | 4.7E-08 |
| 20880 | 9C6 | H1.9 | L1 | 3.5E-08 |
| 20881 | 9C6 | H1.10 | L1 | 5.1E-08 |
| 20882 | 9C6 | H1.11 | L1 | 2.2E-08 |
| 20883 | 9C6 | H1.12 | L1 | 3.4E-08 |
| 20884 | 9C6 | H1.13 | L1 | 3.0E-08 |
| 20885 | 9C6 | H1.14 | L1 | 3.4E-08 |
| 20886 | 9C6 | H1.15 | L1 | 3.4E-08 |
| 20887 | 9C6 | H1.16 | L1 | 3.7E-08 |
| 20888 | 9C6 | H1 | L1.1 | 3.1E-08 |
| 20889 | 9C6 | H1 | L1.2 | 3.0E-08 |
| 20890 | 9C6 | H1 | L1.3 | 3.2E-08 |
| 20891 | 9C6 | H1 | L1.4 | 3.1E-08 |
| 20892 | 9C6 | H1 | L1.5 | 3.1E-08 |
| 20893 | 9C6 | H1 | L1.6 | 3.4E-08 |
| 20894 | 9C6 | H1 | L1.7 | 6.2E-08 |

FIGURE 55A

| Fab XENP | VH | VL | Human LAG-3 Fab $K_D$ (M) | Fab $T_m$ (°C) |
|---|---|---|---|---|
| 20847 | H1 | L2 | 1.37E-08 | 73.5 |
| 21228 | H1.1 | L2 | 1.43E-08 | 72.5 |
| 21232 | H1.5 | L2 | 1.73E-08 | 73 |
| 21235 | H1.8 | L2 | 1.15E-08 | 72.5 |
| 21236 | H1.9 | L2 | 1.26E-08 | 73 |
| 21239 | H1.12 | L2 | 1.25E-08 | 73.5 |
| 21245 | H1.18 | L2 | 1.27E-08 | 72.5 |
| 21249 | H1.22 | L2 | 9.50E-09 | 72.5 |
| 21256 | H1.29 | L2 | 1.30E-08 | 73.5 |
| 21264 | H1.37 | L2 | 3.60E-09 | 73 |
| 21284 | H1.57 | L2 | 2.36E-08 | 73.5 |
| 21286 | H1.59 | L2 | 3.61E-08 | 73.5 |
| 21291 | H1.64 | L2 | 6.71E-09 | 73 |
| 21292 | H1.65 | L2 | 7.08E-09 | 73 |
| 21295 | H1.68 | L2 | 1.31E-08 | 72.5 |
| 21301 | H1.70 | L2 | 5.47E-09 | 72.5 |
| 21302 | H1.71 | L2 | 1.25E-08 | 74.5 |
| 21304 | H1.73 | L2 | 1.63E-08 | 73.5 |
| 21306 | H1.75 | L2 | 1.69E-08 | 74 |
| 21327 | H1.96 | L2 | 1.93E-08 | 73.5 |
| 21329 | H1.98 | L2 | 1.11E-08 | 73.5 |
| 21332 | H1.101 | L2 | 1.43E-08 | 73.5 |
| 21336 | H1.105 | L2 | 5.41E-09 | 73 |
| 21339 | H1.108 | L2 | 1.29E-08 | 73.5 |
| 21342 | H1.111 | L2 | 1.18E-08 | 73.5 |
| 21344 | H1.113 | L2 | 1.16E-08 | 73 |
| 21351 | H1 | L2.4 | 1.07E-08 | 71.5 |
| 21353 | H1 | L2.6 | 1.68E-08 | 70.5 |
| 21360 | H1 | L2.13 | 1.17E-08 | 74 |
| 21369 | H1 | L2.22 | 1.74E-08 | 71 |
| 21370 | H1 | L2.23 | 9.74E-09 | 73 |
| 21371 | H1 | L2.24 | 1.80E-08 | 73 |
| 21382 | H1 | L2.35 | 5.44E-09 | 73 |
| 21392 | H1 | L2.45 | 5.09E-09 | 72 |
| 21394 | H1 | L2.47 | 3.40E-09 | 73.5 |
| 21395 | H1 | L2.48 | 8.27E-09 | 72 |
| 21401 | H1 | L2.50 | 2.30E-09 | 73.5 |
| 21402 | H1 | L2.51 | 8.47E-09 | 73 |
| 21409 | H1 | L2.58 | 3.11E-09 | 77 |

FIGURE 55B

| Fab XENP | VH | VL | Human LAG-3 Fab $K_D$ (M) | Fab $T_m$ (°C) |
|---|---|---|---|---|
| 21411 | H1 | L2.60 | 1.46E-08 | 75 |
| 21421 | H1 | L2.70 | 6.58E-09 | 74 |
| 21423 | H1 | L2.72 | 1.15E-08 | 73 |
| 21424 | H1 | L2.73 | 7.68E-09 | 74 |
| 21426 | H1 | L2.75 | 1.61E-08 | 74.5 |
| 21609 | H1.64 | L2.35 | 1.16E-08 | |
| 21610 | H1.64 | L2.47 | 3.30E-09 | |
| 21611 | H1.64 | L2.50 | 2.34E-09 | |
| 21612 | H1.70 | L2.35 | 1.30E-08 | |
| 21613 | H1.70 | L2.47 | 6.29E-09 | |
| 21614 | H1.70 | L2.50 | 6.48E-09 | |
| 21615 | H1.105 | L2.35 | 5.82E-09 | |
| 21616 | H1.105 | L2.47 | 3.62E-09 | |
| 21617 | H1.105 | L2.50 | 2.02E-09 | |
| 21705 | H.117 | L2 | 2.90E-09 | |
| 21706 | H.118 | L2 | 4.06E-09 | |
| 21707 | H.119 | L2 | 7.72E-09 | |
| 21708 | H.120 | L2 | 8.48E-09 | |
| 21709 | H.121 | L2 | 3.19E-09 | |
| 21710 | H.122 | L2 | 4.54E-09 | |
| 21711 | H.123 | L2 | 7.63E-09 | |
| 21712 | H.124 | L2 | 1.08E-08 | |
| 21713 | H.126 | L2 | 1.63E-09 | |
| 21714 | H.128 | L2 | 5.70E-09 | |
| 21715 | H.129 | L2 | 1.16E-08 | |
| 21716 | H.130 | L2 | 9.43E-09 | |
| 21717 | H.131 | L2 | 1.63E-08 | |
| 21718 | H.132 | L2 | 2.12E-08 | |
| 21719 | H.133 | L2 | 1.60E-08 | |
| 21720 | H.134 | L2 | 2.45E-08 | |
| 21721 | H.135 | L2 | 5.71E-09 | |
| 21722 | H.136 | L2 | 3.03E-09 | |
| 21723 | H.137 | L2 | 7.26E-09 | |
| 21724 | H.138 | L2 | 8.29E-09 | |
| 21725 | H.139 | L2 | 7.00E-09 | |
| 21726 | H.140 | L2 | 1.03E-08 | |
| 21727 | H.141 | L2 | 4.74E-09 | |
| 21728 | H.142 | L2 | 1.61E-06 | |
| 21729 | H.143 | L2 | 4.70E-09 | |

FIGURE 55C

| Fab XENP | VH | VL | Human LAG-3 Fab $K_D$ (M) | Fab $T_m$ (°C) |
|---|---|---|---|---|
| 21730 | H.144 | L2 | 1.64E-09 | |
| 21731 | H.145 | L2 | 5.19E-09 | |
| 21732 | H.146 | L2 | 2.95E-09 | |
| 21794 | H1.125 | L2 | 8.13E-10 | |
| 21795 | H1.127 | L2 | 2.36E-09 | |
| 21796 | H1 | L2.102 | 1.21E-08 | |
| 21801 | H1 | L2.103 | 3.22E-08 | |
| 21802 | H1 | L2.104 | 2.09E-07 | |
| 21803 | H1 | L2.105 | 8.35E-08 | |
| 21804 | H1 | L2.106 | 1.43E-07 | |
| 21805 | H1 | L2.107 | | |
| 21806 | H1 | L2.108 | | |
| 21807 | H1 | L2.109 | 1.68E-08 | |
| 21808 | H1 | L2.110 | | |
| 21809 | H1 | L2.111 | 2.24E-09 | |
| 21810 | H1 | L2.112 | 3.26E-09 | |
| 21811 | H1 | L2.113 | 1.29E-09 | |
| 21812 | H1 | L2.114 | 2.79E-09 | |
| 21813 | H1 | L2.115 | 6.06E-09 | |
| 21814 | H1 | L2.116 | 1.58E-09 | |
| 21815 | H1 | L2.117 | | |
| 21816 | H1 | L2.118 | 1.13E-08 | |
| 21817 | H1 | L2.119 | 3.99E-09 | |
| 21818 | H1 | L2.120 | 2.90E-09 | |
| 21819 | H1 | L2.121 | 1.12E-08 | |
| 21912 | H1.117 | L2.50 | | |
| 21913 | H1.125 | L2.50 | 1.75E-10 | |
| 21914 | H1.126 | L2.50 | 2.75E-10 | |
| 21915 | H1.144 | L2.50 | 4.63E-10 | |
| 21916 | H1.127 | L2.50 | 5.28E-10 | |
| 21917 | H1.136 | L2.50 | 5.12E-10 | |
| 21918 | H1.154 | L2.50 | 9.22E-10 | |
| 21919 | H1.141 | L2.50 | 1.71E-09 | |
| 21920 | H1.117 | L2.113 | 7.96E-10 | |
| 21921 | H1.125 | L2.113 | 1.38E-10 | |
| 21922 | H1.126 | L2.113 | 3.96E-10 | |
| 21923 | H1.144 | L2.113 | 2.84E-10 | |
| 21924 | H1.127 | L2.113 | 5.20E-10 | |
| 21925 | H1.136 | L2.113 | 3.08E-10 | |

FIGURE 55D

| Fab XENP | VH | VL | Human LAG-3 Fab K$_D$ (M) | Fab T$_m$ (°C) |
|---|---|---|---|---|
| 21926 | H1.154 | L2.113 | 9.08E-10 | |
| 21927 | H1.141 | L2.113 | 5.63E-10 | |
| 21928 | H1.117 | L2.116 | 3.23E-10 | |
| 21929 | H1.125 | L2.116 | 3.64E-10 | |
| 21930 | H1.126 | L2.116 | 9.37E-10 | |
| 21931 | H1.144 | L2.116 | 9.74E-10 | |
| 21932 | H1.127 | L2.116 | 1.66E-09 | |
| 21933 | H1.136 | L2.116 | 1.31E-09 | |
| 21934 | H1.154 | L2.116 | 3.58E-09 | |
| 21935 | H1.141 | L2.116 | 2.16E-09 | |
| 21915 | H1.144 | L2.50 | 7.66E-10 | |
| 21923 | H1.144 | L2.113 | 7.31E-10 | |
| 22138 | H1.158 | L2.126 | 1.58E-07 | |
| 22139 | H1.159 | L2.126 | 2.12E-07 | |
| 22140 | H1.160 | L2.126 | 1.70E-07 | |
| 22141 | H1.161 | L2.126 | 8.77E-08 | |
| 22142 | H1.162 | L2.126 | 1.20E-07 | |
| 22143 | H1.163 | L2.126 | 4.62E-07 | |
| 22144 | H1.164 | L2.126 | 3.46E-07 | |
| 22145 | H1.165 | L2.126 | 2.01E-07 | |
| 22146 | H1.166 | L2.126 | 2.59E-07 | |
| 22147 | H1.167 | L2.126 | 4.12E-08 | |
| 22148 | H1.168 | L2.126 | 3.43E-07 | |
| 22149 | H1.169 | L2.126 | 3.24E-07 | |
| 22453 | H1.144 | L2.131 | 2.00E-09 | |
| 22454 | H1.167 | L2.128 | 3.00E-07 | |
| 22455 | H1.167 | L2.129 | 1.68E-06 | |
| 22456 | H1.167 | L2.130 | 2.64E-07 | |
| 22457 | H1.167 | L2.131 | 3.76E-07 | |
| 22461 | H1.125 | L2.131 | 1.67E-09 | |
| 22450 | H1.144 | L2.128 | 2.55E-09 | 67 |
| 22451 | H1.144 | L2.129 | 4.26E-09 | 67.5 |
| 22452 | H1.144 | L2.130 | 4.95E-09 | 68.5 |
| 22458 | H1.125 | L2.128 | 2.24E-09 | 65 |
| 22459 | H1.125 | L2.129 | 5.64E-09 | 67 |
| 22460 | H1.125 | L2.130 | 3.21E-09 | 67 |
| 22570 | H1.144 | L2.132 | 2.44E-09 | 66.5 |
| 22571 | H1.144 | L2.133 | 4.71E-09 | 67 |
| 22572 | H1.144 | L2.134 | 5.54E-09 | 69 |

FIGURE 55E

| Fab XENP | VH | VL | Human LAG-3 Fab $K_D$ (M) | Fab $T_m$ (°C) |
|---|---|---|---|---|
| 22574 | H1.125 | L2.132 | 1.98E-09 | 65.5 |
| 22575 | H1.125 | L2.133 | 3.19E-09 | 65 |
| 22578 | H1.141 | L2.132 | 2.93E-12 | 66.5 |
| 22579 | H1.141 | L2.133 | 9.21E-09 | 68 |
| 22580 | H1.141 | L2.134 | 4.12E-09 | 69.5 |
| 22609 | H1.144 | L2.136 | 4.60E-09 | 67.5 |
| 22610 | H1.125 | L2.136 | 3.81E-09 | 66 |
| 22611 | H1.141 | L2.136 | 4.30E-09 | 68 |
| 22612 | H1.144 | L2.137 | 2.03E-08 | |
| 22613 | H1.125 | L2.137 | 5.09E-09 | 66 |
| 22614 | H1.141 | L2.137 | 7.35E-09 | 68.5 |
| 22576 | H1.125 | L2.134 | 3.46E-09 | 66.5 |
| 22615 | H1.144 | L2.126 | 2.69E-09 | |
| 22616 | H1.144 | L2.91 | 1.26E-08 | 74 |
| 22617 | H1.144 | L2.93 | 8.31E-09 | 72.5 |
| 22618 | H1.144 | L2.122 | 9.12E-09 | 74.5 |
| 22619 | H1.144 | L2.124 | 1.03E-08 | 73.5 |
| 22620 | H1.125 | L2.126 | 1.20E-09 | 64 |
| 22621 | H1.125 | L2.91 | 5.96E-09 | 73.5 |
| 22622 | H1.125 | L2.93 | 5.81E-09 | 72 |
| 22623 | H1.125 | L2.122 | 6.81E-09 | 73 |
| 22624 | H1.125 | L2.124 | 7.00E-09 | 73 |
| 22652 | H1.144 | L2.138 | 1.32E-09 | 74 |
| 22653 | H1.144 | L2.139 | 2.41E-09 | |
| 22654 | H1.144 | L2.140 | 2.89E-09 | |
| 22655 | H1.144 | L2.141 | 3.65E-09 | |
| 22656 | H1.144 | L2.142 | 1.29E-09 | 74 |
| 22657 | H1.144 | L2.143 | 3.33E-09 | |
| 22658 | H1.144 | L2.144 | 3.04E-09 | |
| 22659 | H1.144 | L2.145 | 3.43E-09 | |
| 22660 | H1.125 | L2.138 | 9.29E-10 | 73.5 |
| 22661 | H1.125 | L2.139 | 2.34E-09 | |
| 22662 | H1.125 | L2.140 | 2.24E-09 | 73.5 |
| 22663 | H1.125 | L2.141 | 2.41E-09 | 73 |
| 22664 | H1.125 | L2.142 | 3.62E-10 | 73.5 |
| 22665 | H1.125 | L2.143 | 2.74E-09 | |
| 22666 | H1.125 | L2.144 | 2.58E-09 | |
| 22667 | H1.125 | L2.145 | 2.70E-09 | |

| XENP | Clone | VH | VL | KD (M) | kdis(1/s) | DSF T$_M$ (°C) |
|---|---|---|---|---|---|---|
| 20844 | 7G8 | H3 | L1 | 4.84E-08 | 3.51E-02 | 59.0 |
| 20911 | 7G8 | H3.1 | L1 | 2.13E-08 | 6.47E-03 | |
| 20912 | 7G8 | H3.2 | L1 | 5.51E-08 | 1.22E-02 | |
| 20913 | 7G8 | H3.3 | L1 | 2.16E-08 | 7.75E-03 | |
| 20914 | 7G8 | H3.4 | L1 | 1.64E-08 | 7.57E-03 | |
| 20915 | 7G8 | H3.5 | L1 | 8.38E-08 | 3.72E-03 | |
| 20916 | 7G8 | H3.6 | L1 | 6.50E-08 | 1.90E-02 | |
| 20917 | 7G8 | H3.8 | L1 | 1.62E-08 | 8.26E-03 | |
| 20918 | 7G8 | H3 | L1.1 | 8.19E-08 | 2.45E-02 | |
| 20919 | 7G8 | H3 | L1.2 | Weak | Weak | |
| 20920 | 7G8 | H3 | L1.3 | Weak | Weak | |
| 20921 | 7G8 | H3 | L1.4 | 8.16E-08 | 2.17E-02 | |
| 20922 | 7G8 | H3 | L1.5 | Weak | Weak | |
| 20923 | 7G8 | H3 | L1.6 | 4.42E-06 | 3.89E-02 | |
| 20924 | 7G8 | H3 | L1.8 | 6.43E-08 | 1.41E-02 | |
| 20925 | 7G8 | H3.1 | L1.1 | 4.31E-08 | 5.78E-03 | |
| 20926 | 7G8 | H3.1 | L1.5 | 5.26E-08 | 5.85E-03 | |
| 20927 | 7G8 | H3.5 | L1.1 | 1.61E-06 | 7.44E-03 | |
| 20928 | 7G8 | H3.5 | L1.5 | 7.31E-08 | 6.77E-03 | |
| 20929 | 7G8 | H3 | L0 | 4.17E-08 | 3.08E-02 | |
| 20930 | 7G8 | H0 | L0 | 6.59E-08 | 6.10E-02 | |
| 20931 | 7G8 | H1 | L0 | 1.09E-07 | 3.18E-02 | |
| 20932 | 7G8 | H2 | L0 | 8.33E-08 | 6.28E-02 | |
| 20933 | 7G8 | H0.1 | L0 | 2.44E-08 | 2.70E-02 | |
| 20934 | 7G8 | H0.2 | L0 | 2.11E-08 | 2.05E-02 | |
| 20935 | 7G8 | H0.3 | L0 | 3.07E-08 | 1.43E-02 | |
| 20936 | 7G8 | H0.4 | L0 | 3.55E-08 | 3.29E-02 | |
| 20937 | 7G8 | H0.5 | L0 | 5.33E-08 | 3.46E-02 | |
| 20938 | 7G8 | H0.6 | L0 | 1.86E-08 | 2.48E-02 | |
| 20939 | 7G8 | H0.7 | L0 | 7.57E-08 | 9.20E-02 | |
| 20940 | 7G8 | H0.8 | L0 | 2.24E-08 | 3.65E-02 | |
| 20941 | 7G8 | H0.9 | L0 | 7.91E-08 | 1.16E-01 | |
| 20942 | 7G8 | H0.10 | L0 | 1.08E-07 | 1.05E-01 | |
| 20943 | 7G8 | H0.11 | L0 | 8.29E-08 | 1.15E-01 | |
| 20944 | 7G8 | H0.12 | L0 | 1.19E-06 | 3.47E-01 | |
| 20945 | 7G8 | H0.13 | L0 | 9.61E-08 | 1.03E-01 | |
| 20946 | 7G8 | H0.14 | L0 | 1.85E-07 | 2.53E-01 | |
| 20947 | 7G8 | H0.15 | L0 | 7.88E-08 | 1.99E-01 | |

FIGURE 56B

| XENP | Clone | VH | VL | KD (M) | kdis(1/s) | DSF $T_M$ (°C) |
|---|---|---|---|---|---|---|
| 20948 | 7G8 | H0.17 | L0 | 4.14E-08 | 5.74E-02 | |
| 20949 | 7G8 | H0.18 | L0 | 3.74E-08 | 4.05E-02 | |
| 20950 | 7G8 | H0.19 | L0 | 3.85E-08 | 3.85E-02 | |
| 20951 | 7G8 | H0.20 | L0 | 7.09E-08 | 9.98E-02 | |
| 20952 | 7G8 | H0.21 | L0 | 6.30E-08 | 3.75E-02 | |
| 20953 | 7G8 | H0.22 | L0 | 9.92E-08 | 5.17E-02 | |
| 20954 | 7G8 | H0.23 | L0 | 4.49E-08 | 2.71E-02 | |
| 20955 | 7G8 | H0.24 | L0 | Weak | Weak | |
| 20956 | 7G8 | H0.25 | L0 | 9.22E-08 | 6.99E-02 | |
| 20957 | 7G8 | H0.26 | L0 | 1.09E-07 | 1.18E-01 | |
| 20958 | 7G8 | H0.27 | L0 | 3.45E-08 | 5.35E-02 | |
| 20959 | 7G8 | H0.28 | L0 | 5.30E-08 | 5.63E-02 | |
| 20960 | 7G8 | H0.29 | L0 | 6.01E-08 | 4.73E-02 | |
| 20961 | 7G8 | H0.30 | L0 | 2.31E-08 | 2.00E-02 | |
| 20962 | 7G8 | H0.31 | L0 | 1.05E-08 | 1.29E-02 | |
| 20963 | 7G8 | H0.32 | L0 | 6.80E-08 | 5.77E-02 | |
| 20964 | 7G8 | H0.33 | L0 | 6.46E-08 | 1.61E-02 | |
| 20965 | 7G8 | H0.34 | L0 | 3.29E-08 | 1.77E-02 | |
| 20966 | 7G8 | H0.35 | L0 | 8.17E-08 | 1.70E-02 | |
| 20967 | 7G8 | H0.36 | L0 | 3.61E-07 | 1.49E-01 | |
| 20968 | 7G8 | H0.37 | L0 | 8.90E-08 | 1.33E-01 | |
| 20969 | 7G8 | H0.38 | L0 | 1.00E-07 | 1.66E-01 | |
| 20970 | 7G8 | H0.39 | L0 | 1.19E-07 | 1.62E-01 | |
| 20971 | 7G8 | H0.40 | L0 | 2.45E-07 | 1.49E-01 | |
| 20972 | 7G8 | H0.41 | L0 | 6.40E-08 | 1.48E-01 | |
| 20973 | 7G8 | H0.42 | L0 | 5.41E-08 | 1.17E-01 | |
| 20974 | 7G8 | H0.43 | L0 | 1.30E-06 | 4.23E-01 | |
| 20975 | 7G8 | H0.44 | L0 | 5.03E-07 | 2.47E-01 | |
| 20976 | 7G8 | H0.45 | L0 | 3.41E-08 | 5.79E-02 | |
| 20977 | 7G8 | H0.46 | L0 | 2.45E-08 | 4.35E-02 | |
| 20978 | 7G8 | H0.47 | L0 | 3.94E-08 | 3.73E-02 | |
| 20979 | 7G8 | H0.48 | L0 | 3.16E-08 | 3.07E-02 | |
| 20980 | 7G8 | H0.49 | L0 | 2.89E-08 | 2.66E-02 | |
| 20981 | 7G8 | H0.50 | L0 | 2.70E-08 | 2.71E-02 | |
| 20982 | 7G8 | H0.51 | L0 | 3.12E-08 | 3.57E-02 | |
| 20983 | 7G8 | H0.52 | L0 | 3.38E-08 | 2.95E-02 | |
| 20984 | 7G8 | H0.53 | L0 | 3.05E-08 | 2.31E-02 | |
| 20985 | 7G8 | H0.54 | L0 | 6.81E-08 | 5.02E-02 | |

FIGURE 56C

| XENP | Clone | VH | VL | KD (M) | kdis(1/s) | DSF $T_M$ (°C) |
|---|---|---|---|---|---|---|
| 20986 | 7G8 | H0.55 | L0 | 4.72E-08 | 4.53E-02 | |
| 20987 | 7G8 | H0.56 | L0 | 1.37E-07 | 1.06E-01 | |
| 20988 | 7G8 | H0.57 | L0 | 5.69E-08 | 4.86E-02 | |
| 20989 | 7G8 | H0.58 | L0 | 6.58E-08 | 6.12E-02 | |
| 20990 | 7G8 | H0.59 | L0 | 3.52E-07 | 8.60E-02 | |
| 20991 | 7G8 | H0.60 | L0 | 7.59E-08 | 6.07E-02 | |
| 20992 | 7G8 | H0.61 | L0 | 1.86E-06 | 2.22E-01 | |
| 20993 | 7G8 | H0.62 | L0 | 3.12E-08 | 3.17E-02 | |
| 20994 | 7G8 | H0.63 | L0 | 2.50E-07 | 1.67E-01 | |
| 20995 | 7G8 | H0.64 | L0 | 9.55E-08 | 6.47E-02 | |
| 20996 | 7G8 | H0.65 | L0 | 1.53E-06 | 2.43E-01 | |
| 21001 | 7G8 | H0.66 | L0 | 3.19E-06 | 1.47E-01 | |
| 21002 | 7G8 | H0.67 | L0 | 1.12E-06 | 3.70E-01 | |
| 21003 | 7G8 | H0.68 | L0 | 7.10E-06 | 3.57E-01 | |
| 21004 | 7G8 | H0.69 | L0 | 1.34E-07 | 1.39E-01 | |
| 21005 | 7G8 | H0.70 | L0 | 1.45E-07 | 8.55E-02 | |
| 21006 | 7G8 | H0.71 | L0 | 2.35E-08 | 2.46E-02 | |
| 21007 | 7G8 | H0.72 | L0 | 4.36E-08 | 4.93E-02 | |
| 21008 | 7G8 | H0.73 | L0 | 1.57E-07 | 8.04E-02 | |
| 21009 | 7G8 | H0.74 | L0 | 6.39E-08 | 5.12E-02 | |
| 21010 | 7G8 | H0.75 | L0 | 9.21E-08 | 8.34E-02 | |
| 21011 | 7G8 | H0.76 | L0 | 5.84E-08 | 8.50E-02 | |
| 21012 | 7G8 | H0.77 | L0 | 1.07E-07 | 6.84E-02 | |
| 21013 | 7G8 | H0.78 | L0 | 1.56E-07 | 9.33E-02 | |
| 21014 | 7G8 | H0.79 | L0 | 5.11E-08 | 5.02E-02 | |
| 21015 | 7G8 | H0.80 | L0 | 1.11E-07 | 6.42E-02 | |
| 21016 | 7G8 | H0.81 | L0 | 6.41E-08 | 7.22E-02 | |
| 21017 | 7G8 | H0.82 | L0 | 1.08E-07 | 1.12E-01 | |
| 21018 | 7G8 | H0.83 | L0 | 3.88E-08 | 5.32E-02 | |
| 21019 | 7G8 | H0.84 | L0 | 1.04E-07 | 1.06E-01 | |
| 21020 | 7G8 | H0.85 | L0 | 5.13E-08 | 5.55E-02 | |
| 21021 | 7G8 | H0.86 | L0 | 8.11E-08 | 8.50E-02 | |
| 21022 | 7G8 | H0.87 | L0 | 1.61E-07 | 1.14E-01 | |
| 21023 | 7G8 | H0.88 | L0 | 8.22E-08 | 9.43E-02 | |
| 21024 | 7G8 | H0.89 | L0 | 6.36E-08 | 9.23E-02 | |
| 21025 | 7G8 | H0.90 | L0 | 6.07E-08 | 6.79E-02 | |
| 21026 | 7G8 | H0.91 | L0 | 8.91E-08 | 9.16E-02 | |
| 21027 | 7G8 | H0.92 | L0 | 7.61E-08 | 7.27E-02 | |

FIGURE 56D

| XENP | Clone | VH | VL | KD (M) | kdis(1/s) | DSF $T_M$ (°C) |
|---|---|---|---|---|---|---|
| 21028 | 7G8 | H0.93 | L0 | 6.69E-08 | 6.88E-02 | |
| 21029 | 7G8 | H0.94 | L0 | 9.67E-08 | 2.04E-01 | |
| 21030 | 7G8 | H0.95 | L0 | 3.11E-08 | 3.15E-02 | |
| 21031 | 7G8 | H0.96 | L0 | 3.74E-08 | 3.89E-02 | |
| 21032 | 7G8 | H0.97 | L0 | 4.45E-08 | 3.44E-02 | |
| 21033 | 7G8 | H0.98 | L0 | 3.64E-08 | 2.58E-02 | |
| 21034 | 7G8 | H0.99 | L0 | 2.23E-08 | 1.77E-02 | |
| 21035 | 7G8 | H0.100 | L0 | 3.37E-08 | 2.26E-02 | |
| 21036 | 7G8 | H0.101 | L0 | 2.27E-08 | 1.79E-02 | |
| 21037 | 7G8 | H0.102 | L0 | 1.64E-08 | 1.84E-02 | |
| 21038 | 7G8 | H0.103 | L0 | 1.09E-08 | 1.03E-02 | |
| 21039 | 7G8 | H0.104 | L0 | 7.96E-08 | 4.16E-01 | |
| 21040 | 7G8 | H0.105 | L0 | 3.54E-08 | 2.87E-02 | |
| 21041 | 7G8 | H0.106 | L0 | 5.76E-08 | 3.36E-01 | |
| 21042 | 7G8 | H0.107 | L0 | 5.06E-08 | 3.82E-02 | |
| 21043 | 7G8 | H0.110 | L0 | 1.16E-07 | 4.05E-02 | |
| 21044 | 7G8 | H0.111 | L0 | 2.33E-07 | 2.48E-01 | |
| 21045 | 7G8 | H0.112 | L0 | 4.31E-07 | 5.82E-01 | |
| 21046 | 7G8 | H0.114 | L0 | 4.20E-08 | 7.45E-02 | |
| 21047 | 7G8 | H0.115 | L0 | 6.98E-08 | 7.11E-02 | |
| 21048 | 7G8 | H0.116 | L0 | 3.52E-08 | 3.42E-02 | |
| 21049 | 7G8 | H0.117 | L0 | 8.34E-07 | 2.83E-01 | |
| 21050 | 7G8 | H0.118 | L0 | 1.50E-07 | 1.23E-01 | |
| 21051 | 7G8 | H0.119 | L0 | 2.71E-08 | 4.85E-02 | |
| 21052 | 7G8 | H0.120 | L0 | 8.60E-08 | 7.91E-02 | |
| 21053 | 7G8 | H0.121 | L0 | 1.92E-07 | 3.86E-01 | |
| 21054 | 7G8 | H0.122 | L0 | 4.63E-08 | 2.90E-02 | |
| 21055 | 7G8 | H0.123 | L0 | 6.45E-07 | 1.88E-01 | |
| 21056 | 7G8 | H0.124 | L0 | 2.15E-07 | 2.02E-01 | |
| 21057 | 7G8 | H0.125 | L0 | 9.51E-07 | 1.77E-01 | |
| 21058 | 7G8 | H0.126 | L0 | 3.12E-07 | 1.44E-01 | |
| 21059 | 7G8 | H0.127 | L0 | 1.35E-07 | 1.43E-01 | |
| 21060 | 7G8 | H0.128 | L0 | 1.34E-07 | 1.68E-01 | |
| 21061 | 7G8 | H0.129 | L0 | 1.17E-08 | 1.53E-02 | |
| 21062 | 7G8 | H0.130 | L0 | 1.24E-07 | 9.49E-02 | |
| 21063 | 7G8 | H0.131 | L0 | 1.44E-07 | 6.58E-01 | |
| 21064 | 7G8 | H0.132 | L0 | 3.56E-05 | 2.33E-02 | |
| 21065 | 7G8 | H0.134 | L0 | <1.0E-12 | <1.0E-07 | |

FIGURE 56E

| XENP | Clone | VH | VL | KD (M) | kdis(1/s) | DSF T$_M$ (°C) |
|---|---|---|---|---|---|---|
| 21066 | 7G8 | H0.141 | L0 | 1.11E-07 | 2.25E-01 | |
| 21067 | 7G8 | H0.142 | L0 | 6.72E-08 | 8.34E-02 | |
| 21068 | 7G8 | H0.143 | L0 | 2.35E-07 | 2.77E-01 | |
| 21069 | 7G8 | H0.145 | L0 | 6.09E-08 | 6.17E-02 | |
| 21070 | 7G8 | H0.146 | L0 | 5.40E-08 | 9.04E-02 | |
| 21071 | 7G8 | H0.147 | L0 | 5.53E-07 | 3.88E-01 | |
| 21072 | 7G8 | H0.148 | L0 | 2.10E-07 | 1.79E-01 | |
| 21074 | 7G8 | H0 | L0.1 | 9.61E-08 | 1.30E-01 | |
| 21075 | 7G8 | H0 | L0.2 | 8.81E-08 | 9.74E-02 | |
| 21076 | 7G8 | H0 | L0.3 | 1.86E-07 | 2.70E-01 | |
| 21077 | 7G8 | H0 | L0.4 | 1.09E-07 | 1.76E-01 | |
| 21078 | 7G8 | H0 | L0.5 | 4.48E-08 | 4.49E-01 | |
| 21079 | 7G8 | H0 | L0.6 | 1.28E-07 | 1.39E-01 | |
| 21080 | 7G8 | H0 | L0.7 | 5.79E-06 | 7.16E-02 | |
| 21081 | 7G8 | H0 | L0.8 | 1.16E-07 | 4.00E-01 | |
| 21082 | 7G8 | H0 | L0.9 | 8.20E-06 | 1.43E-01 | |
| 21083 | 7G8 | H0 | L0.10 | 6.42E-08 | 1.08E-01 | |
| 21084 | 7G8 | H0 | L0.11 | 2.70E-08 | 2.64E-02 | |
| 21085 | 7G8 | H0 | L0.12 | 6.51E-08 | 7.19E-02 | |
| 21086 | 7G8 | H0 | L0.13 | 7.75E-08 | 1.04E-01 | |
| 21087 | 7G8 | H0 | L0.14 | 1.19E-07 | 2.90E-01 | |
| 21088 | 7G8 | H0 | L0.15 | 1.57E-07 | 3.83E-01 | |
| 21089 | 7G8 | H0 | L0.16 | 0.00E+00 | <1.0E-07 | |
| 21090 | 7G8 | H0 | L0.17 | 2.80E-07 | 3.17E-01 | |
| 21091 | 7G8 | H0 | L0.18 | 6.26E-05 | 2.72E+01 | |
| 21092 | 7G8 | H0 | L0.19 | 1.27E-06 | 2.47E-01 | |
| 21093 | 7G8 | H0 | L0.20 | 5.16E-08 | 7.64E-02 | |
| 21094 | 7G8 | H0 | L0.21 | 5.43E-08 | 8.04E-02 | |
| 21095 | 7G8 | H0 | L0.22 | 1.06E-07 | 1.33E-01 | |
| 21096 | 7G8 | H0 | L0.23 | 5.58E-08 | 1.71E-01 | |
| 21101 | 7G8 | H0 | L0.24 | 4.43E-08 | 1.79E-01 | |
| 21102 | 7G8 | H0 | L0.25 | 6.10E-08 | 1.51E-01 | |
| 21103 | 7G8 | H0 | L0.26 | 7.99E-08 | 1.48E-01 | |
| 21104 | 7G8 | H0 | L0.27 | 5.62E-08 | 1.35E-01 | |
| 21105 | 7G8 | H0 | L0.28 | 7.77E-08 | 9.49E-02 | |
| 21106 | 7G8 | H0 | L0.29 | 7.83E-08 | 5.16E-02 | |
| 21107 | 7G8 | H0 | L0.30 | 5.72E-08 | 4.66E-02 | |
| 21108 | 7G8 | H0 | L0.31 | 1.05E-07 | 4.67E-02 | |

FIGURE 56F

| XENP | Clone | VH | VL | KD (M) | kdis(1/s) | DSF $T_M$ (°C) |
|---|---|---|---|---|---|---|
| 21109 | 7G8 | H0 | L0.32 | 4.68E-08 | 4.50E-02 | |
| 21110 | 7G8 | H0 | L0.33 | 6.87E+05 | 4.23E+08 | |
| 21111 | 7G8 | H0 | L0.34 | 2.75E-08 | 2.68E-02 | |
| 21112 | 7G8 | H0 | L0.35 | 9.77E-08 | 8.71E-02 | |
| 21113 | 7G8 | H0 | L0.36 | 1.20E-07 | 6.11E-02 | |
| 21114 | 7G8 | H0 | L0.37 | 3.00E-08 | 3.15E-02 | |
| 21115 | 7G8 | H0 | L0.38 | 1.12E-07 | 7.85E-02 | |
| 21116 | 7G8 | H0 | L0.39 | 3.17E-08 | 5.71E-02 | |
| 21117 | 7G8 | H0 | L0.40 | 2.27E-07 | 7.01E-01 | |
| 21118 | 7G8 | H0 | L0.41 | 8.48E-08 | 1.31E-01 | |
| 21119 | 7G8 | H0 | L0.42 | 2.50E-10 | 4.30E-03 | |
| 21120 | 7G8 | H0 | L0.43 | 2.39E-07 | 2.12E-01 | |
| 21121 | 7G8 | H0 | L0.44 | 2.46E-06 | 1.14E-01 | |
| 21122 | 7G8 | H0 | L0.45 | 1.75E-07 | 5.49E-01 | |
| 21123 | 7G8 | H0 | L0.46 | 2.60E-06 | 3.50E-01 | |
| 21124 | 7G8 | H0 | L0.47 | 6.27E-08 | 5.49E-02 | |
| 21125 | 7G8 | H0 | L0.48 | 3.15E-08 | 3.71E-02 | |
| 21126 | 7G8 | H0 | L0.49 | 5.22E-08 | 5.09E-02 | |
| 21127 | 7G8 | H0 | L0.50 | 4.37E-08 | 3.69E-02 | |
| 21128 | 7G8 | H0 | L0.51 | 2.23E-09 | 1.89E-02 | |
| 21129 | 7G8 | H0 | L0.52 | 5.88E-08 | 9.73E-02 | |
| 21130 | 7G8 | H0 | L0.53 | 3.55E-08 | 3.99E-02 | |
| 21131 | 7G8 | H0 | L0.54 | 8.64E-08 | 1.08E-01 | |
| 21132 | 7G8 | H0 | L0.55 | Weak | Weak | |
| 21133 | 7G8 | H0 | L0.56 | 6.02E-07 | 2.78E-01 | |
| 21134 | 7G8 | H0 | L0.57 | 3.63E-08 | 3.47E-02 | |
| 21135 | 7G8 | H0 | L0.58 | 1.65E-07 | 9.58E-02 | |
| 21136 | 7G8 | H0 | L0.59 | 2.27E-08 | 2.30E-02 | |
| 21137 | 7G8 | H0 | L0.60 | 2.65E-08 | 3.61E-02 | |
| 21138 | 7G8 | H0 | L0.61 | 9.30E-08 | 1.32E-01 | |
| 21139 | 7G8 | H0 | L0.62 | 2.91E-08 | 3.44E-02 | |
| 21140 | 7G8 | H0 | L0.63 | 3.40E-08 | 3.40E-02 | |
| 21141 | 7G8 | H0 | L0.64 | 3.69E-08 | 2.72E-02 | |
| 21142 | 7G8 | H0 | L0.65 | 3.09E-08 | 4.10E-02 | |
| 21143 | 7G8 | H0 | L0.66 | 7.34E-08 | 1.20E-01 | |
| 21144 | 7G8 | H0 | L0.67 | 1.26E-07 | 6.24E-02 | |
| 21145 | 7G8 | H0 | L0.68 | 8.99E-08 | 3.43E-01 | |
| 21146 | 7G8 | H0 | L0.69 | 5.94E-08 | 2.05E-01 | |

FIGURE 56G

| XENP | Clone | VH | VL | KD (M) | kdis(1/s) | DSF $T_M$ (°C) |
|---|---|---|---|---|---|---|
| 21147 | 7G8 | H0 | L0.70 | 4.22E-08 | 8.54E-02 | |
| 21148 | 7G8 | H0 | L0.71 | 1.79E-07 | 2.51E-01 | |
| 21149 | 7G8 | H0 | L0.72 | 1.23E-07 | 2.35E-01 | |
| 21150 | 7G8 | H0 | L0.73 | 7.55E-08 | 1.58E-01 | |
| 21151 | 7G8 | H0 | L0.74 | 1.64E-07 | 1.84E-01 | |
| 21152 | 7G8 | H0 | L0.75 | 9.32E-08 | 1.42E-01 | |
| 21153 | 7G8 | H0 | L0.76 | Weak | Weak | |
| 21154 | 7G8 | H0 | L0.77 | 1.87E-07 | 8.91E-02 | |
| 21155 | 7G8 | H0 | L0.78 | 2.94E-07 | 4.70E-02 | |
| 21156 | 7G8 | H0 | L0.79 | Weak | Weak | |
| 21157 | 7G8 | H0 | L0.80 | Weak | Weak | |
| 21158 | 7G8 | H0 | L0.81 | Weak | Weak | |
| 21159 | 7G8 | H0 | L0.82 | 6.04E-07 | 4.40E-01 | |
| 21160 | 7G8 | H0 | L0.83 | 6.50E-08 | 3.50E-02 | |
| 21161 | 7G8 | H0 | L0.84 | 3.52E-06 | 1.08E-01 | |
| 21162 | 7G8 | H0 | L0.85 | 9.89E-08 | 4.37E-02 | |
| 21163 | 7G8 | H0 | L0.86 | 4.90E-08 | 4.85E-02 | |
| 21164 | 7G8 | H0 | L0.87 | 1.25E-07 | 1.41E-01 | |
| 21165 | 7G8 | H0 | L0.88 | 1.90E-07 | 1.87E-01 | |
| 21166 | 7G8 | H0 | L0.89 | 3.52E-06 | 6.60E-02 | |
| 21167 | 7G8 | H0 | L0.90 | 2.54E-08 | 2.01E-02 | |
| 21168 | 7G8 | H0 | L0.91 | 1.12E-06 | 1.99E-01 | |
| 21169 | 7G8 | H0 | L0.92 | 1.20E-07 | 7.65E-02 | |
| 21170 | 7G8 | H0 | L0.93 | 4.81E-08 | 5.41E-02 | |
| 21171 | 7G8 | H0 | L0.94 | 6.64E-07 | 1.82E-01 | |
| 21172 | 7G8 | H0 | L0.95 | 7.61E-08 | 8.11E-02 | |
| 21173 | 7G8 | H0 | L0.96 | 7.95E-07 | 8.67E-02 | |
| 21174 | 7G8 | H0 | L0.97 | 6.75E-08 | 6.60E-02 | |
| 21175 | 7G8 | H0 | L0.98 | 6.19E-08 | 4.49E-02 | |
| 21176 | 7G8 | H0 | L0.99 | 3.97E-08 | 4.14E-02 | |
| 21177 | 7G8 | H0 | L0.100 | 8.53E-08 | 5.75E-02 | |
| 21178 | 7G8 | H0 | L0.101 | 3.33E-07 | 1.95E+00 | |
| 21179 | 7G8 | H0 | L0.102 | 1.04E-07 | 2.79E-01 | |
| 21180 | 7G8 | H0 | L0.103 | 1.50E-07 | 2.14E+01 | |
| 21181 | 7G8 | H0 | L0.104 | 6.11E+16 | 2.82E+26 | |
| 21182 | 7G8 | H0 | L0.105 | Weak | Weak | |
| 21183 | 7G8 | H0 | L0.106 | 3.27E-06 | 7.92E-02 | |
| 21184 | 7G8 | H0 | L0.107 | Weak | Weak | |

FIGURE 56H

| XENP | Clone | VH | VL | KD (M) | kdis(1/s) | DSF $T_M$ (°C) |
|---|---|---|---|---|---|---|
| 21558 | 7G8 | H3.1 | L0.59 | 7.44E-09 | 4.35E-03 | |
| 21559 | 7G8 | H3.4 | L0.59 | 6.72E-09 | 4.71E-03 | |
| 21560 | 7G8 | H0.129 | L0.59 | 7.05E-09 | 6.94E-03 | |
| 21561 | 7G8 | H0.31 | L0.59 | 6.39E-09 | 6.75E-03 | |
| 21562 | 7G8 | H0.103 | L0.59 | 3.09E-08 | 5.24E-03 | |
| 21563 | 7G8 | H0.71 | L0.59 | 7.04E-09 | 7.48E-03 | |
| 21564 | 7G8 | H3.1 | L0 | 6.73E-09 | 6.58E-03 | |
| 21565 | 7G8 | H3.4 | L0 | 8.47E-09 | 8.54E-03 | |
| 21566 | 7G8 | H3.1 | L0.11 | 4.56E-08 | 3.76E-02 | |
| 21567 | 7G8 | H3.4 | L0.11 | 5.84E-08 | 4.23E-02 | |
| 21568 | 7G8 | H0.129 | L0.11 | 1.26E-07 | 8.67E-02 | |
| 21569 | 7G8 | H3.1 | L0.34 | 1.05E-08 | 7.33E-03 | |
| 21570 | 7G8 | H3.4 | L0.34 | 1.13E-08 | 9.28E-03 | |
| 21571 | 7G8 | H0.129 | L0.34 | 1.33E-08 | 1.29E-02 | |
| 21662 | 7G8 | H3.18 | L1 | 3.04E-09 | 3.04E-03 | |
| 21663 | 7G8 | H3.15 | L1 | 3.50E-09 | 2.64E-03 | |
| 21664 | 7G8 | H3.19 | L1 | 7.41E-09 | 7.68E-03 | |
| 21665 | 7G8 | H3.17 | L1 | 4.07E-09 | 3.47E-03 | |
| 21666 | 7G8 | H3.16 | L1 | 1.63E-08 | 4.73E-03 | |
| 21667 | 7G8 | H3.21 | L1 | 8.57E-09 | 2.33E-03 | |
| 21668 | 7G8 | H3.22 | L1 | | | |
| 21669 | 7G8 | H3.23 | L1 | 4.10E-09 | 3.88E-03 | |
| 21670 | 7G8 | H3.18 | L1.11 | 2.88E-09 | 2.39E-03 | 54.5 |
| 21671 | 7G8 | H3.15 | L1.11 | 2.76E-09 | 2.48E-03 | |
| 21672 | 7G8 | H3.19 | L1.11 | 4.23E-09 | 4.54E-03 | |
| 21673 | 7G8 | H3.17 | L1.11 | 3.75E-09 | 2.73E-03 | |
| 21674 | 7G8 | H3.16 | L1.11 | 1.16E-08 | 3.38E-03 | |
| 21675 | 7G8 | H3.21 | L1.11 | 9.61E-09 | 2.05E-03 | |
| 21676 | 7G8 | H3.22 | L1.11 | | | |
| 21677 | 7G8 | H3.23 | L1.11 | 2.83E-09 | 2.29E-03 | |
| 21678 | 7G8 | H3.18 | L1.13 | 6.65E-09 | 5.02E-03 | |
| 21679 | 7G8 | H3.15 | L1.13 | 8.37E-09 | 4.87E-03 | |
| 21680 | 7G8 | H3.19 | L1.13 | 1.70E-08 | 9.72E-03 | |
| 21681 | 7G8 | H3.17 | L1.13 | 1.19E-08 | 7.68E-03 | |
| 21682 | 7G8 | H3.16 | L1.13 | 2.95E-08 | 1.38E-02 | |
| 21683 | 7G8 | H3.21 | L1.13 | 1.10E-08 | 5.13E-03 | |
| 21684 | 7G8 | H3.22 | L1.13 | | | |
| 21685 | 7G8 | H3.23 | L1.13 | 1.02E-08 | 7.76E-03 | |

FIGURE 56I

| XENP | Clone | VH | VL | KD (M) | kdis(1/s) | DSF $T_M$ (°C) |
|---|---|---|---|---|---|---|
| 21686 | 7G8 | H3.18 | L1.15 | 9.47E-09 | 7.62E-03 | |
| 21687 | 7G8 | H3.15 | L1.15 | 2.04E-08 | 7.79E-03 | |
| 21688 | 7G8 | H3.19 | L1.15 | 1.75E-08 | 1.04E-02 | |
| 21689 | 7G8 | H3.17 | L1.15 | 2.19E-08 | 1.21E-02 | |
| 21690 | 7G8 | H3.16 | L1.15 | 9.19E-08 | 9.61E-03 | |
| 21691 | 7G8 | H3.21 | L1.15 | 2.34E-08 | 8.44E-03 | |
| 21692 | 7G8 | H3.22 | L1.15 | 2.12E-08 | 1.31E-02 | |
| 21693 | 7G8 | H3.23 | L1.15 | 8.80E-09 | 6.46E-03 | |
| 21694 | 7G8 | H3 | L1.9 | 3.14E-07 | 1.16E-01 | |
| 21695 | 7G8 | H3 | L1.10 | 8.99E-08 | 3.06E-02 | |
| 21696 | 7G8 | H3 | L1.11 | 4.10E-08 | 1.48E-02 | |
| 21701 | 7G8 | H3 | L1.12 | 4.12E-06 | 2.07E-01 | |
| 21702 | 7G8 | H3 | L1.13 | 2.91E-07 | 8.61E-02 | |
| 21703 | 7G8 | H3 | L1.14 | 1.34E-07 | 2.39E-02 | |
| 21704 | 7G8 | H3 | L1.15 | 1.08E-06 | 3.49E-01 | |
| 21742 | 7G8 | H3.11 | L1.13 | 1.85E-08 | 1.25E-02 | |
| 21743 | 7G8 | H3.4 | L1.13 | 2.90E-08 | 2.04E-02 | |
| 21744 | 7G8 | H3.1 | L1.13 | 4.92E-08 | 1.89E-02 | |
| 21745 | 7G8 | H3.11 | L1.15 | 1.84E-08 | 1.33E-02 | |
| 21746 | 7G8 | H3.4 | L1.15 | 4.31E-08 | 1.71E-02 | |
| 21747 | 7G8 | H3.1 | L1.15 | 2.69E-07 | 0.0364 | |
| 21889 | 7G8 | H3.27 | L1 | 2.48E-09 | 3.04E-03 | |
| 21890 | 7G8 | H3.27 | L1.11 | 2.20E-09 | 1.81E-03 | |
| 21891 | 7G8 | H3.27 | L1.13 | 5.02E-09 | 5.79E-03 | |
| 21892 | 7G8 | H3.28 | L1 | 3.55E-09 | 4.33E-03 | |
| 21893 | 7G8 | H3.28 | L1.11 | 2.10E-09 | 2.67E-03 | |
| 21894 | 7G8 | H3.28 | L1.13 | 6.83E-09 | 7.95E-03 | |
| 22379 | 7G8 | H3.29 | L1.11 | | | |
| 22380 | 7G8 | H3.30 | L1.11 | 2.07E-09 | 2.11E-03 | 59.5 |
| 22381 | 7G8 | H3.31 | L1.11 | 6.94E-09 | 6.82E-03 | |
| 22382 | 7G8 | H3.32 | L1.11 | | | |
| 22383 | 7G8 | H3.33 | L1.11 | 6.00E-09 | 5.14E-03 | 62.5 |
| 22384 | 7G8 | H3.34 | L1.11 | 9.12E-09 | 2.43E-03 | 55.0 |
| 22385 | 7G8 | H3.35 | L1.11 | 3.18E-09 | 2.66E-03 | 56.0 |
| 22386 | 7G8 | H3.36 | L1.11 | | | |
| 22387 | 7G8 | H3.37 | L1.11 | | | |
| 22388 | 7G8 | H3.38 | L1.11 | | | |
| 22389 | 7G8 | H3.39 | L1.11 | 3.57E-09 | 2.54E-03 | |

FIGURE 56J

| XENP | Clone | VH | VL | KD (M) | kdis(1/s) | DSF $T_M$ (°C) |
|---|---|---|---|---|---|---|
| 22390 | 7G8 | H3.40 | L1.11 | | | |
| 22391 | 7G8 | H3.41 | L1.11 | | | |
| 22392 | 7G8 | H3.42 | L1.11 | | | |
| 22393 | 7G8 | H3.43 | L1.11 | | | |
| 22394 | 7G8 | H3.44 | L1.11 | | | |
| 22395 | 7G8 | H3.45 | L1.11 | | | |
| 22396 | 7G8 | H3.46 | L1.11 | | | |
| 22401 | 7G8 | H3.47 | L1.11 | 3.50E-09 | 2.68E-03 | |
| 22402 | 7G8 | H3.48 | L1.11 | | | |
| 22403 | 7G8 | H3.49 | L1.11 | 2.37E-09 | 2.85E-03 | 55.0 |
| 22404 | 7G8 | H3.50 | L1.11 | | | |
| 22405 | 7G8 | H3.51 | L1.11 | | | |
| 22406 | 7G8 | H3.52 | L1.11 | | | |
| 22407 | 7G8 | H3.53 | L1.11 | | | |
| 22408 | 7G8 | H3.18 | L1.16 | 2.83E-09 | 3.27E-03 | 58.0 |
| 22409 | 7G8 | H3.18 | L1.17 | 3.04E-09 | 3.25E-03 | 56.0 |
| 22410 | 7G8 | H3.18 | L1.18 | | | |
| 22411 | 7G8 | H3.18 | L1.19 | | | |
| 22412 | 7G8 | H3.18 | L1.20 | | | |
| 22413 | 7G8 | H3.18 | L1.21 | | | |
| 22414 | 7G8 | H3.18 | L1.22 | | | |
| 22415 | 7G8 | H3.18 | L1.23 | | | |
| 22416 | 7G8 | H3.18 | L1.24 | | | |
| 22417 | 7G8 | H3.18 | L1.25 | | | |
| 22418 | 7G8 | H3.18 | L1.26 | | | |
| 22419 | 7G8 | H3.18 | L1.27 | | | |
| 22420 | 7G8 | H3.18 | L1.28 | 2.36E-09 | 2.55E-03 | |
| 22421 | 7G8 | H3.18 | L1.29 | | | |
| 22422 | 7G8 | H3.18 | L1.30 | 1.95E-09 | 3.13E-03 | 63.0 |
| 22423 | 7G8 | H3.18 | L1.31 | 2.65E-09 | 2.84E-03 | |
| 22424 | 7G8 | H3.18 | L1.32 | 2.98E-09 | 2.95E-03 | |
| 22425 | 7G8 | H3.18 | L1.33 | | | |
| 22582 | 7G8 | H3.30 | L1.30 | 2.34E-09 | 2.03E-03 | 67.5 |
| 22583 | 7G8 | H3.33 | L1.30 | 4.51E-09 | 3.15E-03 | 68.5 |
| 22588 | 7G8 | H3.54 | L1.30 | 8.45E-10 | 2.18E-03 | 65.5 |
| 22589 | 7G8 | H3.55 | L1.30 | 2.86E-09 | 4.56E-03 | 67.5 |
| 22590 | 7G8 | H3.56 | L1.30 | 4.85E-08 | 1.55E-03 | 66.5 |
| 22591 | 7G8 | H3.57 | L1.30 | 3.24E-09 | 3.45E-03 | 68.5 |

FIGURE 56K

| XENP | Clone | VH | VL | KD (M) | kdis(1/s) | DSF $T_M$ (°C) |
|---|---|---|---|---|---|---|
| 22592 | 7G8 | H3.58 | L1.30 | 1.97E-09 | 2.31E-03 | 67.0 |
| 22593 | 7G8 | H3.59 | L1.30 | 3.54E-09 | 3.88E-03 | 69.0 |
| 22594 | 7G8 | H3.30 | L1.34 | 6.30E-10 | 1.48E-03 | 68.5 |
| 22595 | 7G8 | H3.30 | L1.36 | 2.86E-09 | 2.86E-03 | 69.5 |
| 22596 | 7G8 | H3.33 | L1.34 | 3.45E-09 | 3.02E-03 | 68.5 |
| 22601 | 7G8 | H3.33 | L1.36 | 1.09E-08 | 6.95E-03 | 70.0 |

FIGURE 57A

| XENP | Fab side (Anti-LAG-3) | scFv side (Anti-CTLA-4) | Human LAG-3 KD (M) |
|---|---|---|---|
| 22518 | 2A11_H1.144_L2.133 | [CTLA-4]_H3.23_L0.129 | 1.7E-09 |
| 22506 | 2A11_H1.144_L2.113 | [CTLA-4]_H3.23_L0.129 | 2.0E-10 |
| 22505 | 2A11_H1.125_L2.113 | [CTLA-4]_H3.23_L0.129 | 4.0E-10 |
| 22509 | 2A11_H1_L2.113 | [CTLA-4]_H3.23_L0.129 | 7.8E-10 |
| 20444 | 2A11_H1L2 | [CTLA-4]_H3.23_L0.129 | 3.5E-09 |
| 21859 | 2A11_H1_L2.47 | [CTLA-4]_H3.23_L0.129 | 3.5E-10 |
| 21860 | 2A11_H1_L2.50 | [CTLA-4]_H3.23_L0.129 | 1.2E-09 |
| 22507 | 2A11_H1.117_L2.116 | [CTLA-4]_H3.23_L0.129 | 6.2E-10 |
| 22508 | 2A11_H1.144_L2 | [CTLA-4]_H3.23_L0.129 | 1.2E-09 |
| 22510 | 2A11_H1_L2.25 | [CTLA-4]_H3.23_L0.129 | 2.3E-08 |
| 22630 | 2A11_H1.144_L2.137 | [CTLA-4]_H3.23_L0.129 | 9.4E-10 |

FIGURE 57B

| XENP | Fab side (Anti-LAG-3) | scFv side (Anti-CTLA-4) | human LAG-3 KD (nM) |
|---|---|---|---|
| 20833 | 7G8_H3L1 | [CTLA-4]_H3.23_L0.129 | 9.1 |
| 21895 | 7G8_H3.18_L1 | [CTLA-4]_H3.23_L0.129 | 1.1 |
| 21896 | 7G8_H3.18_L1.11 | [CTLA-4]_H3.23_L0.129 | 1.0 |
| 21901 | 7G8_H3.15_L1.11 | [CTLA-4]_H3.23_L0.129 |  |
| 21902 | 7G8_H3.23_L1.11 | [CTLA-4]_H3.23_L0.129 | 1.1 |
| 21903 | 7G8_H3.18_L1.13 | [CTLA-4]_H3.23_L0.129 | 2.2 |
| 21904 | 7G8_H3.28_L1 | [CTLA-4]_H3.23_L0.129 | 1.7 |
| 21905 | 7G8_H3.28_L1.11 | [CTLA-4]_H3.23_L0.129 | 1.1 |
| 21906 | 7G8_H3.28_L1.13 | [CTLA-4]_H3.23_L0.129 | 2.1 |
| 22555 | 7G8_H3.30_L1.11 | [CTLA-4]_H3.23_L0.129 | 1.2 |
| 22556 | 7G8_H3.33_L1.11 | [CTLA-4]_H3.23_L0.129 | 2.6 |
| 22557 | 7G8_H3.18_L1.30 | [CTLA-4]_H3.23_L0.129 | 0.7 |
| 22558 | 7G8_H3.30_L1.30 | [CTLA-4]_H3.23_L0.129 | 0.3 |
| 22559 | 7G8_H3.33_L1.30 | [CTLA-4]_H3.23_L0.129 | 1.6 |
| 22602 | 7G8_H3.30_L1.34 | [CTLA-4]_H3.23_L0.129 | 0.2 |
| 22603 | 7G8_H3.30_L1.36 | [CTLA-4]_H3.23_L0.129 | 0.4 |

FIGURE 62A

| XENP | Fab side (anti-LAG-3) | scFv side (anti-PD-1) | Human LAG-3 KD (M) |
|---|---|---|---|
| 20206 | 2A11_H1L2 | 1G6 L1.194_H1.279 | 2.2E-09 |
| 21584 | 2A11_H1_L2.93 | 1G6 L1.194_H1.279 | 1.4E-08 |
| 22123 | 2A11_H1_L2.122 | 1G6 L1.194_H1.279 | 1.9E-08 |
| 22125 | 2A11_H1_L2.124 | 1G6 L1.194_H1.279 | 2.0E-08 |
| 21582 | 2A11_H1_L2.91 | 1G6 L1.194_H1.279 | 6.2E-09 |
| 22627 | 2A11_H1.144_L2.133 | 1G6 L1.194_H1.279 | 3.8E-10 |
| 22628 | 2A11_H1.125_L2.113 | 1G6 L1.194_H1.279 | <1.0E-12 |
| 22629 | 2A11_H1.144_L2.113 | 1G6 L1.194_H1.279 | 4.4E-11 |

FIGURE 62B

| XENP | Fab side (anti-LAG-3) | scFv side (anti-PD-1) | Human LAG-3 KD (nM) |
|---|---|---|---|
| 22521 | 7G8_H3.18_L1.11 | 1G6_L1.194_H1.279 | NT |
| 22522 | 7G8_H3.28_L1.13 | 1G6_L1.194_H1.279 | NT |
| 22565 | 7G8_H3.30_L1.11 | 1G6_L1.194_H1.279 | NT |
| 22566 | 7G8_H3.33_L1.11 | 1G6_L1.194_H1.279 | NT |
| 22567 | 7G8_H3.18_L1.30 | 1G6_L1.194_H1.279 | 1.0 |
| 22568 | 7G8_H3.30_L1.30 | 1G6_L1.194_H1.279 | 0.3 |
| 22569 | 7G8_H3.33_L1.30 | 1G6_L1.194_H1.279 | 1.5 |
| 22604 | 7G8_H3.30_L1.34 | 1G6_L1.194_H1.279 | 0.5 |
| 22605 | 7G8_H3.30_L1.36 | 1G6_L1.194_H1.279 | 0.5 |

The results shown are based upon data generated by the TCGA Research Network:
http://cancergenome.nih.gov/

**p ≤ 0.01
*p ≤ 0.05

Study #1

FIGURE 76C      FIGURE 76D
Study #2
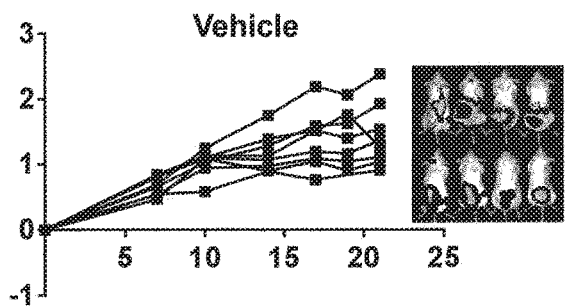
Vehicle
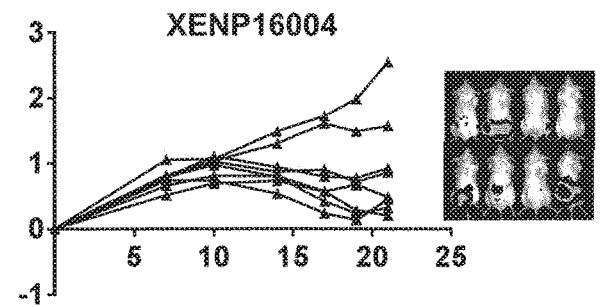
XENP16004
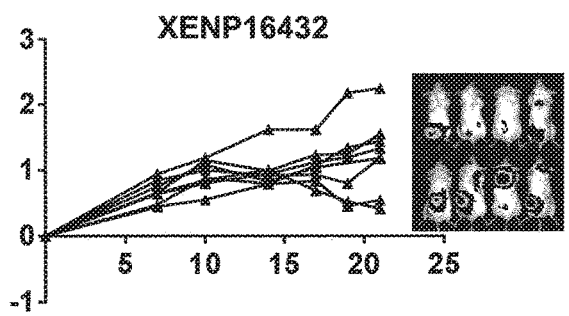
XENP16432
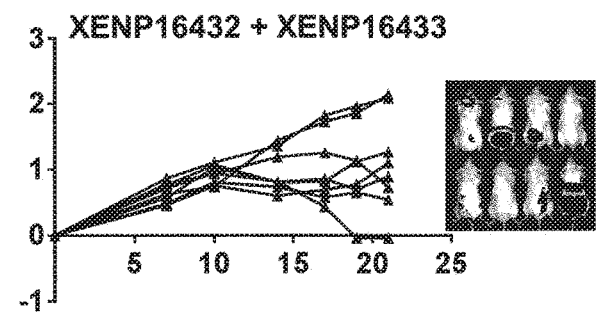
XENP16432 + XENP16433

BISPECIFIC CHECKPOINT INHIBITOR ANTIBODIES

CROSS REFERENCE TO RELATED APPLICATIONS

This application claims priority to U.S. Provisional Patent Application No. 62/350,145, filed Jun. 14, 2016, U.S. Provisional Patent Application No. 62/353,511, filed Jun. 22, 2016 and U.S. Provisional Patent Application No. 62/420,500, filed Nov. 10, 2016, the contents of which are expressly fully incorporated by reference in their entirety.

SEQUENCE LISTING

The instant application contains a Sequence Listing which has been submitted electronically in ASCII format and is hereby incorporated by reference in its entirety. Said ASCII copy, created on Oct. 10, 2017, is named 067461-5191-WO_SUBSTITUTE_SEQUENCE_LISTING.TEXT and is 33,716,785 kilobytes in size.

BACKGROUND OF THE INVENTION

Checkpoint receptors such as CTLA-4, PD-1 (programmed cell death 1), TIM-3 (T cell immunoglobulin and mucin domain 3), LAG-3 (lymphocyte-activation gene 3), TIGIT (T cell immunoreceptor with Ig and ITIM domains), and others, inhibit the activation, proliferation, and/or effector activities of T cells and other cell types. Guided by the hypothesis that checkpoint receptors suppress the endogenous T cell response against tumor cells, preclinical and clinical studies of anti-CTLA4 and anti-PD1 antibodies, including nivolumab, pembrolizumab, ipilimumab, and tremelimumab, have indeed demonstrated that checkpoint blockade results in impressive anti-tumor responses, stimulating endogenous T cells to attack tumor cells, leading to long-term cancer remissions in a fraction of patients with a variety of malignancies. Unfortunately, only a subset of patients responds to these therapies, with response rates generally ranging from 10 to 30% and sometimes higher for each monotherapy, depending on the indication and other factors. Therapeutic combination of these agents, for example ipilimumab plus nivolumab, leads to even higher response rates, approaching 60% in some cases. Preclinical studies have shown additional synergies between anti-PD-1 antibodies and/or anti-CTLA-4 antibodies with blockade of more recently identified checkpoint receptors, including LAG-3, TIM-3, BTLA and TIGIT. While the potential of multiple checkpoint blockade is very promising, combination therapy with such agents is expected to carry a high financial burden. Moreover, autoimmune toxicities of combination therapies, for example nivolumab plus ipilimumab, are significantly elevated compared to monotherapy, causing many patients to halt the therapy.

A number of studies (Ahmadzadeh et al., Blood 114:1537 (2009), Matsuzaki et al., PNAS 107(17):7875-7880 (2010), Fourcade et al., Cancer Res. 72(4):887-896 (2012) and Gros et al., J. Clinical Invest. 124(5):2246 (2014)) examining tumor-infiltrating lymphocytes (TILs) have shown that TILs commonly express multiple checkpoint receptors. Moreover, it is likely that TILs that express multiple checkpoints are in fact the most tumor-reactive. In contrast, non-tumor reactive T cells in the periphery are more likely to express a single checkpoint. Checkpoint blockade with monospecific full-length antibodies is likely nondiscriminatory with regards to de-repression of tumor-reactive TILs versus autoantigen-reactive single expressing T cells that are assumed to contribute to autoimmune toxicities.

Accordingly, the invention is directed to bispecific antibodies that bind to two different checkpoint inhibitor proteins.

I. BRIEF SUMMARY OF THE INVENTION

The present invention provides bispecific heterodimeric antibodies that bind to two different checkpoint cell surface receptors such as human PD-1, human CTLA-4, human TIM-3, human LAG-3 and human TIGIT. Thus, in some aspects, suitable bispecific antibodies bind PD-1 and CTLA-4, PD-1 and TIM-3, PD-1 and LAG-3, PD-1 and TIGIT, PD-1 and BTLA, CTLA-4 and TIM-3, CTLA-4 and LAG-3, CTLA-4 and TIGIT, CTLA-4 and BTLA, TIM-3 and LAG-3, TIM-3 and TIGIT, TIM-3 and BTLA, LAG-3 and TIGIT, LAG-3 and BTLA and TIGIT and BTLA.

In one aspect, the invention provides bottle opener formats that comprise: a) a first monomer (the "scFv monomer", sometimes referred to as the "scFv heavy chain") that comprises a scFv with a variable heavy and variable light domain linked using a charged scFv linker (with the +H sequence of FIG. 7 being preferred in some embodiments), an Fc domain comprising the skew variants S364K/E357Q, the ablation variants E233P/L234V/L235A/G236del/S267K, and an Fv that binds to a checkpoint receptor as outlined herein; b) a second monomer (the "Fab monomer" or "heavy chain") that comprises an Fc domain with the skew variants L368D/K370S, the pI variants N208D/Q295E/N384D/Q418E/N421D, the ablation variants E233P/L234V/L235A/G236del/S267K, and a variable heavy domain that, with the variable light domain, makes up an Fv that binds to a second checkpoint receptor as outlined herein; and c) a light chain. In this particular embodiment, suitable monomer Fv pairs include (Fabs listed first, scFvs second) PD-1 and CTLA-4, CTLA-4 and PD-1, PD-1 and TIM-3, TIM-3 and PD-1, PD-1 and LAG-3, LAG-3×PD1, PD-1 and TIGIT, TIGIT and PD-1, PD-1 and BTLA, BTLA and PD-1, CTLA-4 and TIM-3, TIM-3 and CTLA-4, CTLA-4 and LAG-3, LAG-3 and CTLA-4, CTLA-4 and TIGIT, TIGIT and CTLA-4, CTLA-4 and BTLA, BTLA and CTLA-4, TIM-3 and LAG-3, LAG-3 and TIM-3, TIM-3 and TIGIT, TIGIT and TIM-3, TIM-3 and BTLA, BTLA and TIM-3, LAG-3 and TIGIT, TIGIT and LAG-3, LAG-3 and BTLA, BTLA and LAG-3, BTLA and TIGIT, and TIGIT and BTLA.

Other aspects of the invention are provided herein.

II. BRIEF DESCRIPTION OF THE DRAWINGS

FIG. 1A-1I depict several formats of the present invention. The first is the "bottle opener" format, with a first and a second anti-antigen binding domain. Additionally, mAb-Fv, mAb-scFv, Central-scFv, Central-Fv, one armed central-scFv, one scFv-mAb, scFv-mAb and a dual scFv format are all shown. For all of the scFv domains depicted, they can be either N- to C-terminus variable heavy-(optional linker)-variable light, or the opposite. In addition, for the one armed scFv-mAb, the scFv can be attached either to the N-terminus of a heavy chain monomer or to the N-terminus of the light chain.

FIG. 2A-2D depict the antigen sequences for a number of antigens of use in the invention, including both human and cynomolgus monkey in many cases, to facilitate the development of antigen binding domains that bind to both for ease of clinical development.

FIG. 3A-3F depict useful pairs of heterodimerization variant sets (including skew and pI variants). On FIG. 3E, there are variants for which there are no corresponding "monomer 2" variants; these are pI variants which can be used alone on either monomer, or included on the Fab side of a bottle opener, for example, and an appropriate charged scFv linker can be used on the second monomer that utilizes a scFv as the second antigen binding domain. Suitable charged linkers are shown in FIG. 7.

FIG. 4 depict a list of isosteric variant antibody constant regions and their respective substitutions. pI_(−) indicates lower pI variants, while pI_(+) indicates higher pI variants. These can be optionally and independently combined with other heterodimerization variants of the invention (and other variant types as well, as outlined herein).

FIG. 5 depict useful ablation variants that ablate FcγR binding (sometimes referred to as "knock outs" or "KO" variants). Generally, ablation variants are found on both monomers, although in some cases they may be on only one monomer.

FIG. 6A-6B show two particularly useful embodiments of the invention, that can be used for either the format of FIG. 1A or FIG. 1F. For the FIG. 1A format, the "non-Fv" components of this embodiment are shown in FIG. 37A, although the other formats of can be used as well (and that of FIG. 38 as well).

Figures 1A, 1B, 1C, 1D, 1E:
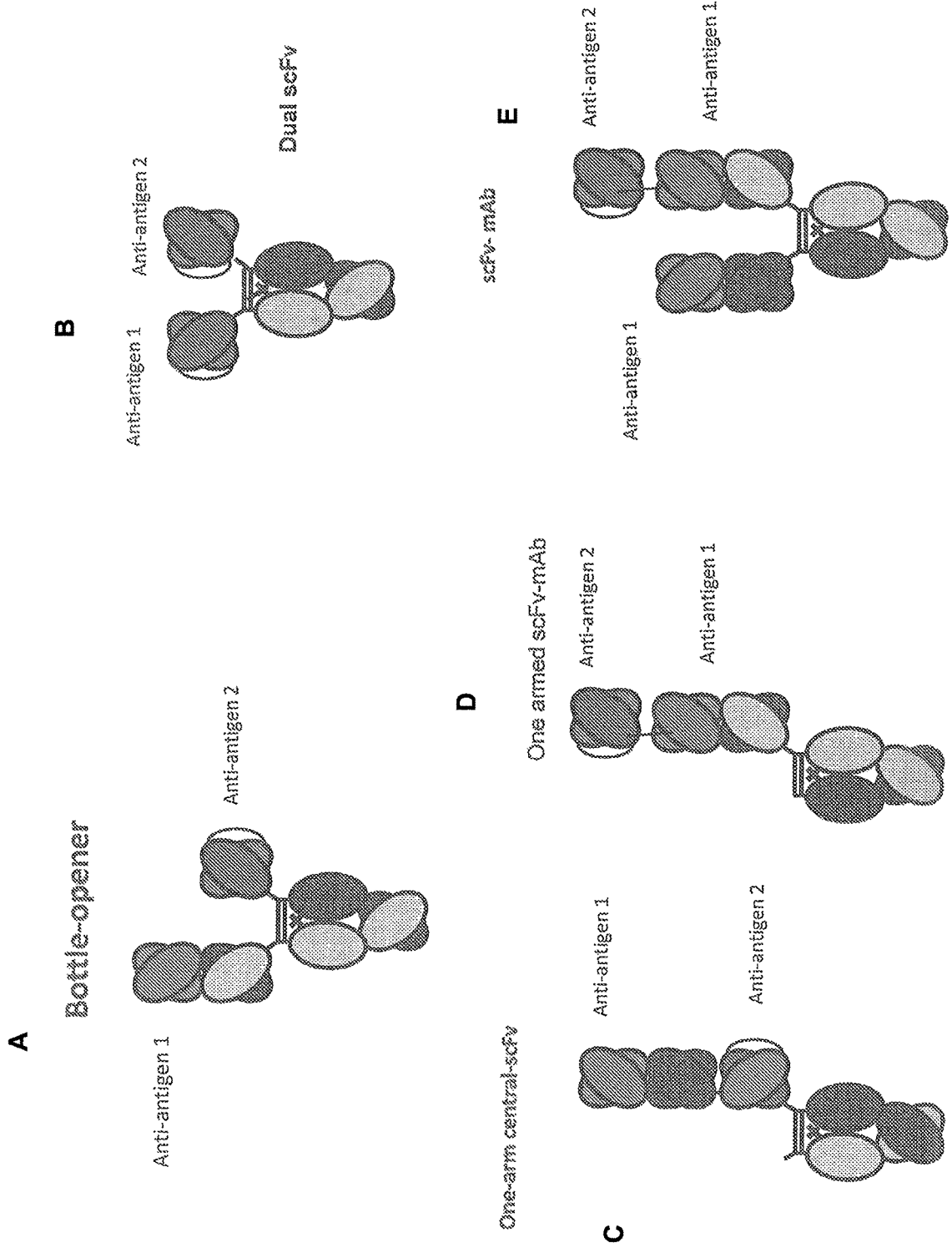

FIG. 7A-7B depicts a number of charged scFv linkers that find use in increasing or decreasing the pI of heterodimeric antibodies that utilize one or more scFv as a component. The (+H) positive linker finds particular use herein, particularly with anti-CD3 vl and vh sequences shown herein. A single prior art scFv linker with a single charge is referenced as "Whitlow", from Whitlow et al., Protein Engineering 6(8): 989-995 (1993). It should be noted that this linker was used for reducing aggregation and enhancing proteolytic stability in scFvs.

FIG. 8 depicts a list of engineered heterodimer-skewing Fc variants with heterodimer yields (determined by HPLC-CIEX) and thermal stabilities (determined by DSC). Not determined thermal stability is denoted by "n.d.".

FIG. 9A-9E depict a select number of PD-1 ABDs, with additional anti-PD-1 ABDs being listed as SEQ ID NOs: 6209-11464, SEQ ID NOs: 11465-17134, SEQ ID NOs: 33003-33072, SEQ ID NOs: 33073-35394 and SEQ ID NOs: 36127-36146. The CDRs are underlined, the scFv linker is double underlined (in the sequences, the scFv linker is a positively charged scFv (GKPGS)$_4$ linker (SEQ ID NO: 37755), although as will be appreciated by those in the art, this linker can be replaced by other linkers, including uncharged or negatively charged linkers, some of which are depicted in FIG. 7), and the slashes indicate the border(s) of the variable domains. In addition, the naming convention illustrates the orientation of the scFv from N- to C-terminus. That is, "H1.279_L1.194" shows that the orientation is vh-scFv linker-vl (from N- to C-terminus, with optional domain linkers on one or both sides, depending on the format used), although these sequences may also be used in the opposite orientation, (from N- to C-terminus) vl-linker-vh. Similarly, "L1.194_H1.279" shows that the orientation is vl-scFv linker-vh (from N- to C-terminus, again with optional domain linkers), with the opposite orientation also included within the invention. As noted herein and is true for every sequence herein containing CDRs, the exact identification of the CDR locations may be slightly different depending on the numbering used as is shown in Table 1, and thus included herein are not only the CDRs that are underlined but also CDRs included within the vh and vl domains using other numbering systems. Furthermore, as for all the sequences in the Figures, these vh and vl sequences can be used either in a scFv format or in a Fab format.

FIG. 10A-10PP depict a number of CTLA-4 ABDs, with additional anti-CTLA-4 ABDs being listed as SEQ ID NOs: 21-2918, SEQ ID NOs: 2919-6208, SEQ ID NOs: 36739-36818 and SEQ ID NOs: 35395-35416. The CDRs are underlined, the scFv linker is double underlined (in the sequences, the scFv linker is a positively charged scFv (GKPGS)$_4$ linker (SEQ ID NO: 37755), although as will be appreciated by those in the art, this linker can be replaced by other linkers, including uncharged or negatively charged linkers, some of which are depicted in FIG. 7), and the slashes indicate the border(s) of the variable domains. As above, the naming convention illustrates the orientation of the scFv from N- to C-terminus; in the sequences listed in this figure, they are all oriented as vh-scFv linker-vl (from N- to C-terminus), although these sequences may also be used in the opposite orientation, (from N- to C-terminus) vl-linker-vh; additionally, some of the sequences in SEQ ID NOs: 21-2918, SEQ ID NOs: 2919-6208, SEQ ID NOs: 36739-36818 and SEQ ID NOs: 35395-35416 are in the opposite orientation. As noted herein and is true for every sequence herein containing CDRs, the exact identification of the CDR locations may be slightly different depending on the numbering used as is shown in Table 1, and thus included herein are not only the CDRs that are underlined but also CDRs included within the vh and vl domains using other numbering systems. Furthermore, as for all the sequences in the Figures, these vh and vl sequences can be used either in a scFv format or in a Fab format. In particular, many of the figures include the XENP identifier for both the scFv format as well as the Fab format; see for example FIG. 10A, that shows that XENP19235 is the molecule using the Fab format and XENP19769 is the scFv molecule.

FIG. 11A-11N depict a number of LAG-3 ABDs, with additional anti-LAG-3 ABDs being listed as SEQ ID NOs: 17135-20764, SEQ ID NOs: 36819-36962, SEQ ID NOs: 35417-35606, SEQ ID NOs: 25194-32793 and SEQ ID NOs: 32794-33002. The CDRs are underlined, the scFv linker is double underlined (in the sequences, the scFv linker is a positively charged scFv (GKPGS)$_4$ linker, although as will be appreciated by those in the art, this linker can be replaced by other linkers, including uncharged or negatively charged linkers, some of which are depicted in FIG. 7), and the slashes indicate the border(s) of the variable domains. As above, the naming convention illustrates the orientation of the scFv from N- to C-terminus; in the sequences listed in this figure, they are all oriented as vh-scFv linker-vl (from N- to C-terminus), although these sequences may also be used in the opposite orientation, (from N- to C-terminus) vl-linker-vh; additionally, some of the sequences in SEQ ID NOs: 17135-20764, SEQ ID NOs: 36819-36962, SEQ ID NOs: 35417-35606, SEQ ID NOs: 25194-32793 and SEQ ID NOs: 32794-33002 are in the opposite orientation. As noted herein and is true for every sequence herein containing CDRs, the exact identification of the CDR locations may be slightly different depending on the numbering used as is shown in Table 1, and thus included herein are not only the CDRs that are underlined but also CDRs included within the vh and vl domains using other numbering systems. Furthermore, as for all the sequences in the Figures, these vh and vl sequences can be used either in a scFv format or in a Fab format.

FIG. 12A-12C depict a number of BTLA ABDs, with additional anti-BTLA ABDs being listed as SEQ ID NOs: 20885-21503 and SEQ ID NOs: 36707-36738. The CDRs are underlined, the scFv linker is double underlined (in the sequences, the scFv linker is a positively charged scFv $(GKPGS)_4$ linker, although as will be appreciated by those in the art, this linker can be replaced by other linkers, including uncharged or negatively charged linkers, some of which are depicted in FIG. 7), and the slashes indicate the border(s) of the variable domains. As above, the naming convention illustrates the orientation of the scFv from N- to C-terminus; in the sequences listed in this figure, they are all oriented as vh-scFv linker-vl (from N- to C-terminus), although these sequences may also be used in the opposite orientation, (from N- to C-terminus) vl-linker-vh; additionally, some of the sequences in SEQ ID NOs: 20885-21503 and SEQ ID NOs: 36707-36738 are in the opposite orientation. As noted herein and is true for every sequence herein containing CDRs, the exact identification of the CDR locations may be slightly different depending on the numbering used as is shown in Table 1, and thus included herein are not only the CDRs that are underlined but also CDRs included within the vh and vl domains using other numbering systems. Furthermore, as for all the sequences in the Figures, these vh and vl sequences can be used either in a scFv format or in a Fab format.

FIG. 13A-13I depict a number of TIM-3 ABDs, with additional anti-TIM-3 ABDs being listed as SEQ ID NOs: 20765-20884, SEQ ID NOs: 37587-37698 and SEQ ID NOs: 36347-36706. The CDRs are underlined, the scFv linker is double underlined (in the sequences, the scFv linker is a positively charged scFv $(GKPGS)_4$ linker, although as will be appreciated by those in the art, this linker can be replaced by other linkers, including uncharged or negatively charged linkers, some of which are depicted in FIG. 7), and the slashes indicate the border(s) of the variable domains. As above, the naming convention illustrates the orientation of the scFv from N- to C-terminus; in the sequences listed in this figure, they are all oriented as vh-scFv linker-vl (from N- to C-terminus), although these sequences may also be used in the opposite orientation, (from N- to C-terminus) vl-linker-vh; additionally, some of the sequences in SEQ ID NOs: 20765-20884, SEQ ID NOs: 37587-37698 and SEQ ID NOs: 36347-36706 are in the opposite orientation. As noted herein and is true for every sequence herein containing CDRs, the exact identification of the CDR locations may be slightly different depending on the numbering used as is shown in Table 1, and thus included herein are not only the CDRs that are underlined but also CDRs included within the vh and vl domains using other numbering systems. Furthermore, as for all the sequences in the Figures, these vh and vl sequences can be used either in a scFv format or in a Fab format.

FIG. 14A-14I depicts the amino acid sequences of specific anti-CTLA-4×anti-PD-1 antibodies in the bottle opener format (Fab-scFv-Fc). The antibodies are named using the Fab variable region first and the scFv variable region second, separated by a dash, followed by the chain designation (Fab-Fc heavy chain, scFv-Fc heavy chain or light chain). CDRs are underlined and slashes indicate the border(s) of the variable regions. The scFv domain has different orientations (N- to C-terminus) of either vh-linker-vl or vl-linker-vh as indicated, although this can be reversed. In addition, each sequence outlined herein can include or exclude the M428L/N434S variants in one or preferably both Fc domains, which results in longer half-life in serum.

FIG. 15A-15K depicts the amino acid sequences of specific anti-LAG-3×anti-PD-1 Fab-scFv-Fc bispecific antibodies. The antibodies are named using the Fab variable region first and the scFv variable region second, separated by a dash, followed by the chain designation (Fab-Fc heavy chain, scFv-Fc heavy chain or light chain). CDRs are underlined and slashes indicate the border(s) of the variable regions. The scFv domains have the orientation (N- to C-terminus) vl-linker-vh, although this can be reversed. In addition, each sequence outlined herein can include or exclude the M428L/N434S variants in one or preferably both Fc domains, which results in longer half-life in serum.

FIG. 16A-16D depicts the amino acid sequences of specific anti-BTLA×anti-PD-1 Fab-scFv-Fc bispecific antibodies. The antibodies are named using the Fab variable region first and the scFv variable region second, separated by a dash, followed by the chain designation (Fab-Fc heavy chain, scFv-Fc heavy chain or light chain). CDRs are underlined and slashes indicate the border(s) of the variable regions. The scFv domains have the orientation (N- to C-terminus) vl-linker-vh, although this can be reversed. In addition, each sequence outlined herein can include or exclude the M428L/N434S variants in one or preferably both Fc domains, which results in longer half-life in serum.

FIG. 17A-17O depicts the amino acid sequences of specific anti-LAG-3×anti-CTLA-4 Fab-scFv-Fc bispecific antibodies. The antibodies are named using the Fab variable region first and the scFv variable region second, separated by a dash, followed by the chain designation (Fab-Fc heavy chain, scFv-Fc heavy chain or light chain). CDRs are underlined and slashes indicate the border(s) of the variable regions. The scFv domains have the orientation (N- to C-terminus) vh-linker-vl, although this can be reversed. In addition, each sequence outlined herein can include or exclude the M428L/N434S variants in one or preferably both Fc domains, which results in longer half-life in serum.

Figure 18:
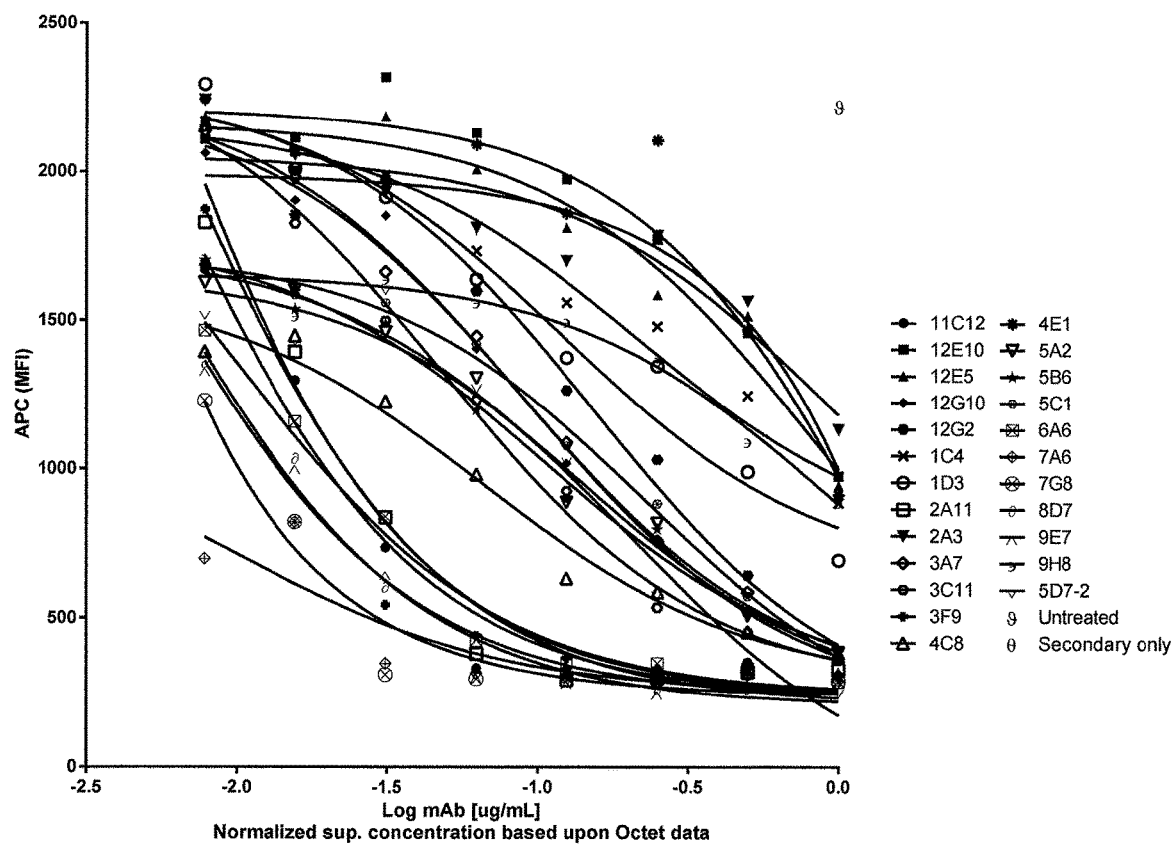

FIG. 18 shows the results of some anti-LAG-3 hybridoma screening. 1 μg of human LAG-3-hIg in 10 μL was mixed with 50 μL of hybridoma supernatant (diluted 2-fold, 8 times in RPMI media with 10% FBS) for 20 minutes at room temperature. 40 μL of Daudi or Ramos cells (which endogenously express MHC-II) were added and incubated at 4° C. for 30 minutes. The cells were then washed and incubated with anti-human-Fc-Alexa647 secondary antibody for 30 minutes. Cells were then washed and analyzed by FACS for Alexa647.

Figures 19, 19A:
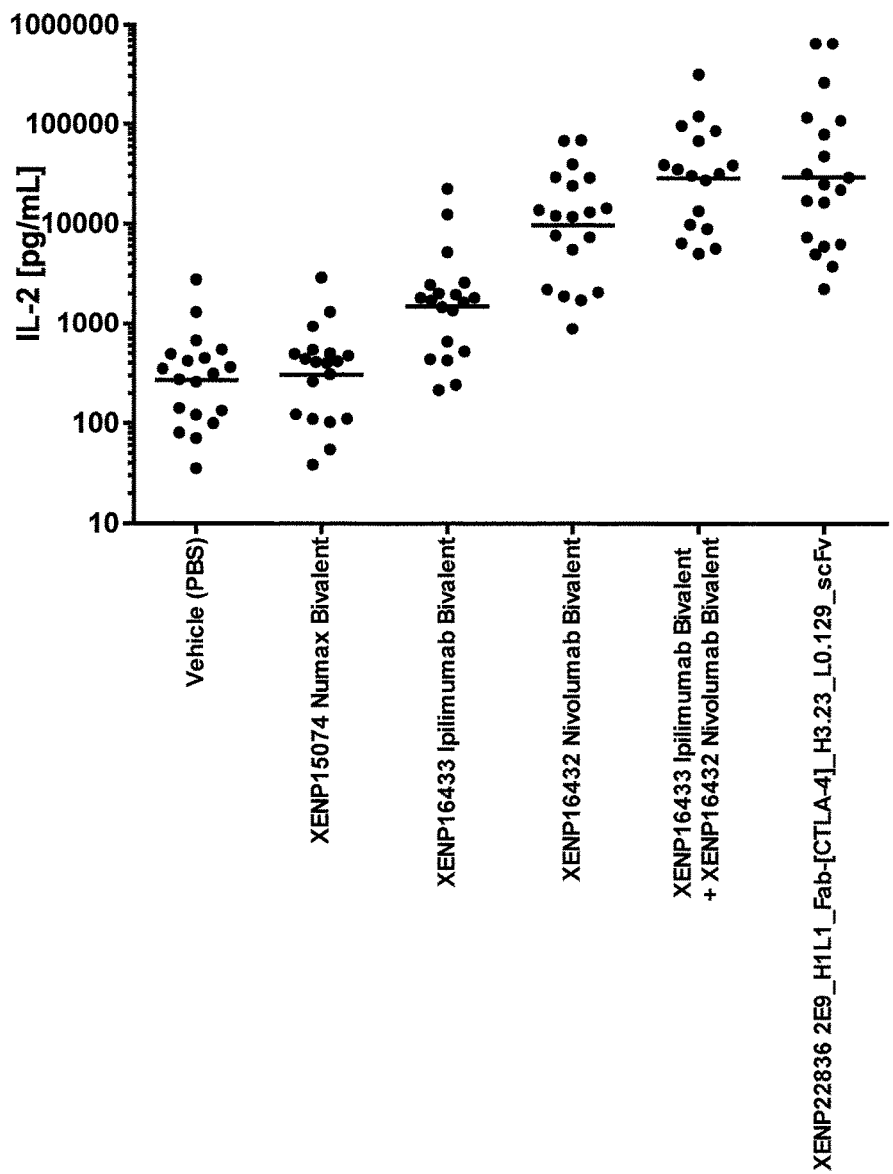
Figure 19B:
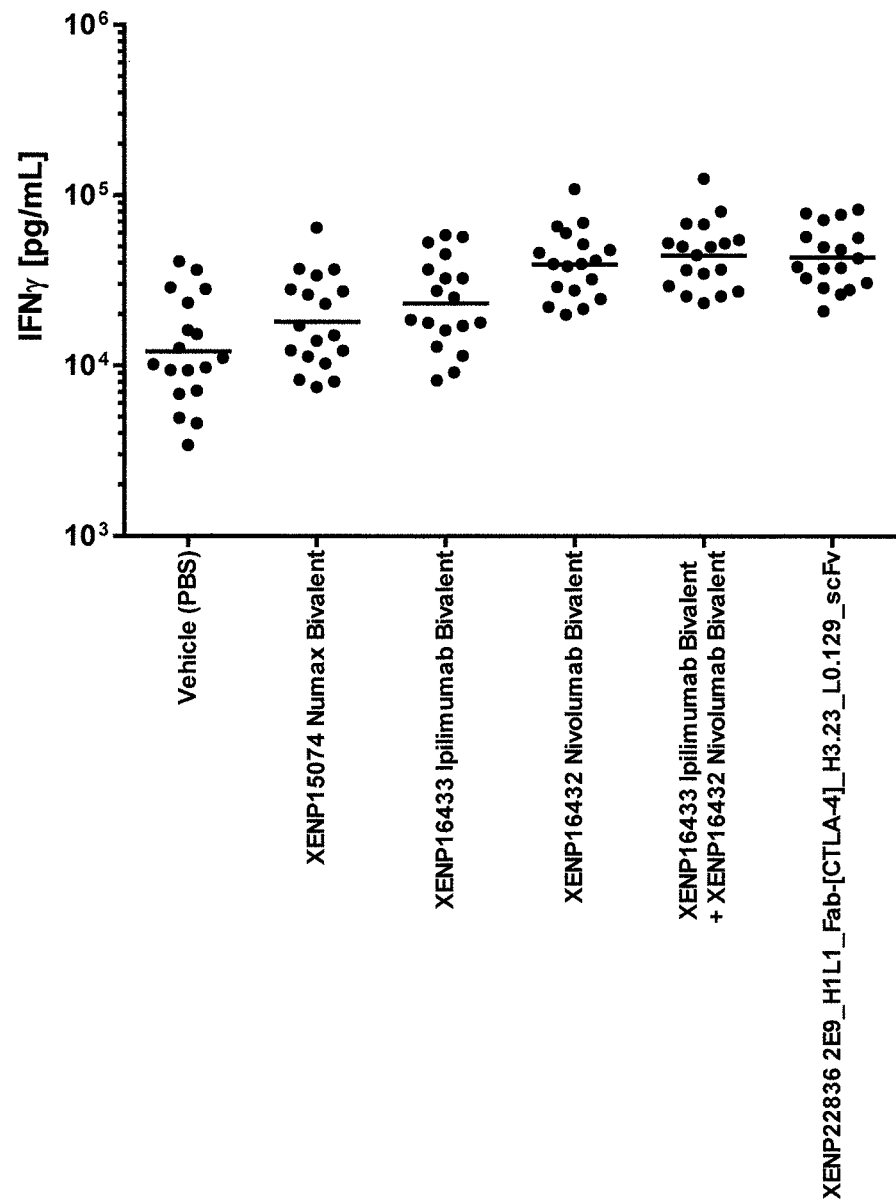

FIG. 19A-19B depict cytokine release assays (A:IL-2, B: IFNγ) after SEB stimulation of human PBMCs and treatment with an anti-CTLA-4×anti-PD-1 bispecific antibody.

Figures 20, 20A:
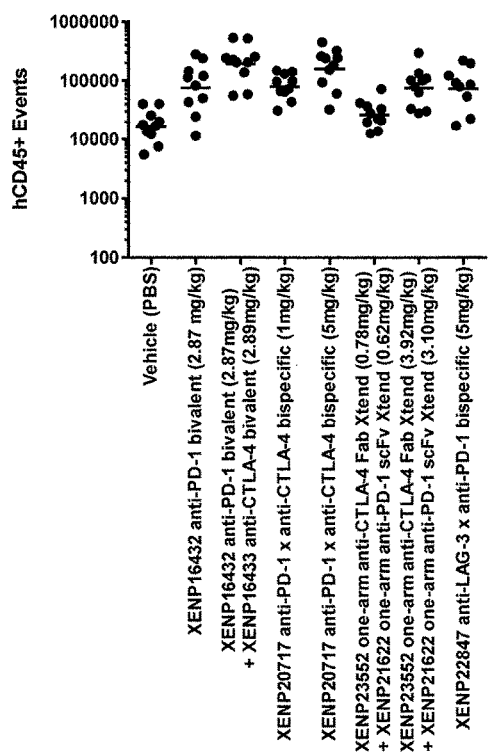
Figure 20B:
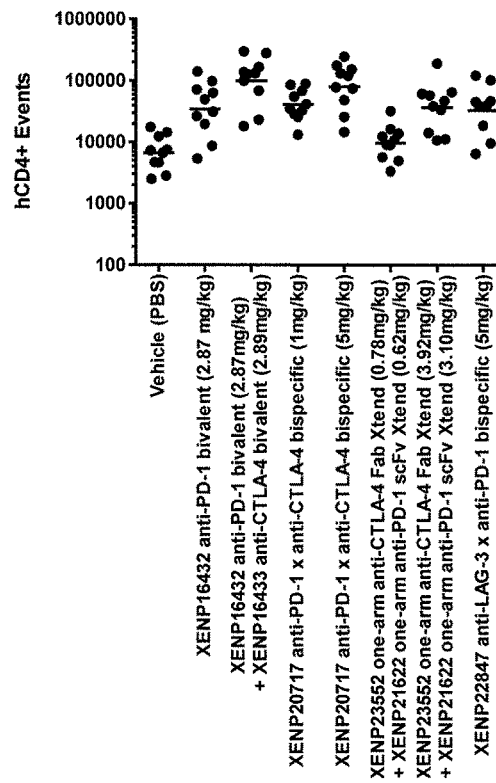
Figure 20C:
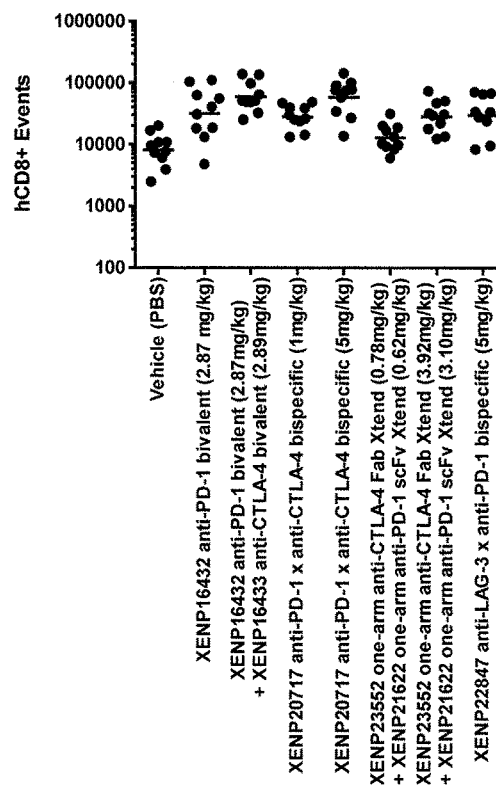

FIG. 20A-20C depict CD45+ events and CD8+ events on Day 14 after human PBMCs were engrafted into NSG mice on Day 0 followed by dosing with the indicated test articles on Day 1.

Figure 21A:
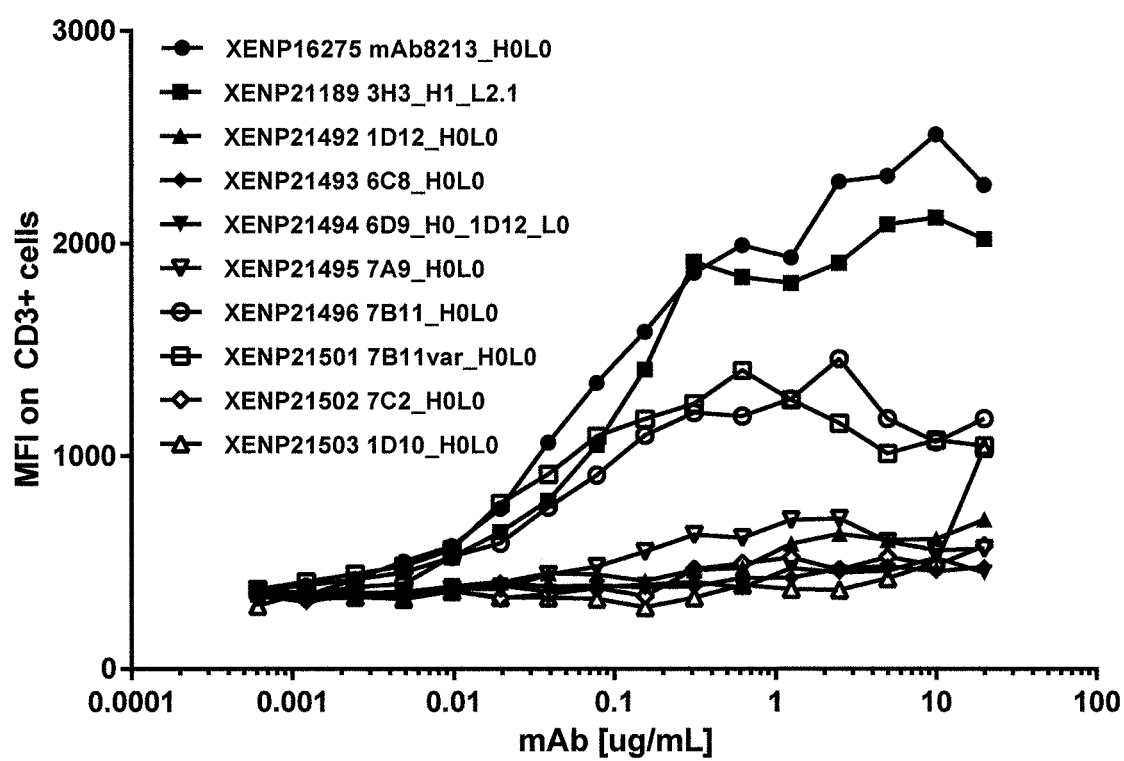
Figure 21B:
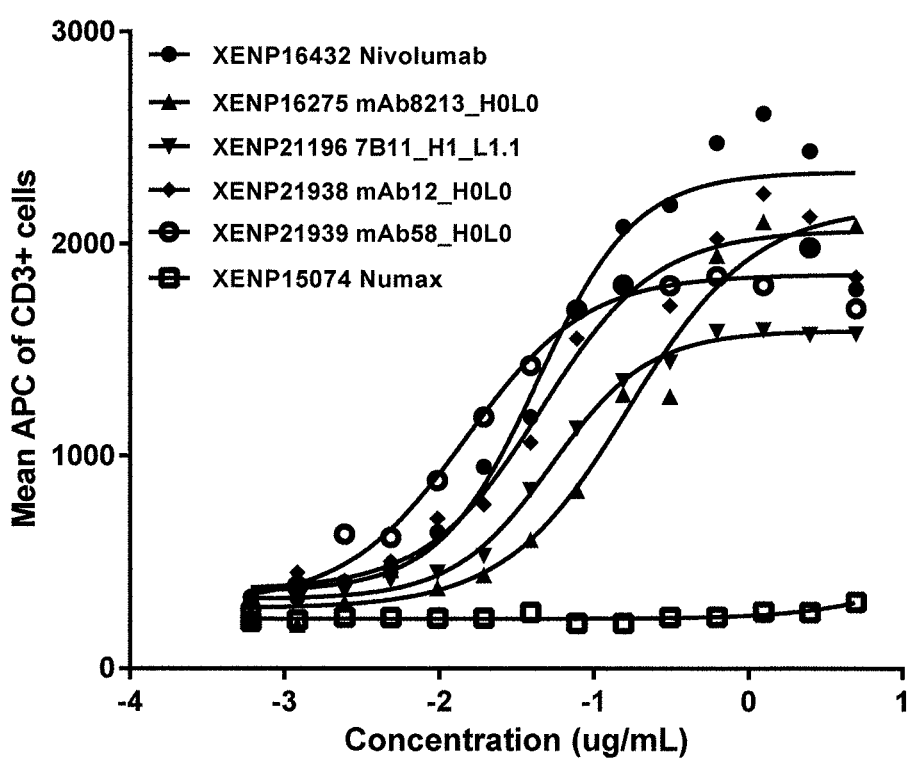

FIG. 21A-21B depicts T cell binding in an SEB-stimulated PBMC assay by chimeric antibodies generated from anti-TIM-3 hybridomas.

FIG. 22 depicts some anti-TIM-3 antigen binding domain engineering data from three experiments. This depicts XENP code for bivalent embodiments, the derivative clone, the designations of the vh and vl engineered domains, the KD binding constant, association constant and dissociation constant against human TIM-3 as measured by OCTET®.

FIG. 23A-23N depicts some anti-PD-1 antigen binding domain engineering data. This depicts the XENP code for the bivalent and scFv embodiments, the designation of the vh and vl engineered domains, the scFv orientation (N- to C-terminal), the KD binding constant against human PD-1 as measured by OCTET®, and the Tm of the scFv.

FIG. 24A-24G depicts the results of some anti-CTLA-4 Fab screening. This depicts the XENP code for the Fab and scFv embodiments, the designation of the vh and vl engineered domains, the KD binding constant against human and cyno CTLA-4 as measured by OCTET®, and the Tm of the scFv and Fab. Additionally, the number of sequence 9-mers that were an exact match to at least one human VH or VL germline are depicted as a measure of humanness for the variable regions of both Fabs and scFvs.

Figure 25:
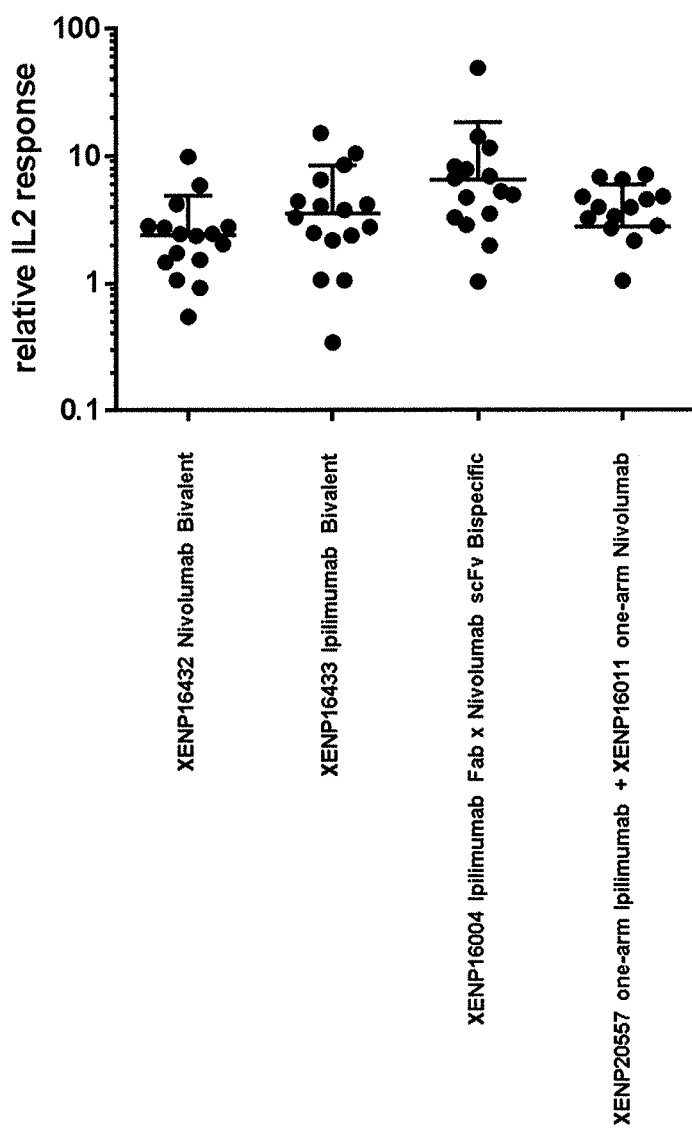

FIG. 25 depicts a mixed lymphocyte reaction looking enhancement of IL-2 release by nivolumab (anti-PD-1 monoclonal antibody, marketed as Opdivo®) alone, ipilimumab alone (anti-CTLA-4 monoclonal antibody, marketed as Yervoy®), a prototype anti-CTLA-4×anti-PD-1 bispecific based on the nivolumab and ipilimumab arms, and a "one-armed" combination control.

Figure 26:
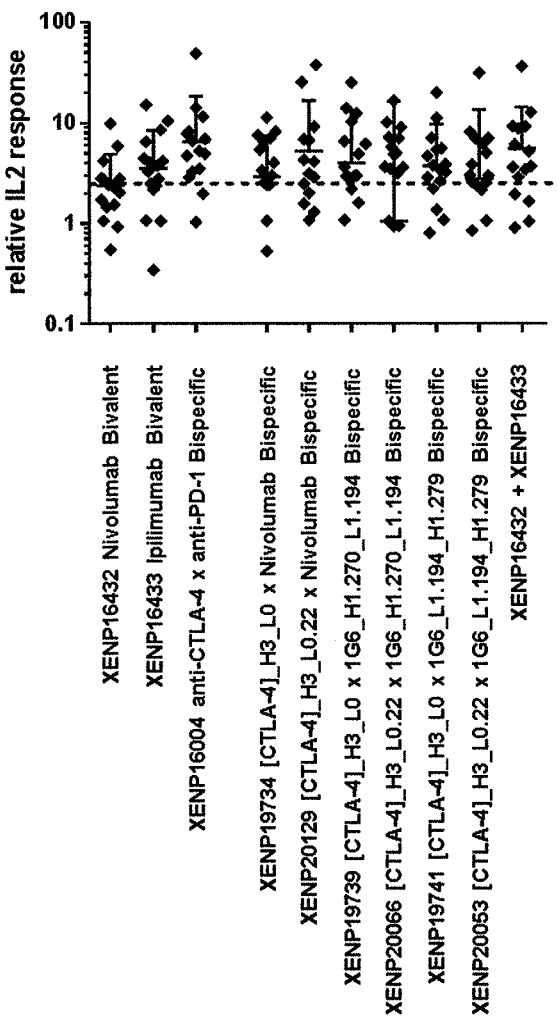

FIG. 26 depicts mixed lymphocyte reaction looking at enhancement of IL-2 release by anti-CTLA-4×anti-PD-1 bispecific antibodies with variant anti-CTLA-4 Fab arms and variant anti-PD-1 scFv arms, as well as nivolumab alone, ipilimumab alone, and a prototype anti-CTLA-4× anti-PD-1 bispecific based on the nivolumab and ipilimumab arms as controls.

Figure 27:
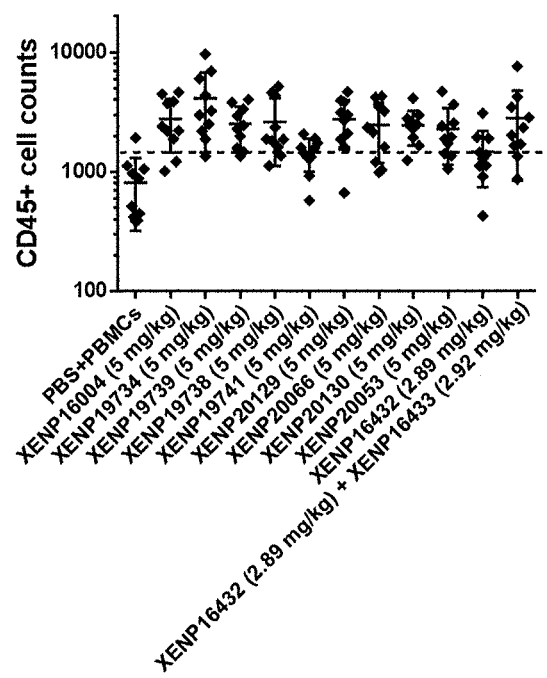

FIG. 27 shows that anti-CTLA-4×anti-PD-1 bispecifics enhance engraftment (as measured by human CD45 counts) in human PBMC-engrafted NSG mice. Enhancement is greater than that seen with nivolumab (XENP16432) alone (dashed line).

Figure 28:
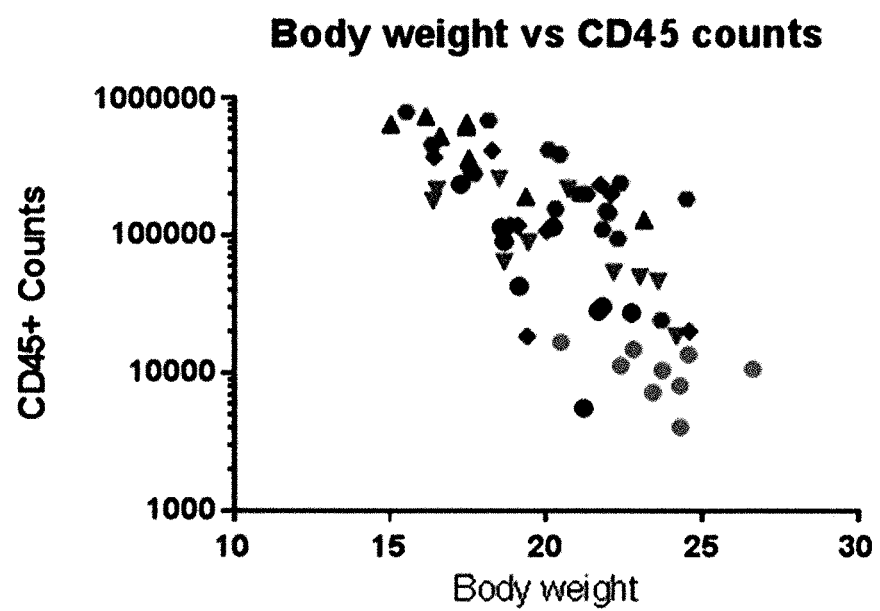

FIG. 28 depicts the correlation between body weight and CD45 cell count in Graft-versus-Host disease, demonstrating that CD45 cell levels are predictive of disease.

Figure 29:
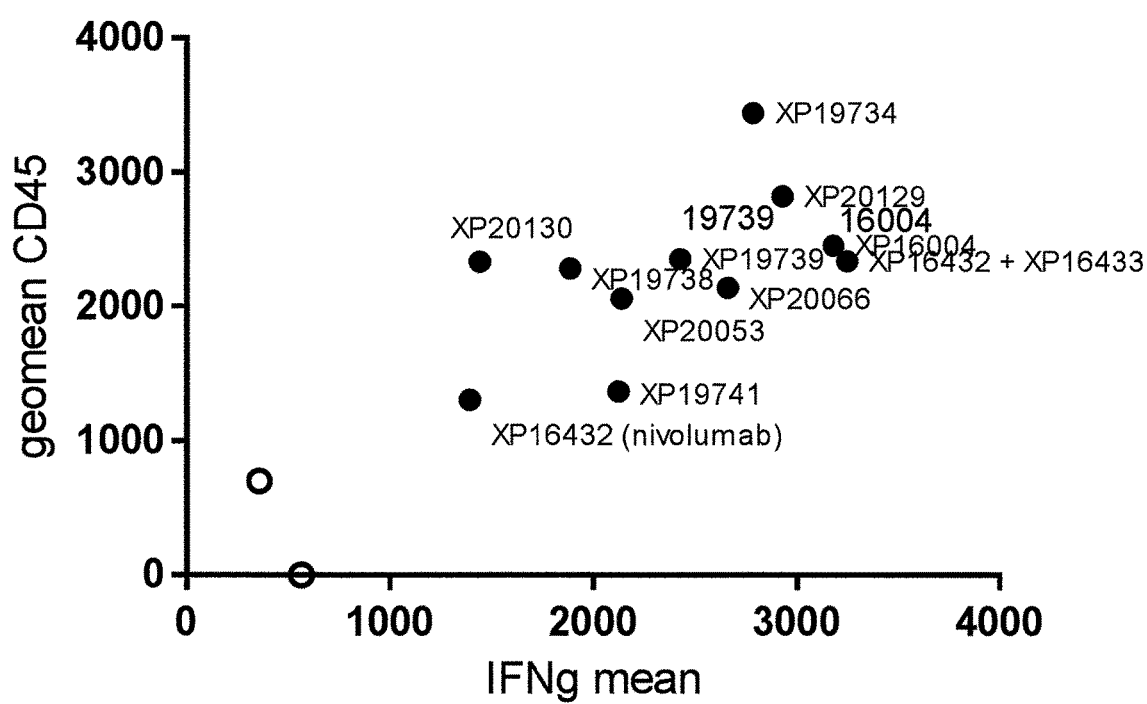

FIG. 29 depicts the correlation between CD45 cell count and IFNγ release in the study depicted in FIG. 27.

Figure 30:
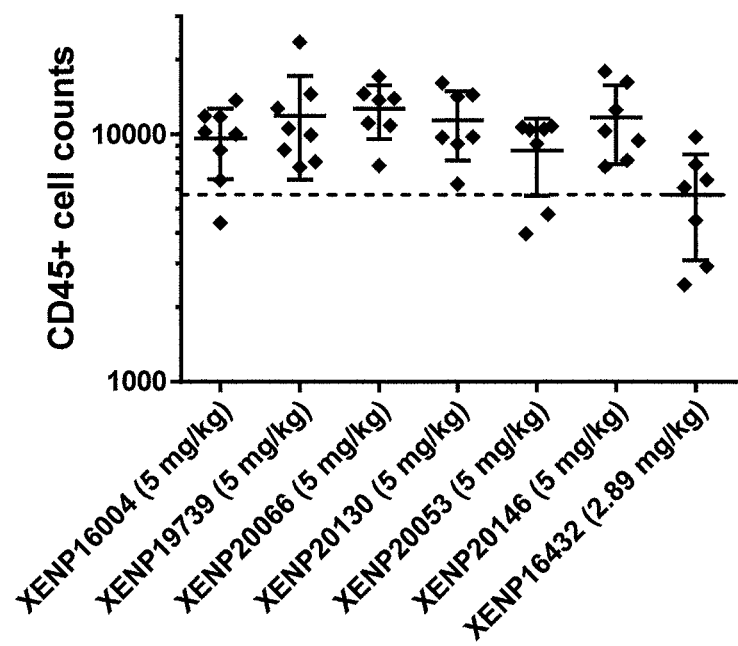

FIG. 30 shows that anti-CTLA-4×anti-PD-1 bispecifics enhance engraftment (as measured by human CD45 counts) in human PBMC-engrafted NSG mice. Enhancement is greater than that seen with nivolumab (XENP16432) alone (dashed line).

Figure 31:
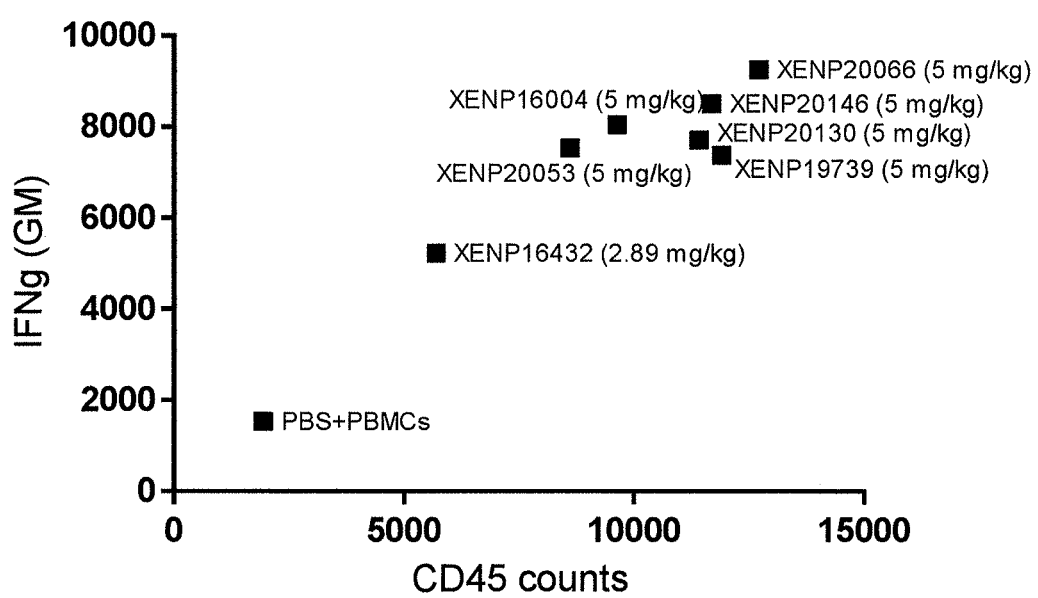

FIG. 31 depicts the correlation between CD45 cell count and IFNγ release in the study depicted in FIG. 30.

Figure 32:
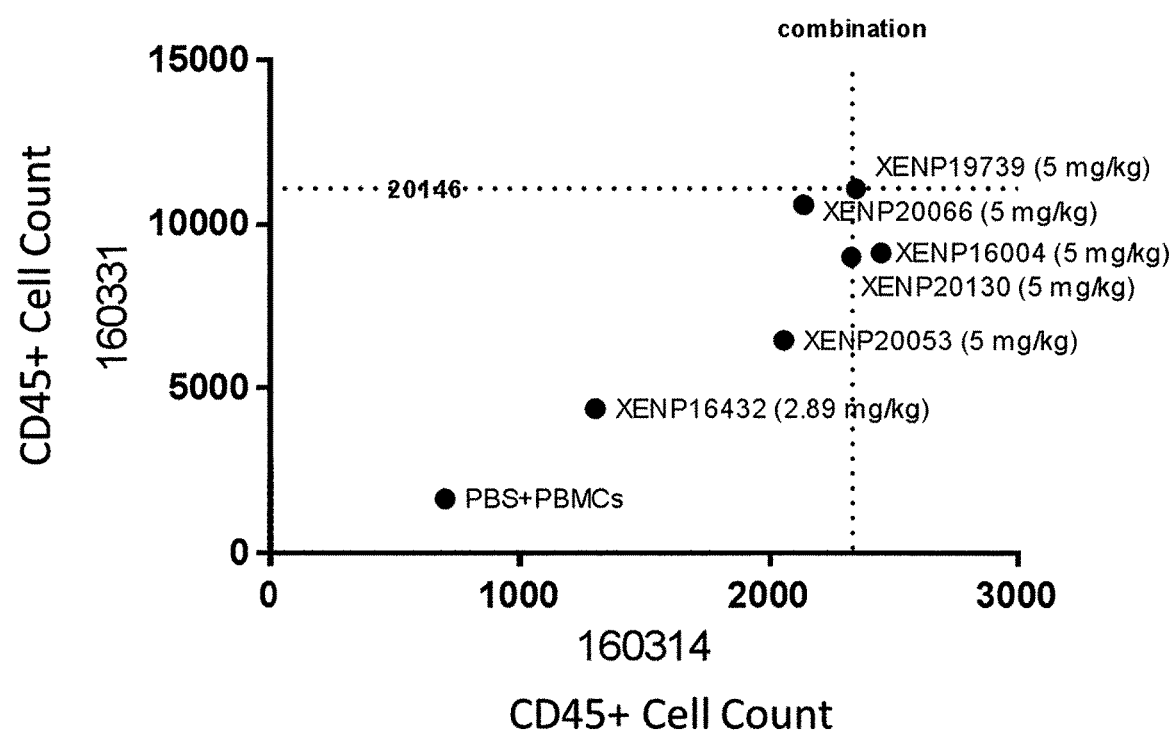

FIG. 32 shows the comparison of test article effects between the studies depicted in FIGS. 27 and 30 demonstrating the consistent superiority of anti-PD-1×anti-CTLA-4 bispecific checkpoint antibodies over nivolumab alone.

Figure 33A:
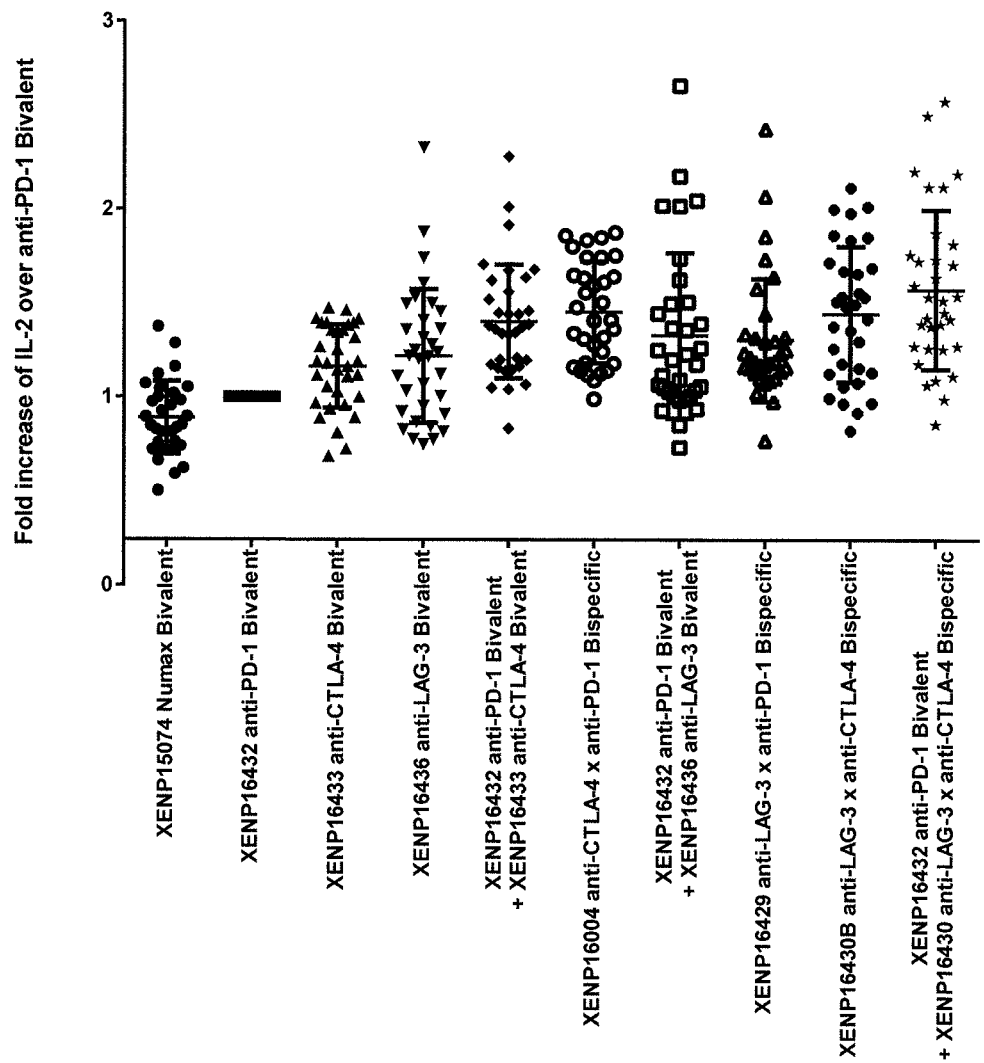
Figure 33B:
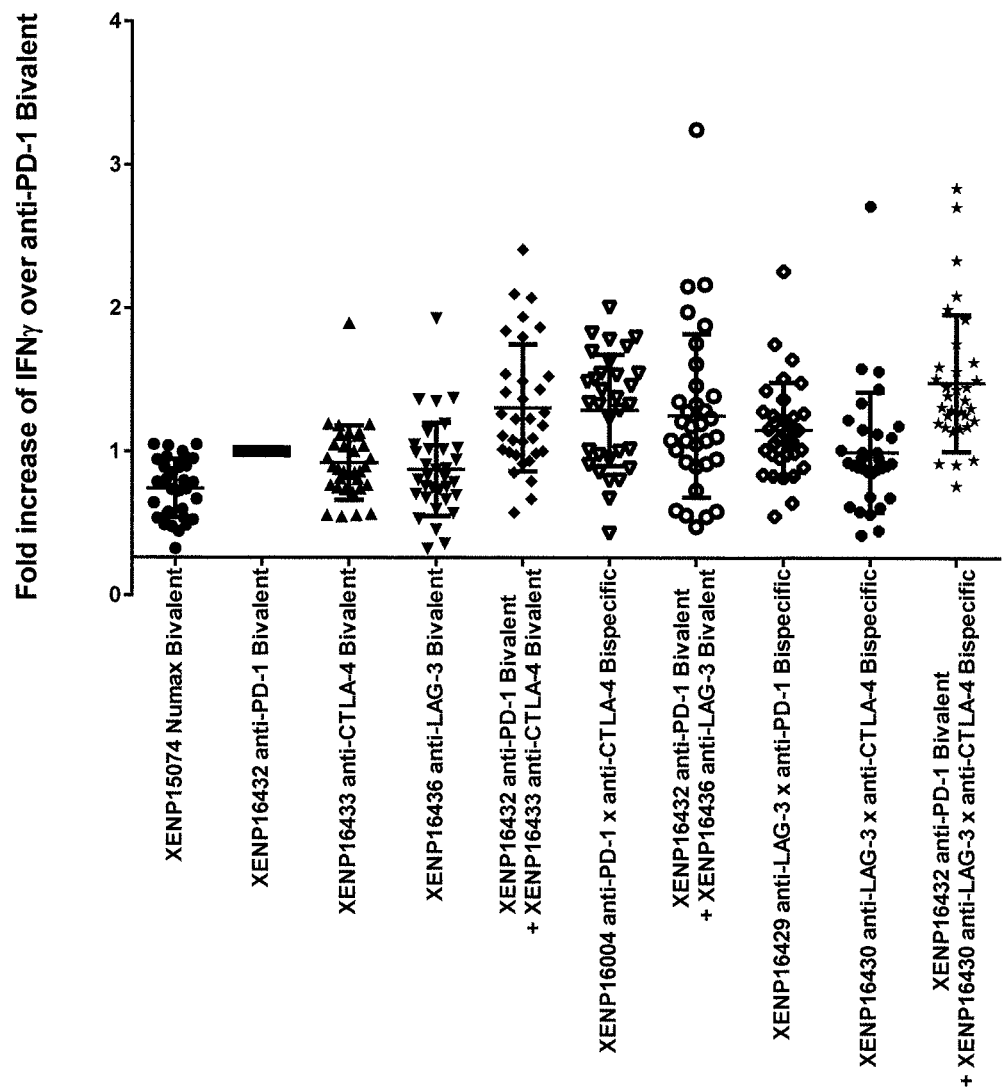

FIG. 33A-33B show the results of mixed lymphocyte reactions to evaluate anti-CTLA-4×anti-PD-1, anti-LAG-3× anti-PD-1, and anti-LAG-3×anti-CTLA-4 bispecifics. Analyte levels were normalized to those induced by nivolumab alone (values greater than one represent an enhancement relative to nivolumab).

Figure 34:
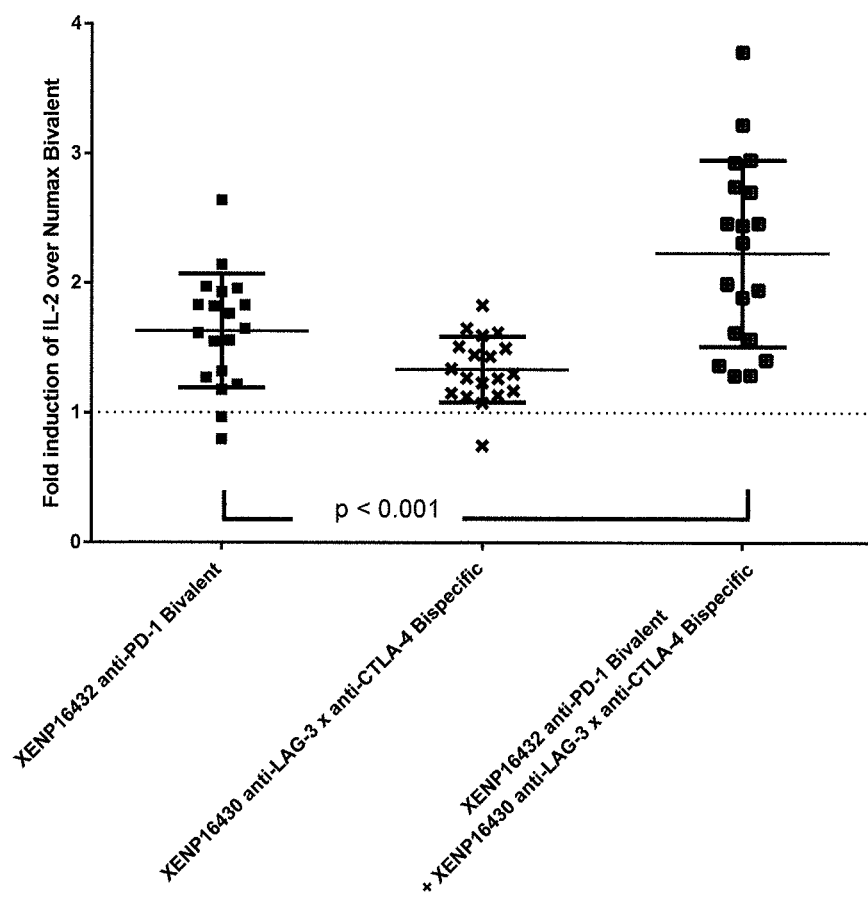

FIG. 34 shows SEB reactions to evaluate anti-LAG-3× anti-CTLA-4 bispecifics. The anti-LAG-3×anti-CTLA-4 bispecific itself enhances the IL-2 response relative to control, although it is inferior to nivolumab alone. However, the anti-LAG-3×anti-CTLA-4 bispecific combined with nivolumab leads to significantly higher IL-2 response than either alone.

Figure 35:
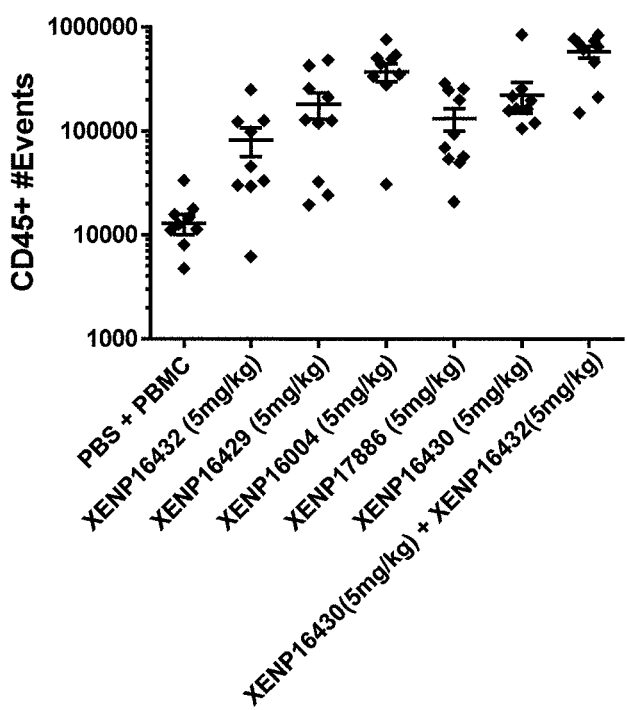

FIG. 35 Anti-CTLA-4×anti-PD-1, anti-LAG-3×anti-PD-1, anti-BTLA×anti-PD-1, and anti-LAG-3×anti-CTLA-4 bispecifics enhance engraftment (as measured by human CD45 counts) in human PBMC-engrafted NSG mice. Enhancement is greater than that seen with nivolumab (XENP 16432) alone. Also, the anti-LAG-3×anti-CTLA-4 bispecific combines with nivolumab to yield the highest engraftment levels.

Figure 36A:
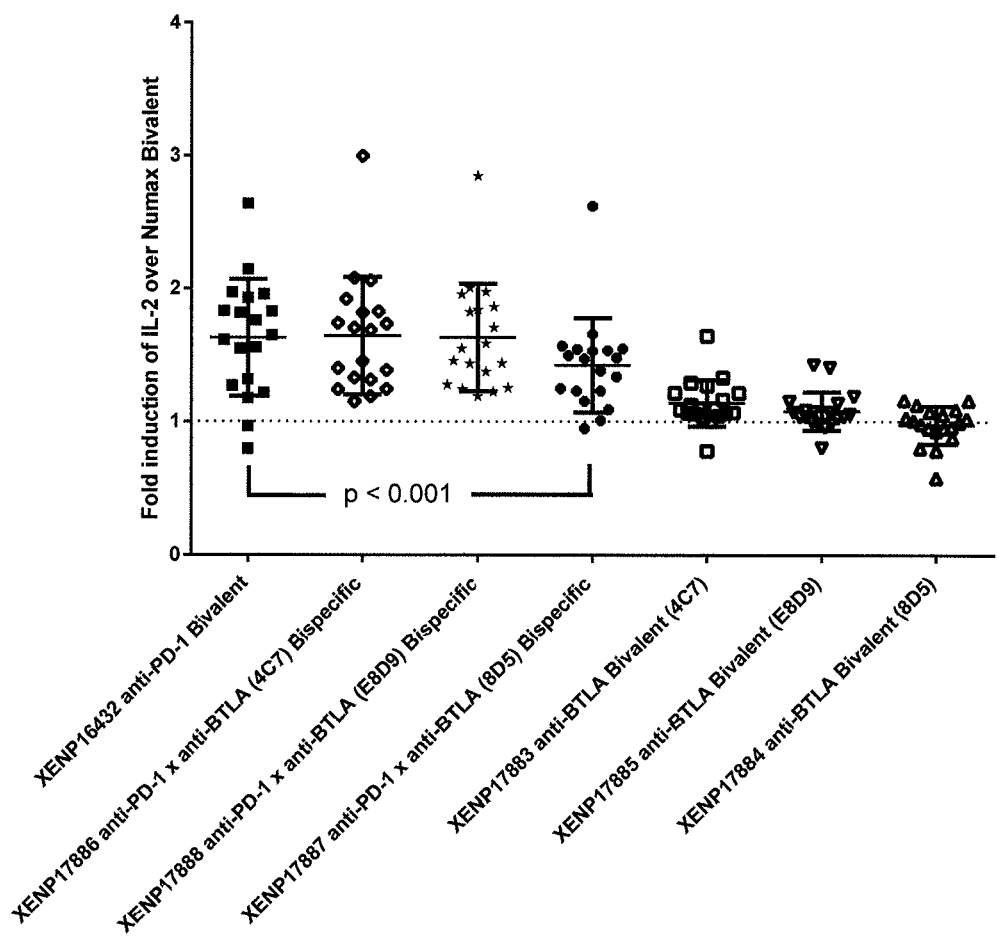
Figure 36B:
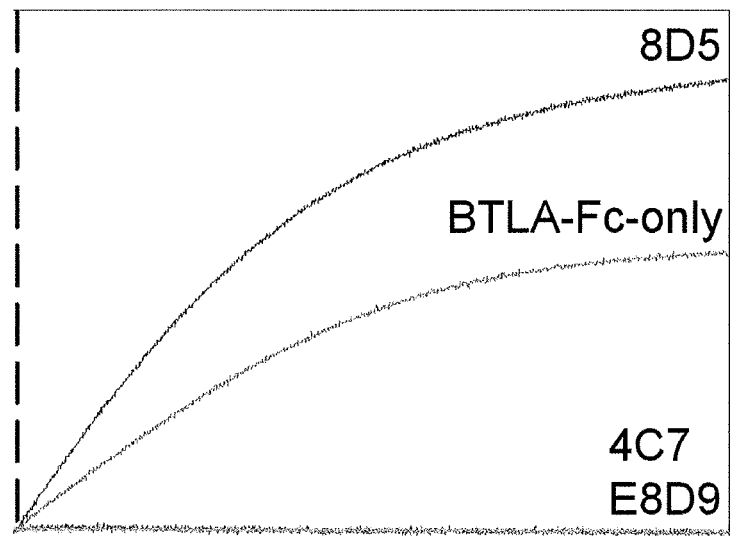

FIG. 36A-36B show that the anti-BTLA×anti-PD-1 bispecifics require disruption of the HVEM/BTLA interaction to possess equivalent de-repressive activity as nivolumab.

FIG. 37A-37E shows the sequences of several useful bottle opener format backbones based on human IgG1, without the Fv sequences (e.g. the scFv and the vh and vl for the Fab side). Bottle opener backbone 1 is based on human IgG1 (356E/358M allotype), and includes the S364K/E357Q:L368D/K370S skew variants, the N208D/Q295E/N384D/Q418E/N421D pI variants on the Fab side and the E233P/L234V/L235A/G236del/S267K ablation variants on both chains. Bottle opener backbone 2 is based on human IgG1 (356E/358M allotype), and includes different skew variants, the N208D/Q295E/N384D/Q418E/N421D pI variants on the Fab side and the E233P/L234V/L235A/G236del/S267K ablation variants on both chains. Bottle opener backbone 3 is based on human IgG1 (356E/358M allotype), and includes different skew variants, the N208D/Q295E/N384D/Q418E/N421D pI variants on the Fab side and the E233P/L234V/L235A/G236del/S267K ablation variants on both chains. Bottle opener backbone 4 is based on human IgG1 (356E/358M allotype), and includes different skew variants, the N208D/Q295E/N384D/Q418E/N421D pI variants on the Fab side and the E233P/L234V/L235A/G236del/S267K ablation variants on both chains. Bottle opener backbone 5 is based on human IgG1 (356D/358L allotype), and includes the S364K/E357Q:L368D/K370S skew variants, the N208D/Q295E/N384D/Q418E/N421D pI variants on the Fab side and the E233P/L234V/L235A/G236del/S267K ablation variants on both chains. Bottle opener backbone 6 is based on human IgG1 (356E/358M allotype), and includes the S364K/E357Q:L368D/K370S skew variants, N208D/Q295E/N384D/Q418E/N421D pI variants on the Fab side and the E233P/L234V/L235A/G236del/S267K ablation variants on both chains, as well as an N297A variant on both chains. Bottle opener backbone 7 is identical to 6 except the mutation is N297S. Alternative formats for bottle opener backbones 6 and 7 can exclude the ablation variants E233P/L234V/L235A/G236del/S267K in both chains. Backbone 8 is based on human IgG4, and includes the S364K/E357Q:L368D/K370S skew variants, the N208D/Q295E/N384D/Q418E/N421D pI variants on the Fab side and the E233P/L234V/L235A/G236del/S267K ablation variants on both chains, as well as a S228P (EU numbering, this is S241P in Kabat) variant on both chains that ablates Fab arm exchange as is known in the art. Alternative formats for bottle opener backbone 8 can exclude the ablation variants E233P/L234V/L235A/G236del/S267K in both chains Backbone 9 is based on human IgG2, and includes the S364K/E357Q:L368D/K370S skew variants, the N208D/Q295E/N384D/Q418E/N421D pI variants on the Fab side. Backbone 10 is based on human IgG2, and includes the S364K/E357Q:L368D/K370S skew variants, the N208D/Q295E/N384D/Q418E/N421D pI variants on the Fab side as well as a S267K variant on both chains.

As will be appreciated by those in the art and outlined below, these sequences can be used with any vh and vl pairs outlined herein, with one monomer including a scFv (optionally including a charged scFv linker) and the other monomer including the Fab sequences (e.g. a vh attached to the "Fab side heavy chain" and a vl attached to the "constant light chain"). That is, any Fv sequences outlined herein for anti-CTLA-4, anti-PD-1, anti-LAG-3, anti-TIM-3, anti-TIGIT and anti-BTLA, whether as scFv (again, optionally with charged scFv linkers) or as Fabs, can be incorporated into these FIG. 37 backbones in any combination. The constant light chain depicted in FIG. 37A can be used for all of the constructs in the figure, although the kappa constant light chain can also be substituted.

Figures 1F, 1G, 1H, 1I:
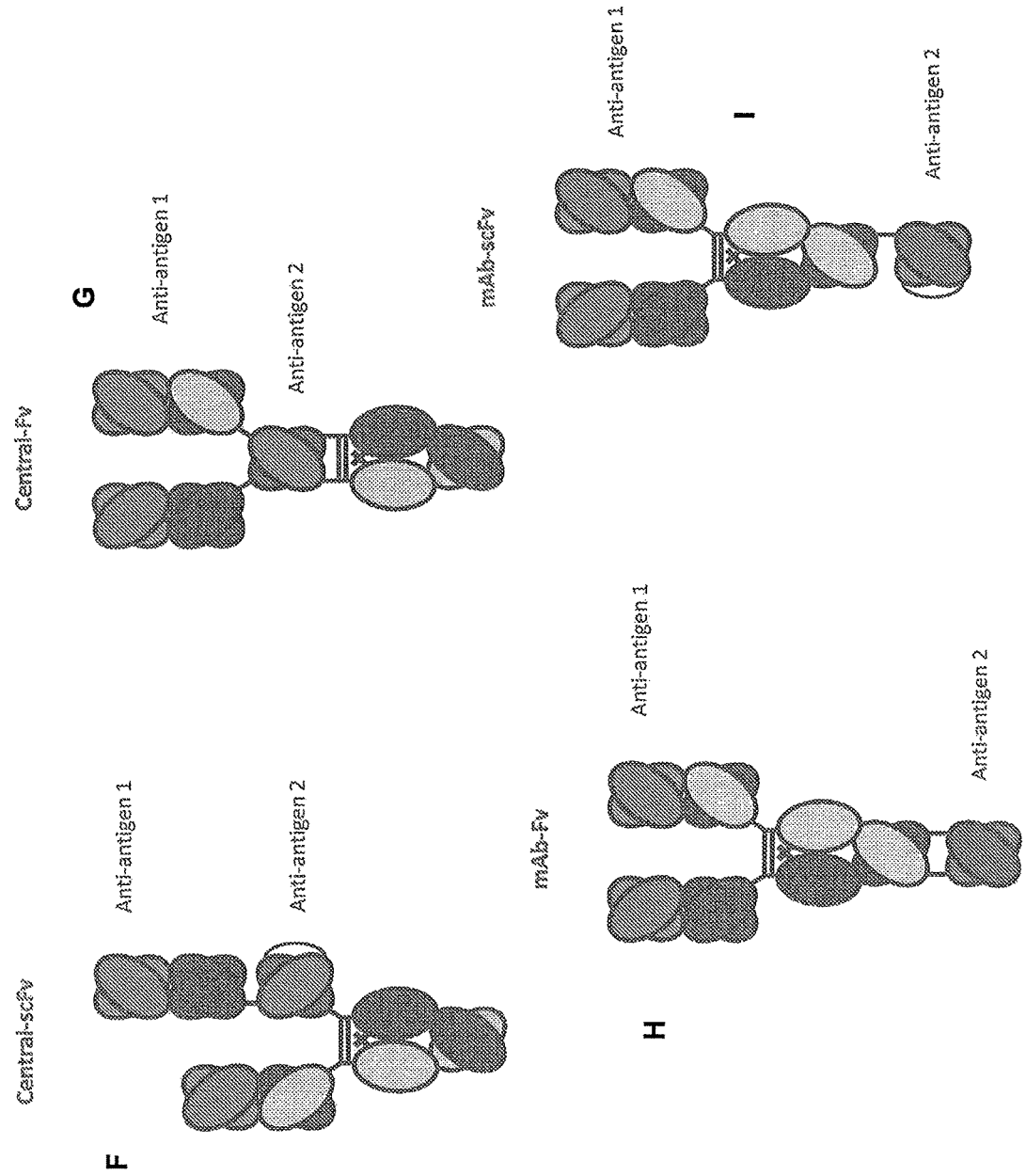

It should be noted that these bottle opener backbones find use in the Central-scFv format of FIG. 1F, where an additional, second Fab (vh-CH1 and vl-constant light) with the same antigen binding as the first Fab is added to the N-terminus of the scFv on the "bottle opener side".

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIG. 38A-38 D shows the sequences of a mAb-scFv backbone of use in the invention, to which the Fv sequences of the invention are added. mAb-scFv backbone 1 is based on human IgG1 (356E/358M allotype), and includes the S364K/E357Q:L368D/K370S skew variants, the N208D/Q295E/N384D/Q418E/N421D pI variants on the Fab side and the E233P/L234V/L235A/G236del/S267K ablation variants on both chains. Backbone 2 is based on human IgG1 (356D/358L allotype), and includes the S364K/E357Q:L368D/K370S skew variants, the N208D/Q295E/N384D/Q418E/N421D pI variants on the Fab side and the E233P/L234V/L235A/G236del/S267K ablation variants on both chains. Backbone 3 is based on human IgG1 (356E/358M allotype), and includes the S364K/E357Q:L368D/K370S skew variants, N208D/Q295E/N384D/Q418E/N421D pI variants on the Fab side and the E233P/L234V/L235A/G236del/S267K ablation variants on both chains, as well as an N297A variant on both chains. Backbone 4 is identical to 3 except the mutation is N297S. Alternative formats for mAb-scFv backbones 3 and 4 can exclude the ablation variants E233P/L234V/L235A/G236del/S267K in both chains. Backbone 5 is based on human IgG4, and includes the S364K/E357Q:L368D/K370S skew variants, the N208D/Q295E/N384D/Q418E/N421D pI variants on the Fab side and the E233P/L234V/L235A/G236del/S267K ablation variants on both chains, as well as a S228P (EU numbering, this is S241P in Kabat) variant on both chains that ablates Fab arm exchange as is known in the art. Backbone 6 is based on human IgG2, and includes the S364K/E357Q:L368D/K370S skew variants, the N208D/Q295E/N384D/Q418E/N421D pI variants on the Fab side. Backbone 7 is based on human IgG2, and includes the S364K/E357Q:L368D/K370S skew variants, the N208D/Q295E/N384D/Q418E/N421D pI variants on the Fab side as well as a S267K variant on both chains.

As will be appreciated by those in the art and outlined below, these sequences can be used with any vh and vl pairs outlined herein, with one monomer including both a Fab and an scFv (optionally including a charged scFv linker) and the other monomer including the Fab sequence (e.g. a vh attached to the "Fab side heavy chain" and a vl attached to the "constant light chain"). That is, any Fv sequences outlined herein for anti-CTLA-4, anti-PD-1, anti-LAG-3, anti-TIM-3, anti-TIGIT and anti-BTLA, whether as scFv (again, optionally with charged scFv linkers) or as Fabs, can be incorporated into this FIG. 38 backbone in any combination. The monomer 1 side is the Fab-scFv pI negative side, and includes the heterodimerization variants L368D/K370S, the isosteric pI variants N208D/Q295E/N384D/Q418E/N421D, the ablation variants E233P/L234V/L235A/G236del/S267K, (all relative to IgG1). The monomer 2 side is the scFv pI positive side, and includes the heterodimerization variants 364K/E357Q. However, other skew variant pairs can be substituted, particularly [S364K/E357Q: L368D/K370S]; [L368D/K370S:S364K]; [L368E/K370S: S364K]; [T411T/E360E/Q362E:D401K]; [L368D/K370S: S364K/E357L], [K370S:S364K/E357Q], [T366S/L368A/Y407V:T366W] and [T366S/L368A/Y407V/Y394C: T366W/S354C].

The constant light chain depicted in FIG. 38A can be used for all of the constructs in the figure, although the kappa constant light chain can also be substituted.

It should be noted that these mAb-scFv backbones find use in the both the mAb-Fv format of FIG. 1H (where one monomer comprises a vl at the C-terminus and the other a vh at the C-terminus) as well as the scFv-mAb format of FIG. 1E (with a scFv domain added to the C-terminus of one of the monomers).

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIG. 39A-39B depicts a matrix of possible combinations for the bispecific checkpoint antibodies of the present invention. In FIG. 39A, the combinations are not bound by format, and any format of FIG. 1 can be used. An "A" in a box means that the CDRs from the first ABD (listed on the X axis) can be combined with the CDRs of the second ABD (listed on Y axis). A "B" in the box means the vh and vl chains from the first ABD can be combined with the vh and vl chains from the second ABD. A "C" in the box means that the CDRs from the first ABD can be combined with the vh and vl chains from the second ABD. A "D" in the box means that the vh and vl chains from the first ABD can be combined with the CDRs from the second ABD. An "E" in the box means that the PD-1 ABD is selected from the group of 1G6_H1.279_L1.194; 1G6_H1.280_L1.224; 1G6_L1.194_H1.279; 1G6_L1.210_H1.288; and 2E9_H1L1. An "F" in the box means that the CTLA-4 ABD is selected from the group of [CTLA-4]_H0.25_L0; [CTLA-4]_H0.26_L0; [CTLA-4]_H0.27_L0; [CTLA-4]_H0.29_L0; [CTLA-4]_H0.38_L0; [CTLA-4]_H0.39_L0; 0[CTLA-4]_H0.40_L0; [CTLA-4]_H0.70_L0; [CTLA-4]_H0_L0.22; [CTLA-4]_H2_L0; [CTLA-4]_H3.21_L0.124; [CTLA-4]_H3.21_L0.129; [CTLA-4]_H3.21_L0.132; [CTLA-4]_H3.23_L0.124; [CTLA-4]_H3.23_L0.129; [CTLA-4]_H3.23_L0.132; [CTLA-4]_H3.25_L0.124; [CTLA-4]_H3.25_L0.129; [CTLA-4]_H3.25_L0.132; [CTLA-4]_H3.4_L0.118; [CTLA-4]_H3.4_L0.119; [CTLA-4]_H3.4_L0.12; [CTLA-4]_H3.4_L0.121; [CTLA-4]_H3.4_L0.122; [CTLA-4]_H3.4_L0.123; [CTLA-4]_H3.4_L0.124; [CTLA-4]_H3.4_L0.125; [CTLA-4]_H3.4_L0.126; [CTLA-4]_H3.4_L0.127; [CTLA-4]_H3.4_L0.128; [CTLA-4]_H3.4_L0.129; [CTLA-4]_H3.4_L0.130; [CTLA-4]_H3.4_L0.131; [CTLA-4]_H3.4_L0.132; [CTLA-4]_H3.5_L2.1; [CTLA-4]_H3.5_L2.2; [CTLA-4]_H3.5_L2.3; [CTLA-4]_H3_L0; [CTLA-4]_H3_L0.22; [CTLA-4]_H3_L0.44;

[CTLA-4]_H3_L0.67; and [CTLA-4]_H3_L0.74. A "G" in the box means that the TIM-3 ABD is selected from the group of 1D10_H0L0; 1D12_H0L0; 3H3_H1_L2.1; 6C8_H0L0; 6D9_H0_1D12_L0; 7A9_H0L0; 7B11_H0L0; 7B11var_H0L0; and 7C2_H0L0. An "H" in the box means that the LAG-3 ABD is selected from the group of identifiers 2A11_H0L0; 2A11_H1.125_L2.113; 2A11_H1.144_L2.142; 2A11_H1_L2.122; 2A11_H1_L2.123; 2A11_H1_L2.124; 2A11_H1_L2.25; 2A11_H1_L2.47; 2A11_H1_L2.50; 2A11_H1_L2.91; 2A11_H1_L2.93; 2A11_H1_L2.97; 2A11_H1L1; 2A11_H1L2; 2A11_H2L2; 2A11_H3L1; 2A11_H3L2; 2A11_H4L1; 2A11_H4L2; 7G8_H0L0; 7G8_H1L1; 7G8_H3.18_L1.11; 7G8_H3.23_L1.11; 7G8_H3.28_L1; 7G8_H3.28_L1.11; 7G8_H3.28_L1.13; 7G8_H3.30_L1.34; 7G8_H3.30_L1.34; and 7G8_H3L1. An "I" in box means that A "J" in the box means that the BTLA ABD is selected from the group 9C6_H0L0; 9C6_H1.1_L1; and 9C6_H1.11_L1. FIG. 39B is identical to FIG. 39A except that FIG. 39B is specific to the bottle opener format. In B, when the first ABD binds PD-1, the first ABD is the scFv monomer, and the other ABD (CTLA-4, LAG-3, TIGIT, TIM-3 and BTLA) are in the Fab monomer. In B, when the first ABD binds CTLA-4, it is in the scFv monomer (except when combined with PD-1, when it is the Fab side), with the other ABD (CTLA-4, LAG-3, TIGIT, TIM-3 and BTLA) are in the Fab monomer.

FIG. 40 depicts a matrix of possible bottle opener format combinations. A "Q" in the box means that the first ABD domain (again, listed on the X axis) is the scFv and the second ABD (again, listed on the Y axis) is the Fab side. An "R" in the box means that the first ABD is the Fab side and the second ABD is the scFv. An "S" in the box means that the first ABD is anti-PD-1 and is the scFv side. A "T" in the box means that the first ABD is anti-CTLA-4 and is the scFv side. A "U" in the box means that the first ABD is anti-TIM-3 and is the scFv side. A "V" in the box means that the first ABD is anti LAG-3 and is the scFv side. A "W" in the box means that the first ABD is anti TIGIT and is the scFv side. An "X" in the box means that the first ABD is anti-BTLA and is the scFv side. In addition, each combination outlined in FIG. 39 can use the CDRs, scFvs and vh and vl combinations of FIG. 38. In addition, particular embodiments of the bottle opener backbones of FIG. 39 are the sequences of FIG. 36.

Figure 41A:
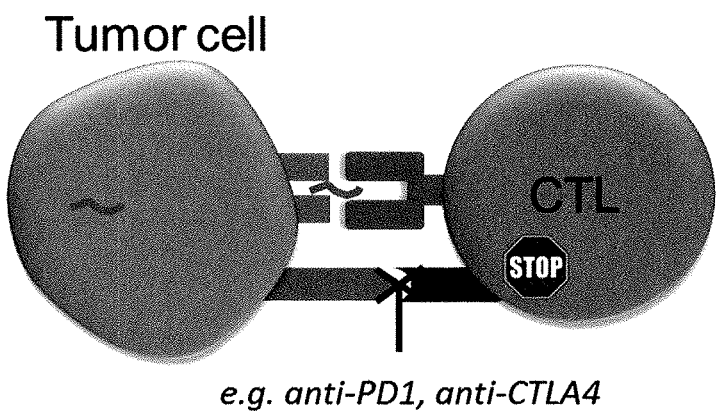
Figure 41B:
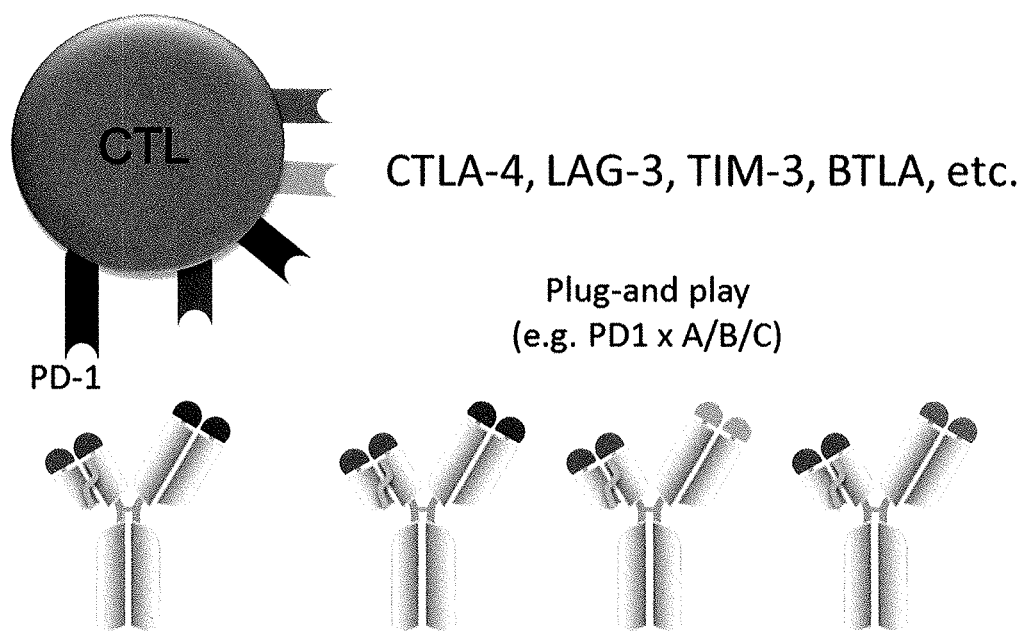

FIG. 41A-41B depicts a schematic associated with the benefit that a bispecific checkpoint antibody can provide over combination therapies using two different antibodies or drugs.

Figure 42:
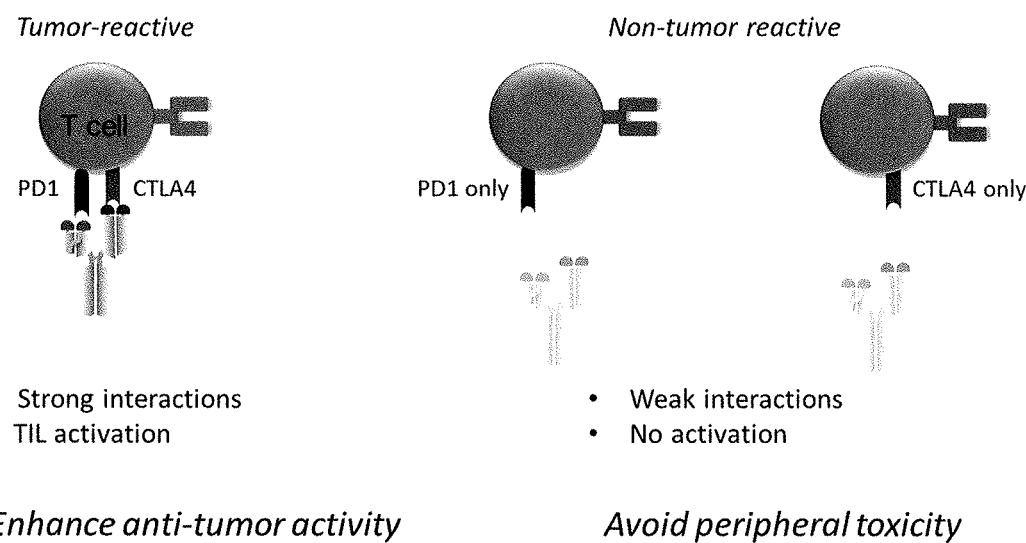

FIG. 42 depicts a similar schematic, showing that because tumor TILs co-express multiple checkpoints, a bivalent binding increases avidity, enhancing anti-tumor activity and avoiding peripheral toxicity.

Figure 43:
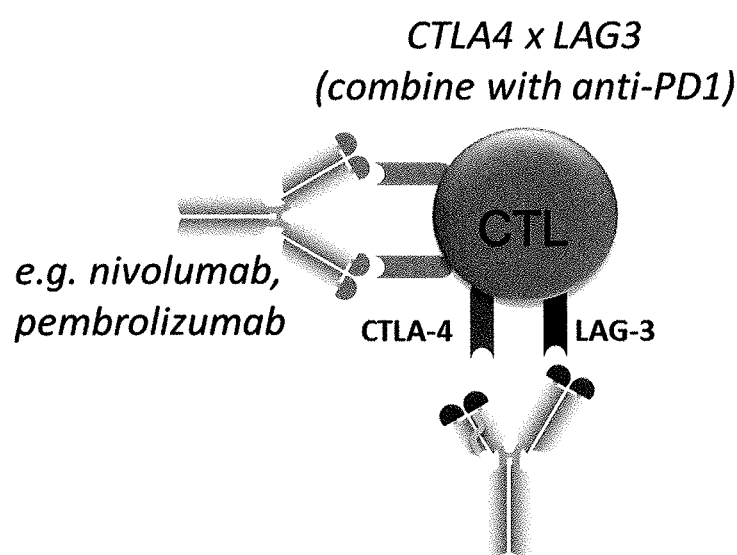

FIG. 43 shows that bispecific checkpoint antibodies of the invention (e.g. anti-LAG-3×anti-CTLA-4) can be combined with other monospecific checkpoint antibodies (e.g. nivolumab, pemobrolizumab).

Figure 44:
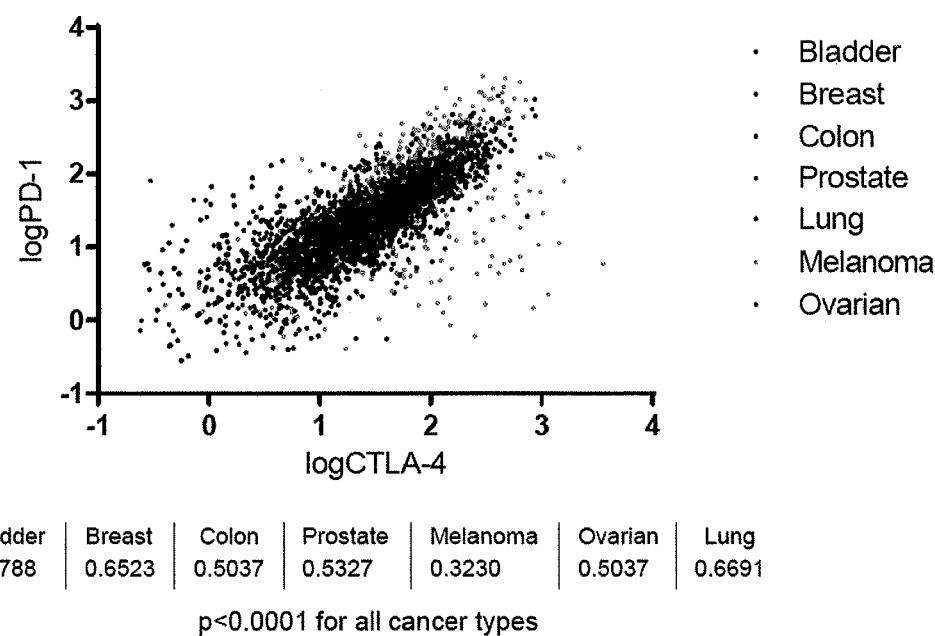

FIG. 44 shows that PD-1 and CTLA-4 are coexpressed in a variety of tumor types, including bladder, breast, colon, prostate, lung, melanoma and ovarian cancer.

Figure 45A:
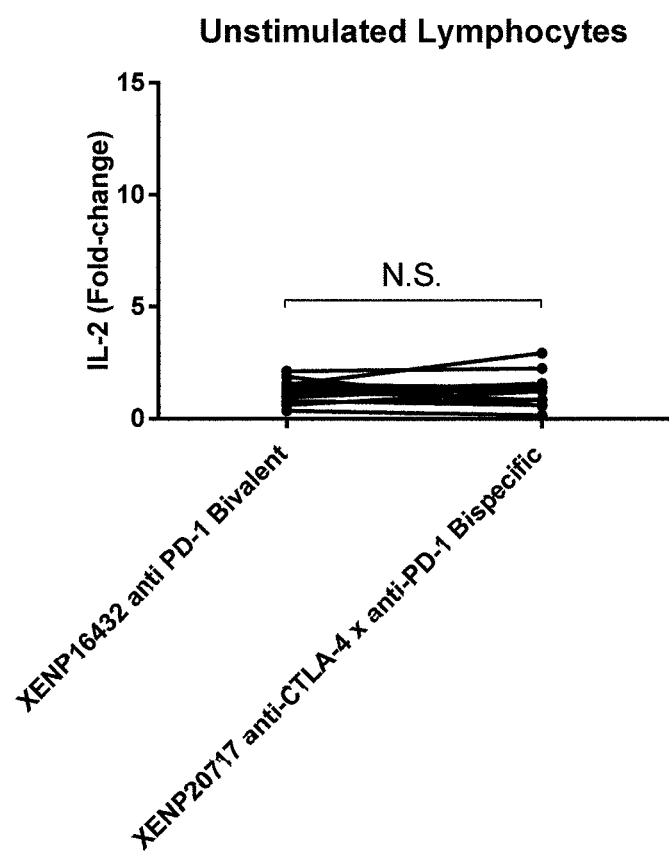
Figure 45B:
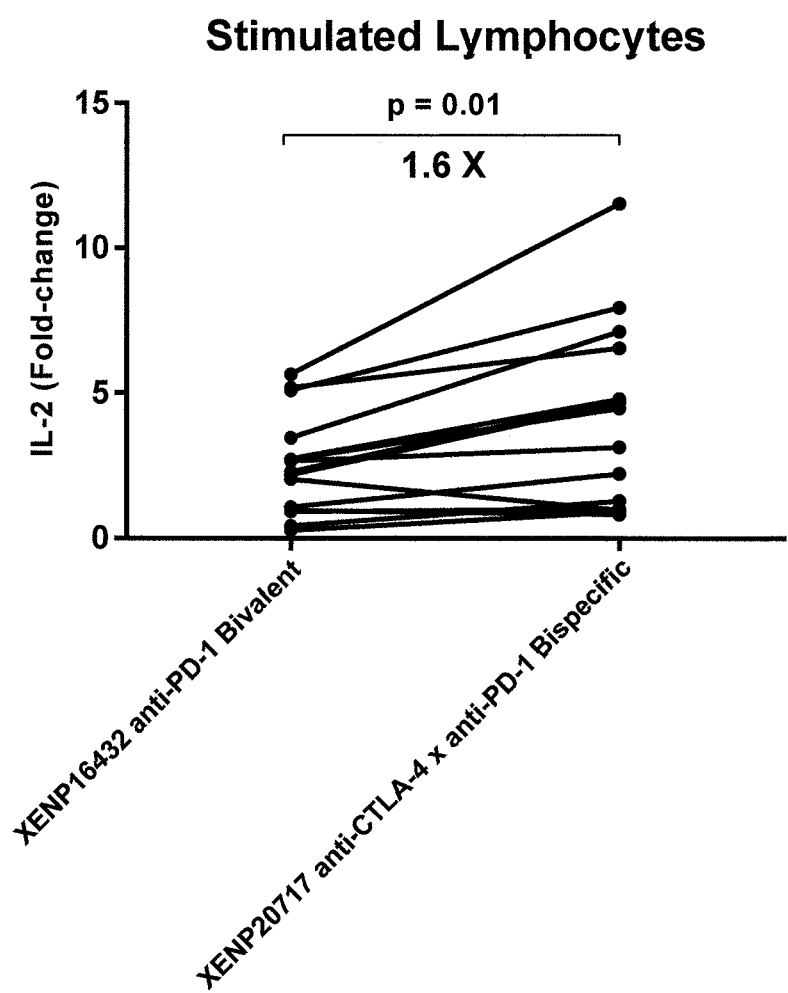
Figure 45C:
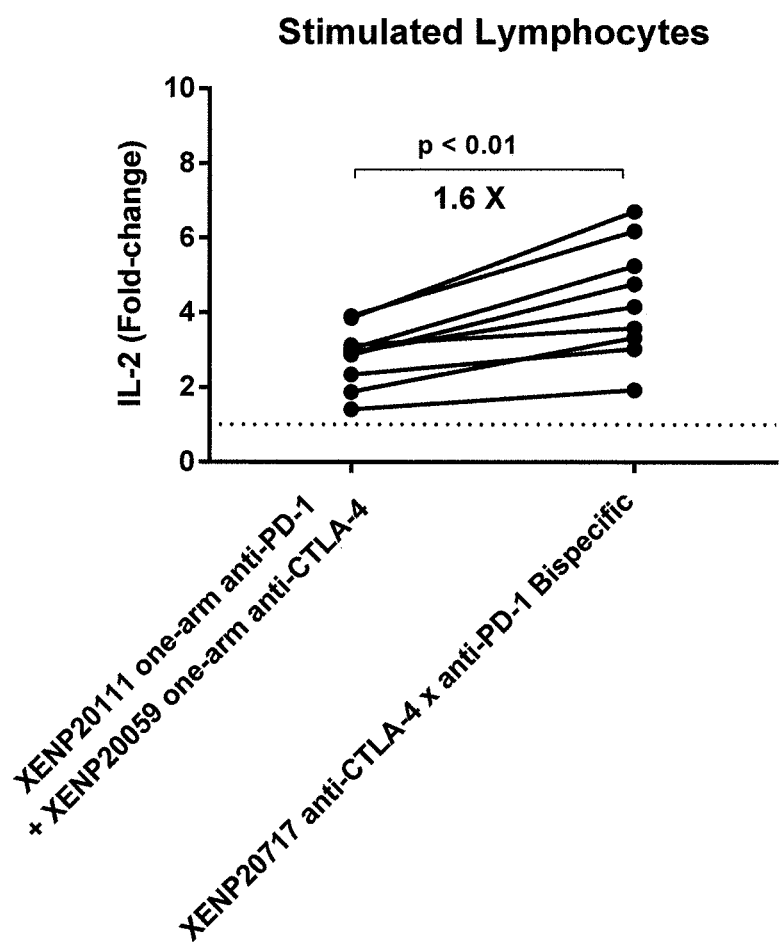

FIG. 45A-45C depicts a comparison of the enhancement of IL-2 B) by anti-PD-1 bivalent and anti-CTLA-4×anti-PD-1 and C) and one-arm anti-PD-1+one-arm anti-CTLA-4 and anti-CTLA-4×anti-PD-1 in an SEB-stimulated PBMC assay as well as C) a control experiment without SEB stimulation.

Figure 46A:
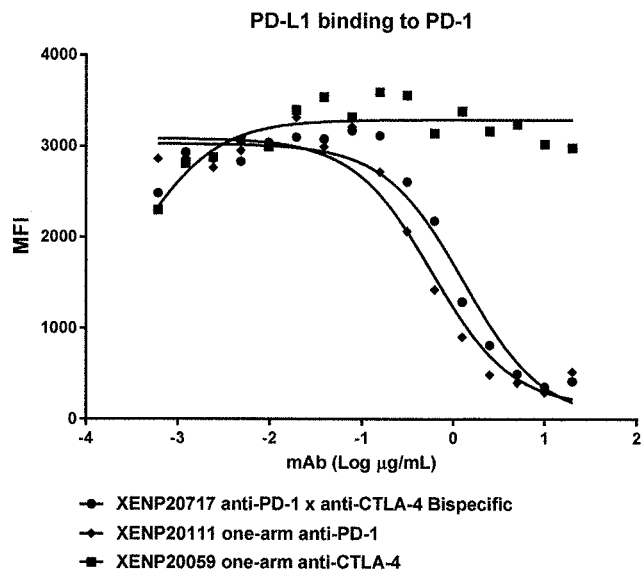
Figure 46B:
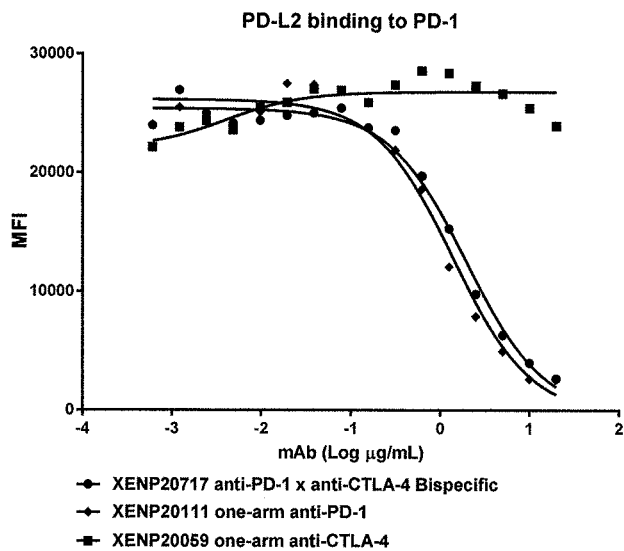

FIG. 46A-46B depicts blocking of PD-1 to ligands PD-L1 and PD-L2 by an exemplary anti-CTLA-4×anti-PD-1 bispecific in comparison to one-arm anti-PD-1 and one-arm anti-CTLA-4 antibodies.

Figure 47:
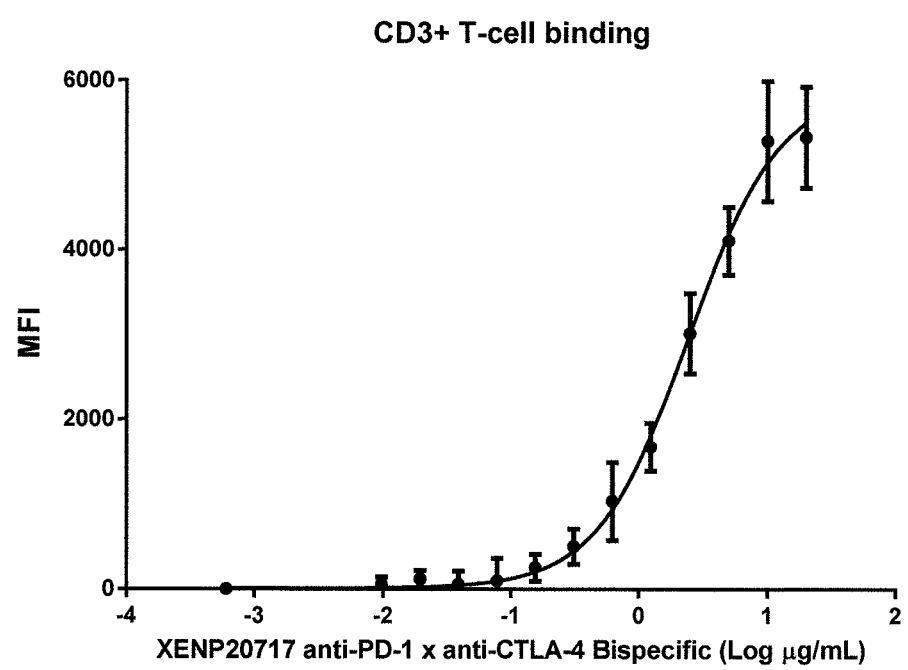

FIG. 47 depicts T cell binding in an SEB-stimulated PBMC assay by an exemplary anti-CTLA-4×anti-PD-1 bispecific antibody.

Figure 48:
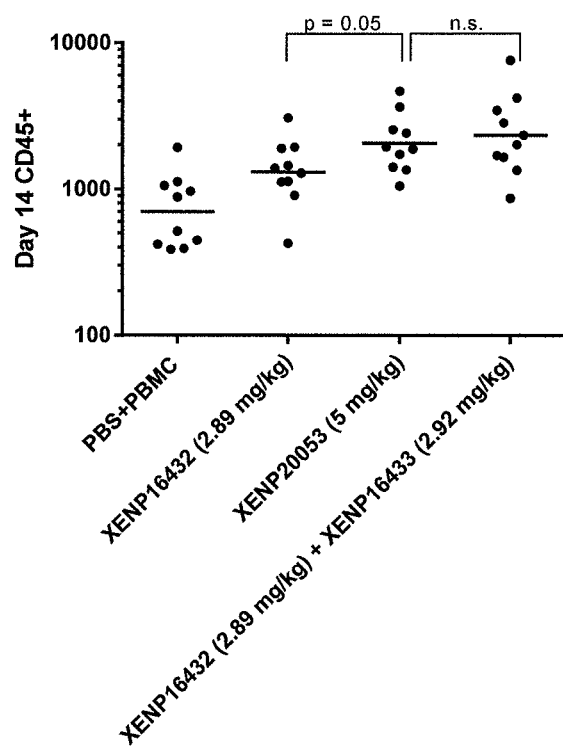

FIG. 48 shows that anti-CTLA-4×anti-PD-1 bispecifics enhance engraftment (as measured by human CD45 counts) in human PBMC-engrafted NSG mice. Enhancement is greater than that seen with nivolumab (XENP16432) alone.

Figure 49:
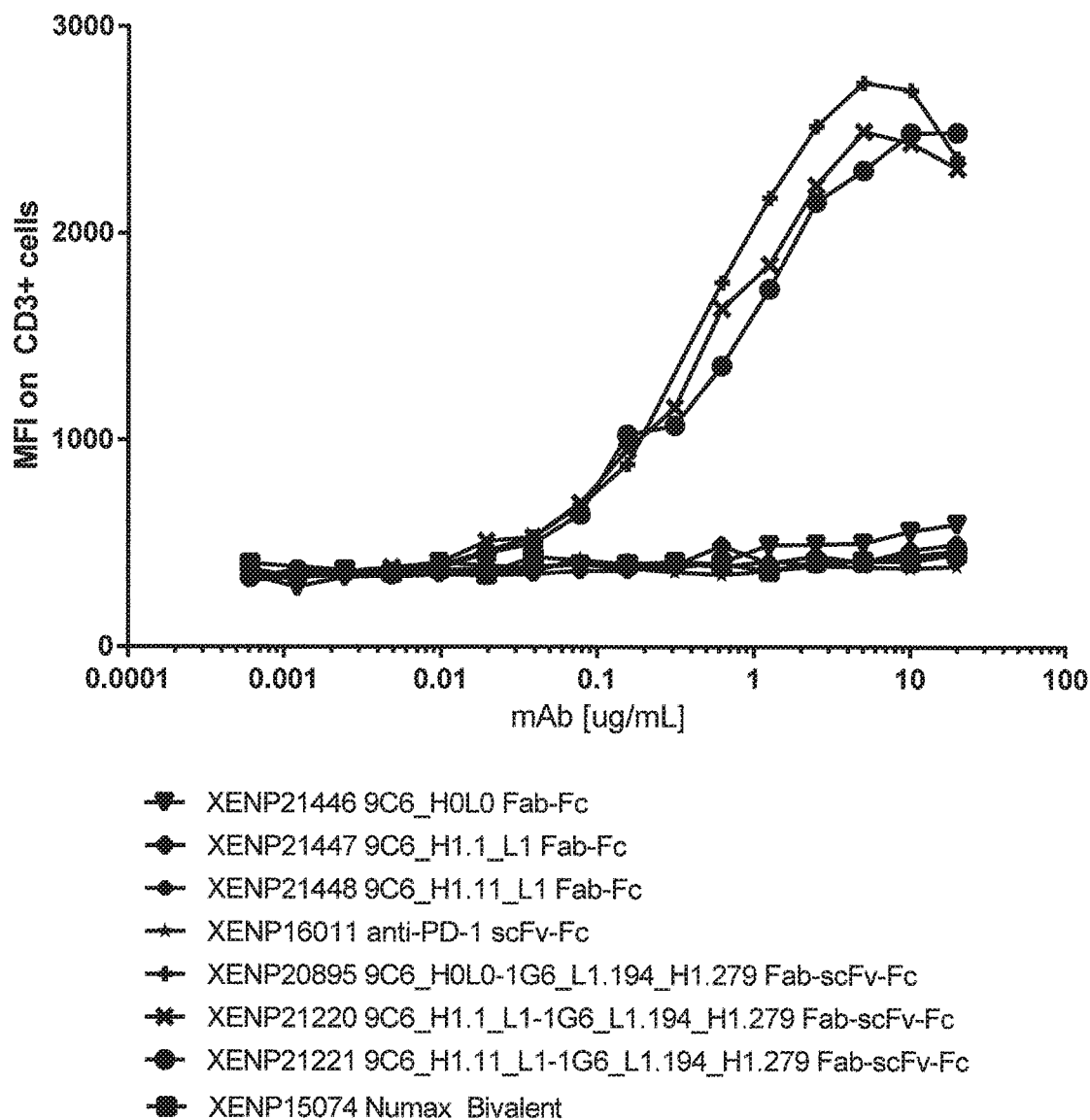

FIG. 49 shows that the anti-BTLA×anti-PD-1 bispecific candidates bind more avidly to T cells compared to "one-armed" controls in an SEB-stimulated PBMC assay.

Figure 50A:
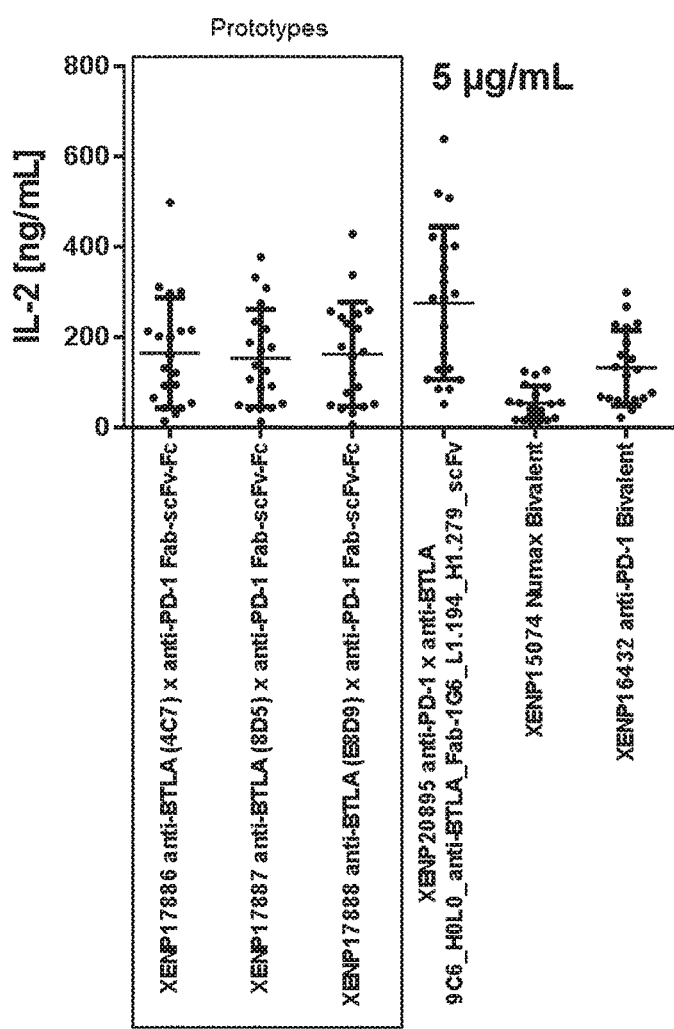
Figure 50B:
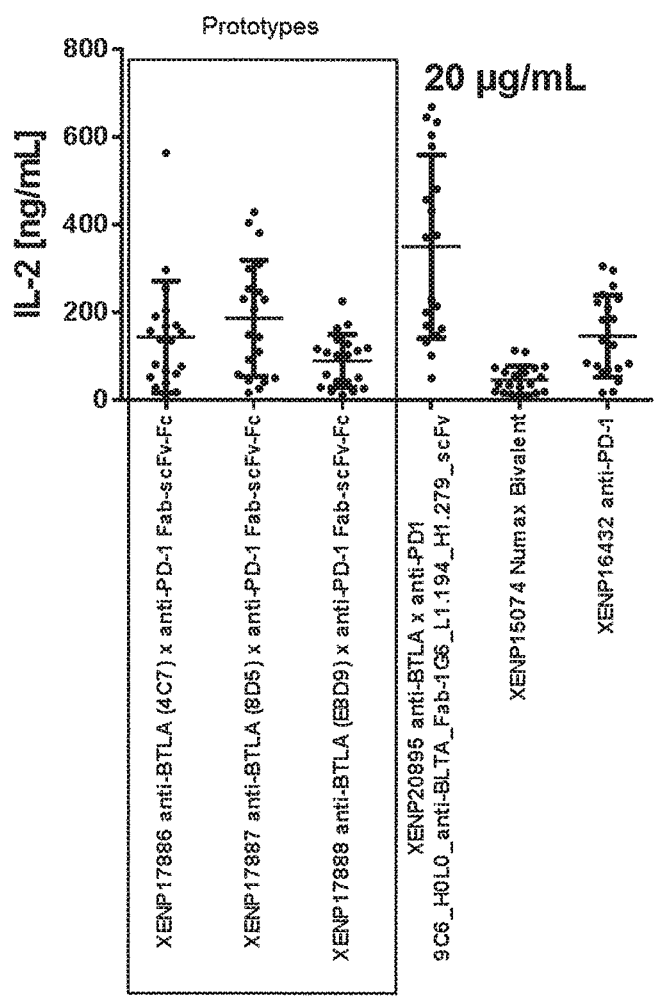

FIG. 50A-50B show that anti-BTLA×anti-PD-1 chimeric bispecific promotes IL-2 secretion from SEB stimulated PBMCs. PBMCs were stimulated with 10 ng/mL SEB for 3 days with indicated test articles. Cell supernatants were collected and assayed with MSD for indicated analyte. A: 20 µg/mL test article; B 5 µg/mL test article.

Figure 51A:
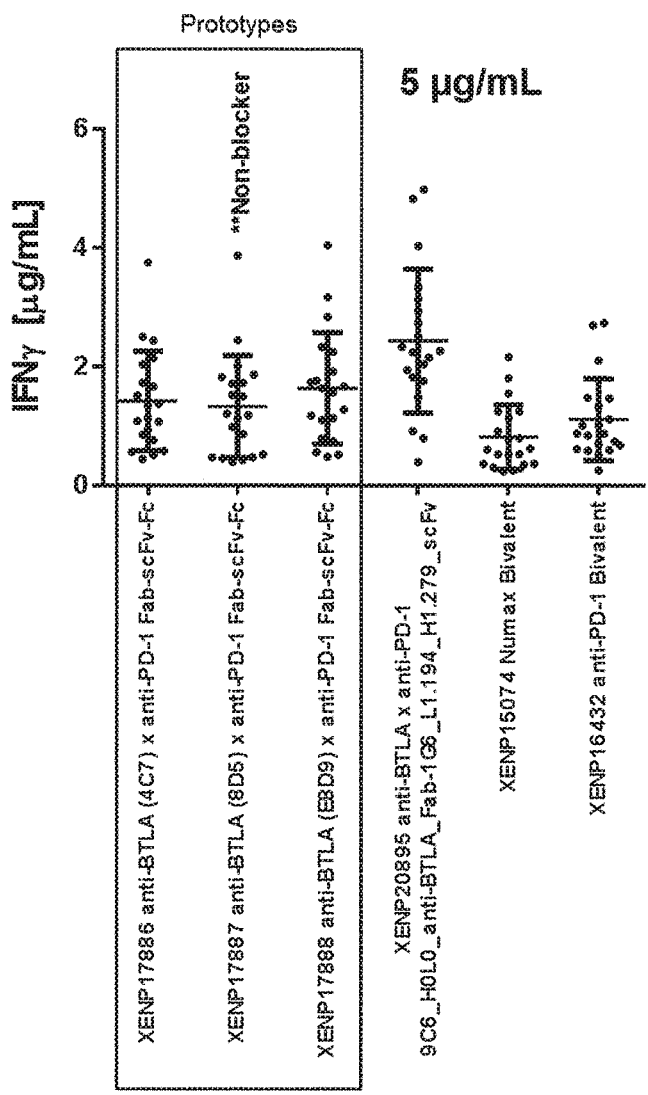
Figure 51B:
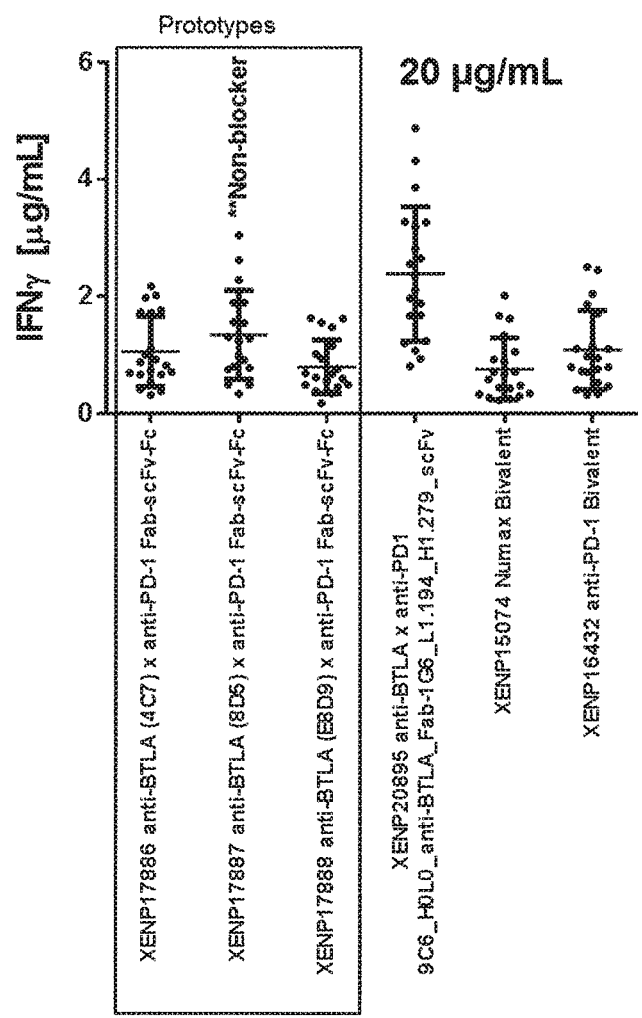

FIG. 51A-51B show that anti-BTLA×anti-PD-1 chimeric bispecific promotes IFNγ secretion from SEB stimulated PBMCs. PBMCs were stimulated with 10 ng/mL SEB for 3 days with indicated test articles. Cell supernatants were collected and assayed with MSD for indicated analyte. A: 20 µg/mL test article; B 5 µg/mL test article.

Figure 52A:
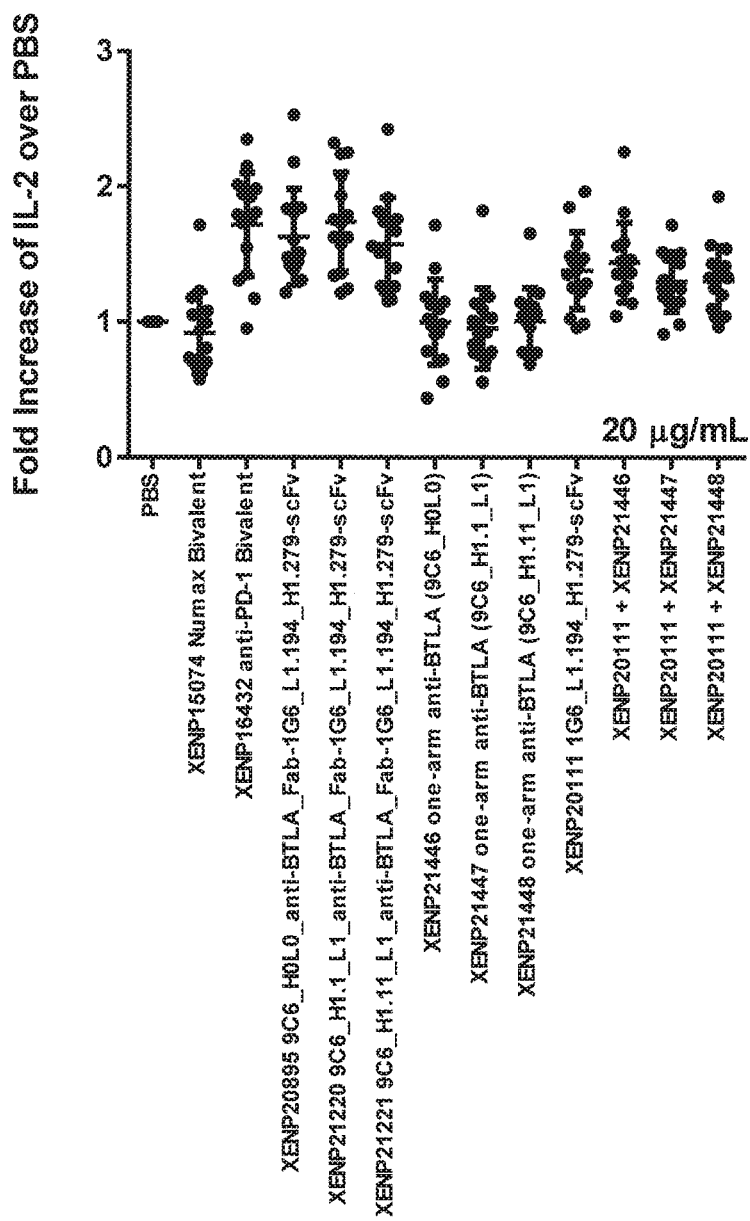
Figure 52B:
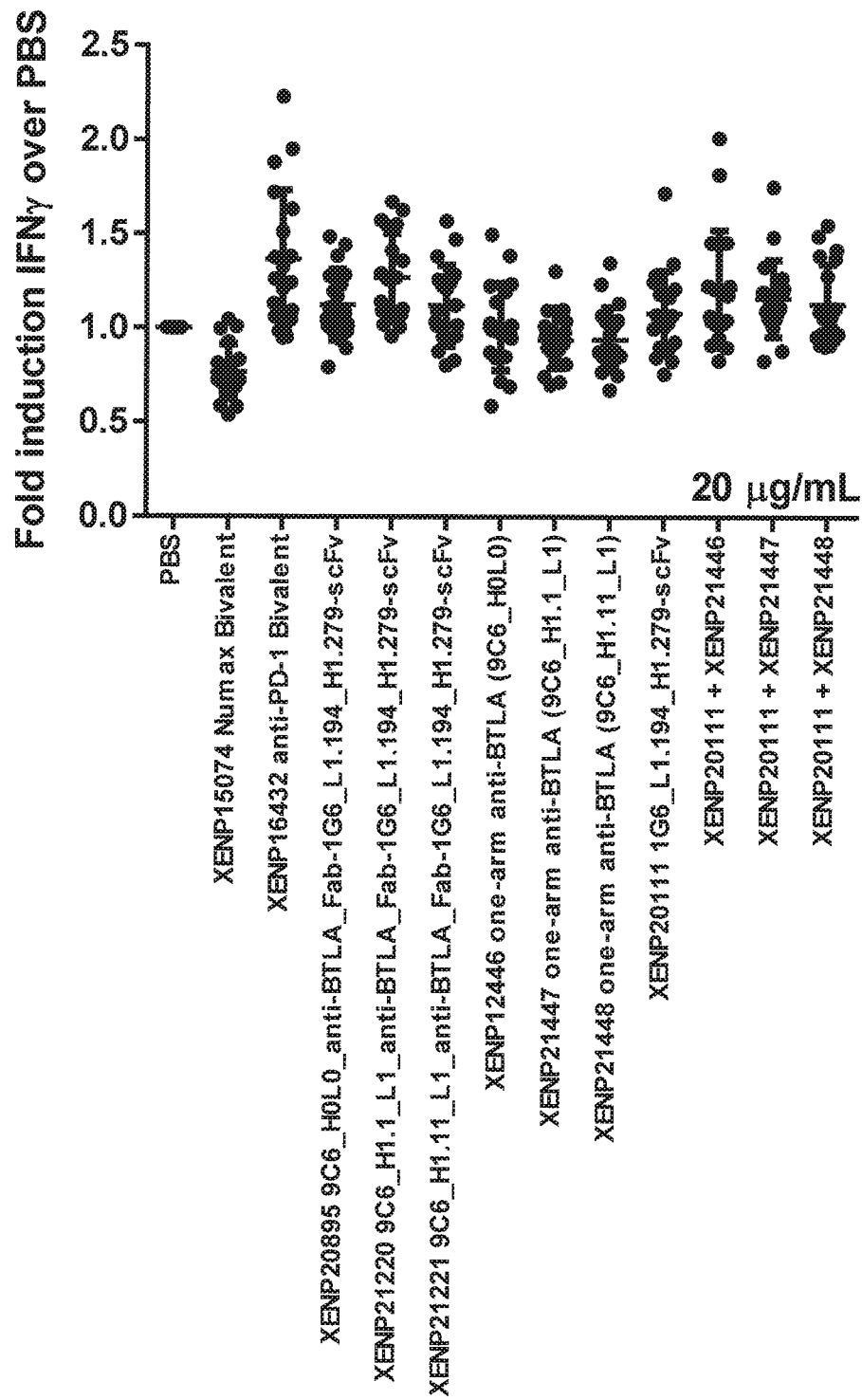
Figure 53A:
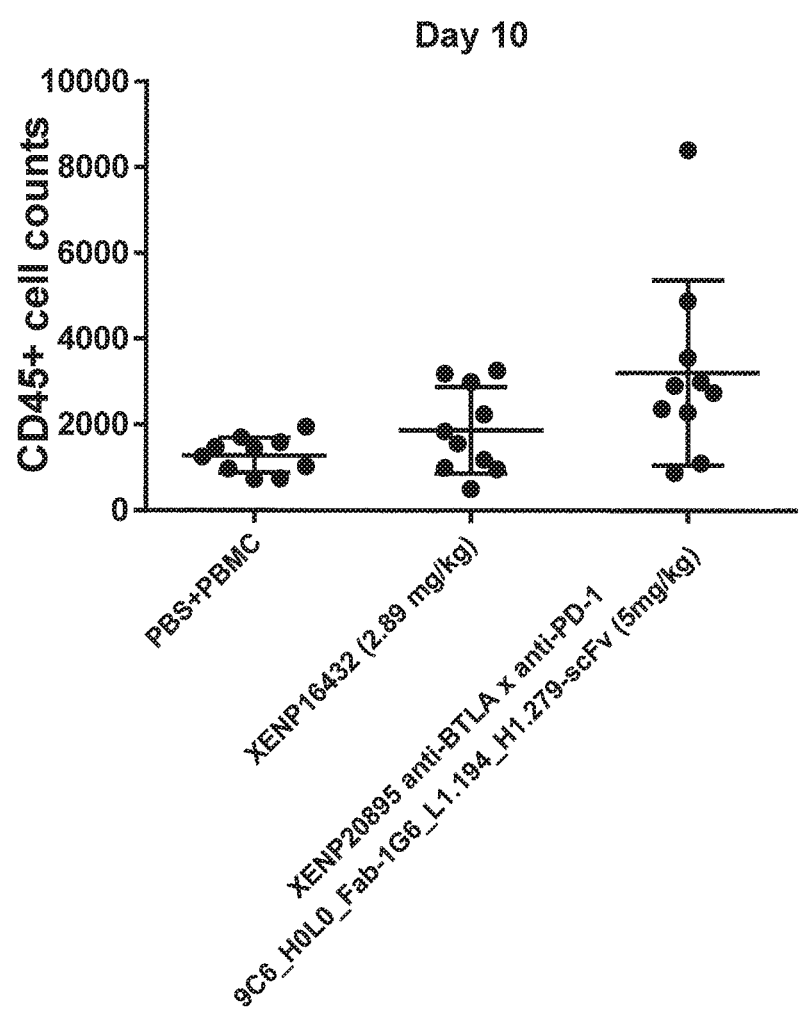
Figure 53B:
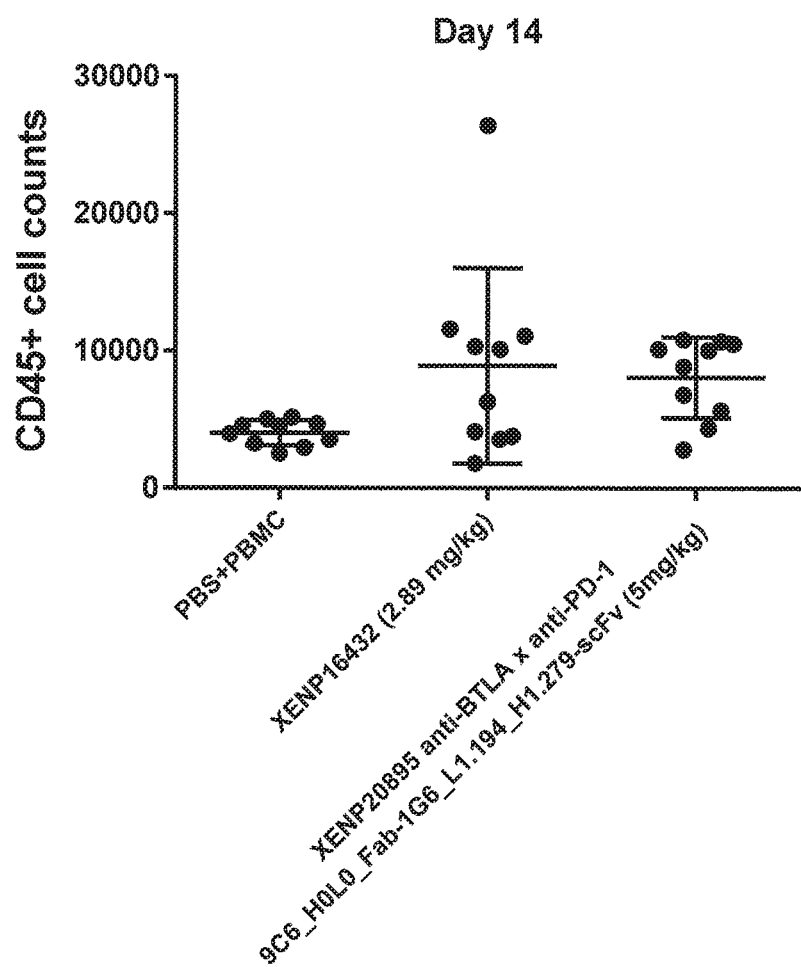
Figure 53C:
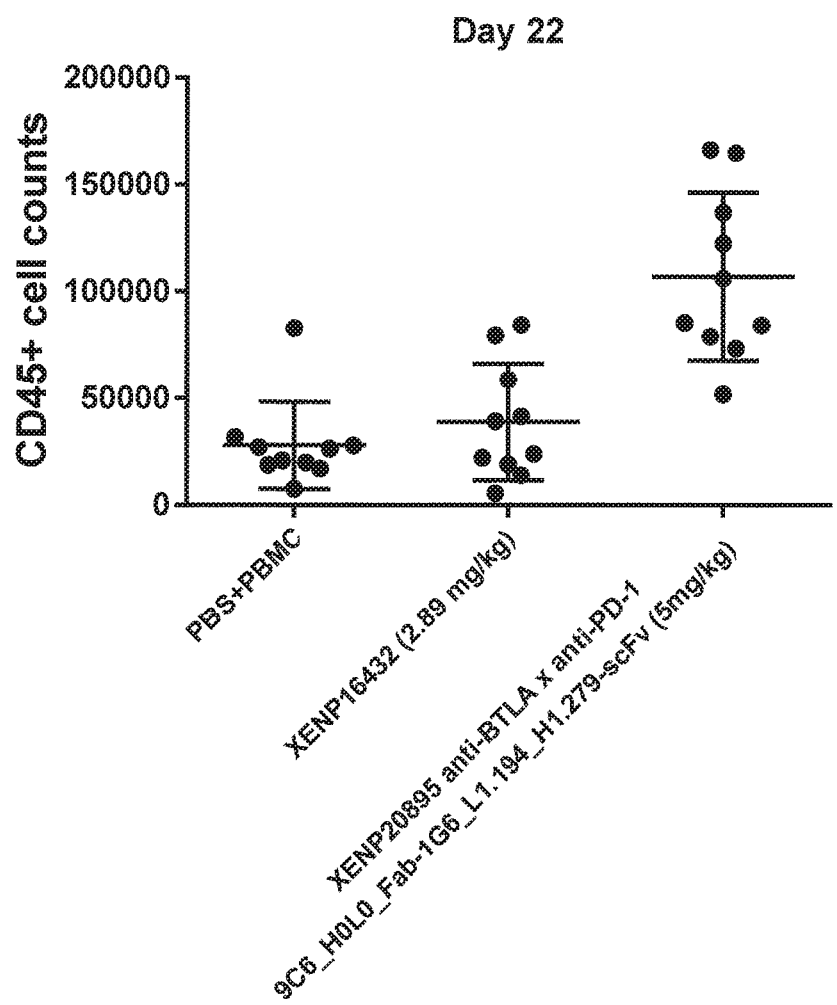
Figure 53D:
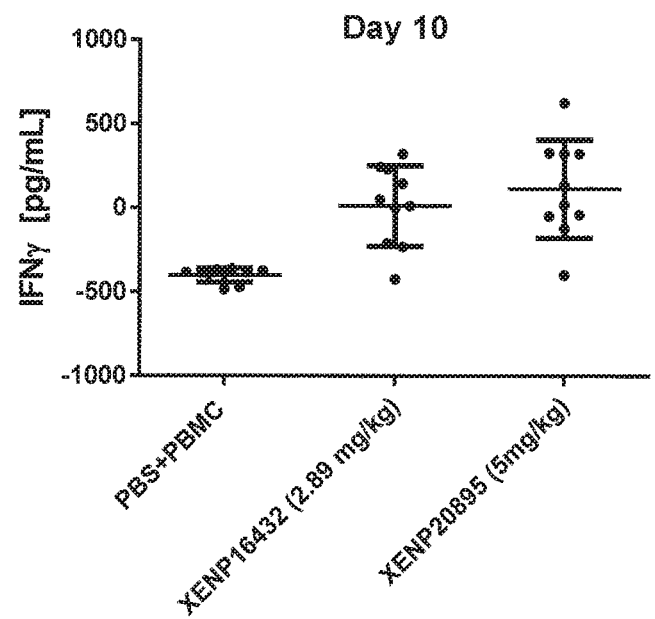
Figure 53E:
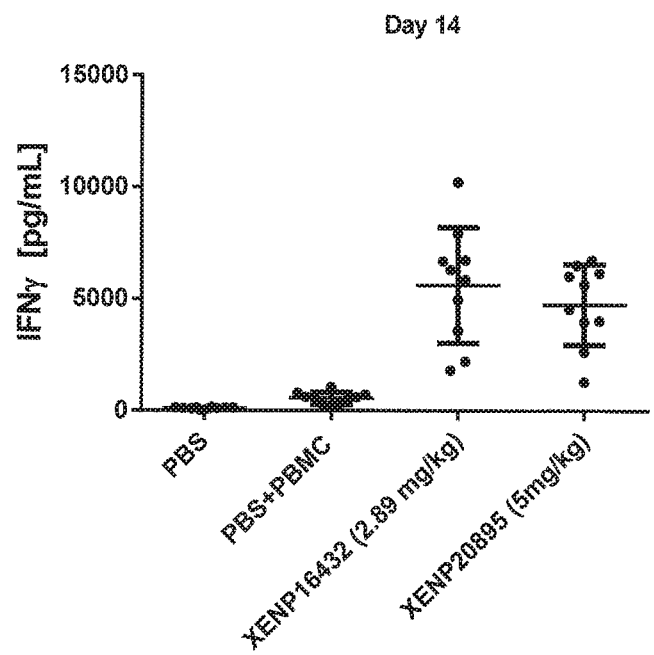
Figure 53F:
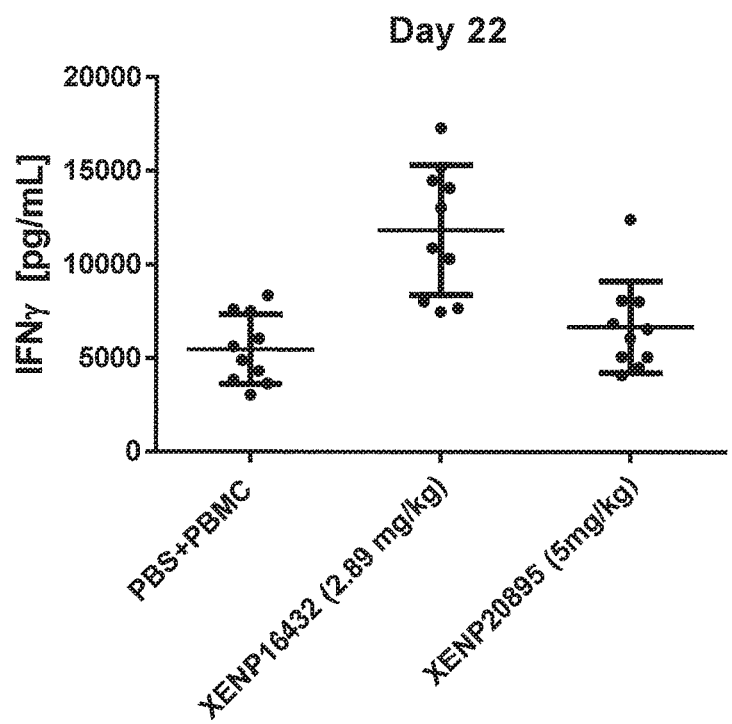

FIG. 52A-52B shows that anti-BTLA×anti-PD-1 bispecific antibodies (chimeric and with humanized/optimized anti-BTLA Fab arms) promotes IL-2 secretion and IFN-γ from SEB stimulated PBMCs. Both panels were PBMCs stimulated with 10 ng/mL SEB for 3 days with indicated 20 µg/mL test articles. Cell supernatants were collected 72 hours later and assayed for indicated analyte.

FIG. 53A-53F shows the time course (Days 10, 14 and 22) enhancement in CD45 cell counts and IFNγ secretion by an exemplary anti-BTLA×anti-PD-1 bispecific antibody in a GVHD study.

FIG. 54 depicts some 9C6 anti-BTLA antigen binding domain engineering data. This depicts XENP code for bivalent embodiments, the designations of the vh and vl engineered domains, and the KD binding constant against human BTLA as measured by OCTET®.

FIG. 55A-55E depicts some 2A11 anti-LAG-3 antigen binding domain engineering data. This depicts XENP code for Fab embodiments, the designations of the vh and vl engineered domains, the KD binding constant against human LAG-3 as measured by OCTET® and the Tm of the Fab.

FIG. 56A-56K depicts some 7G8 anti-LAG-3 antigen binding domain engineering data. This depicts XENP code for Fab embodiments, the designations of the vh and vl engineered domains, the KD binding constant against human LAG-3 as measured by OCTET® and the Tm of the Fab.

FIG. 57A-57B depicts the Kds for anti-LAG-3×anti-CTLA-4 bispecific, heterodimeric bottle opener formats based on either optimized 2A11 or 7G8 anti-LAG-3 Fab arms as measured by OCTET®.

Figure 58:
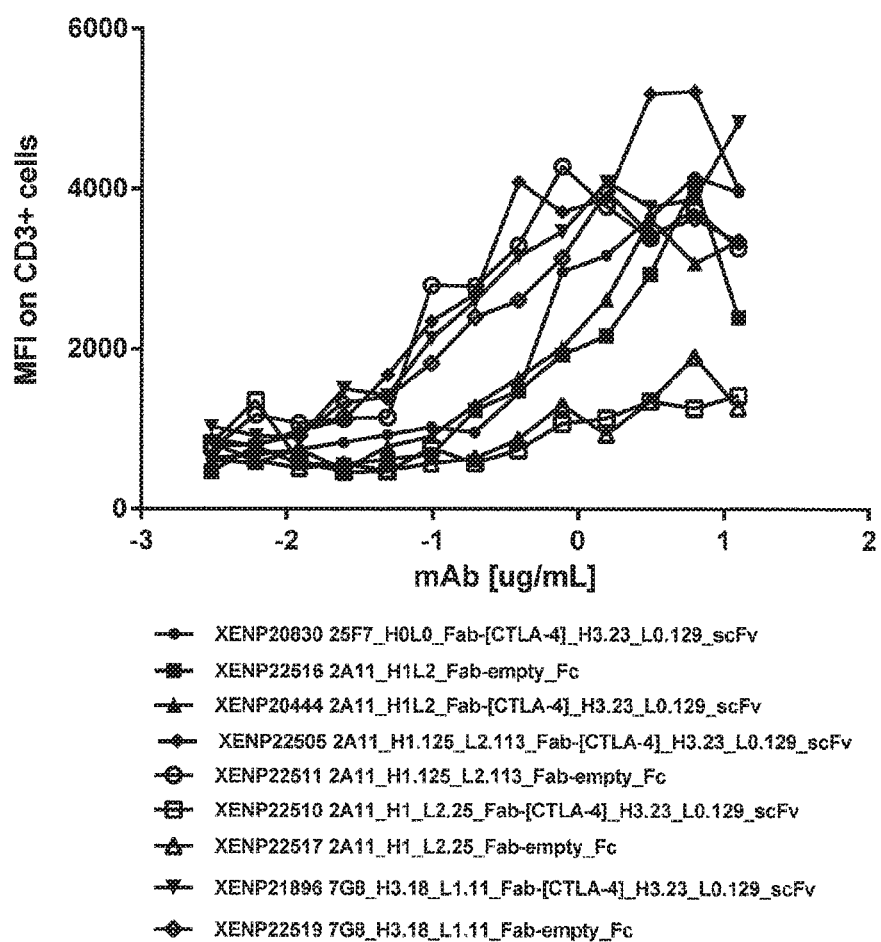

FIG. 58 shows that anti-LAG-3 (7G8)×anti-CTLA-4 and anti-LAG-3 (2A11)×anti-CTLA-4 bispecifics bind more avidly than one-armed anti-LAG-3 controls. PBMCs were stimulated with 100 ng/mL SEB for 3 days. Cells were then treated with the indicated test articles for 30 min at 4C degrees and washed twice. Cells were then treated with an anti-CD3-FITC and anti-human-Fc-APC antibody. Cells were then washed twice and analyzed by flow cytometry.

Figure 59A:
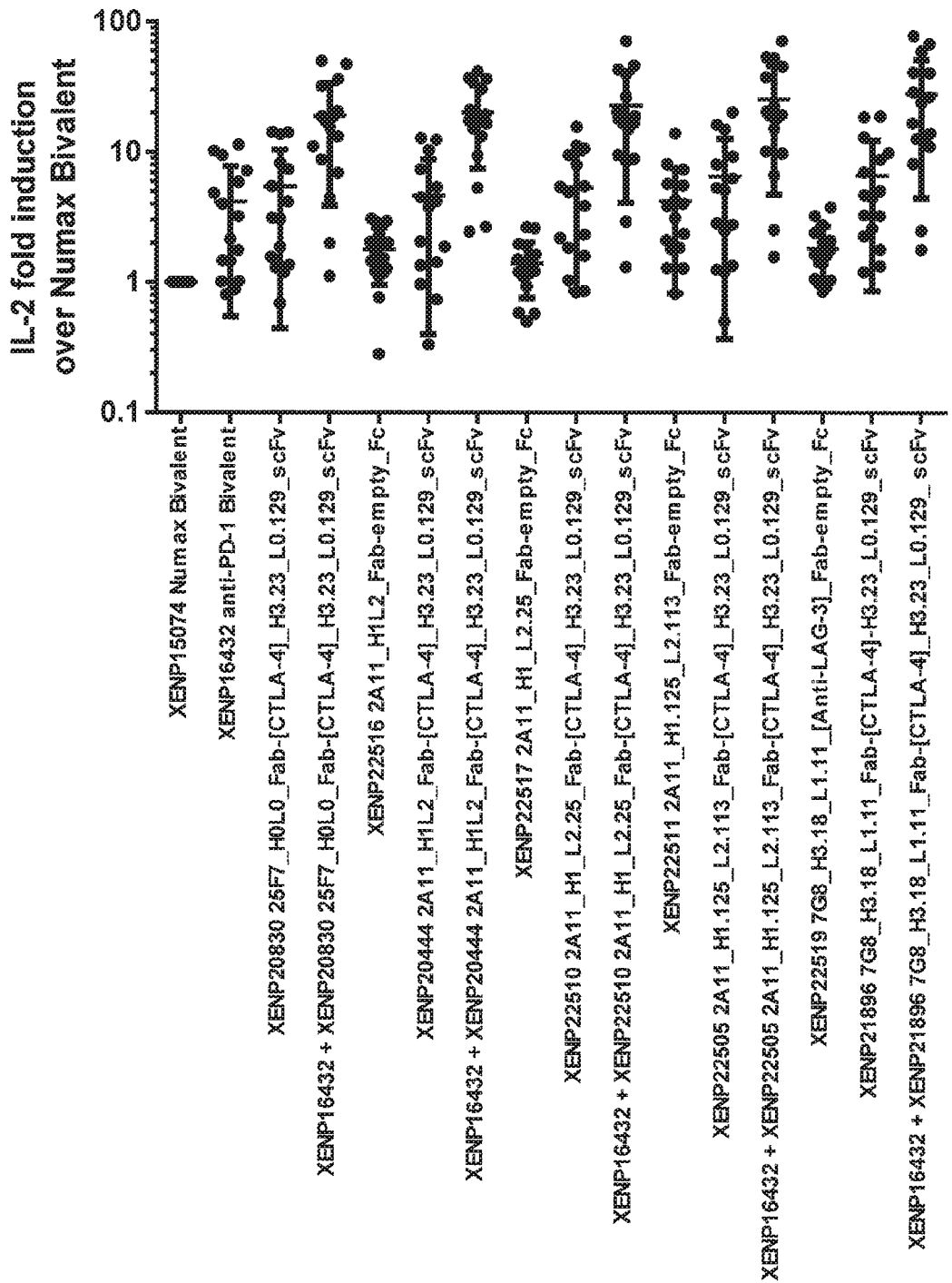
Figure 59B:
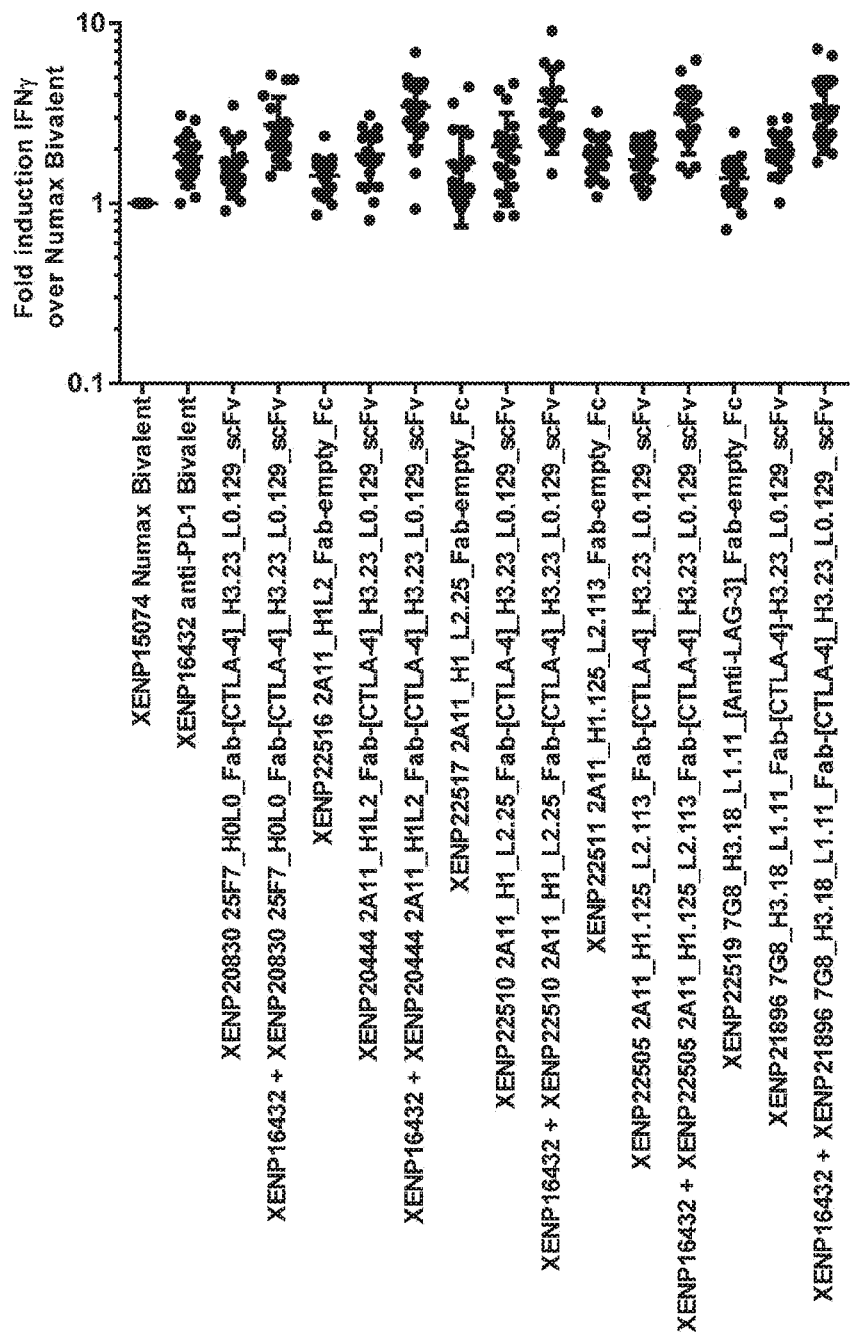

FIG. 59A-59B shows that 7G8 based anti-LAG-3×anti-CTLA-4 bispecifics exhibit more selective function on PBMCs than 2A11 based anti-LAG-3×anti-CTLA-4 bispecifics as indicated by enhancement in IL-2 and IFNγ release. PBMCs were stimulated with 500 ng/mL of SEB for 2 days. Cells were then washed twice in culture medium and stimulated with 500 ng/mL SEB in combination with the indicated amounts of test articles. Cells were assayed for the indicated analyte (either IL-2 or IFN-γ) 24 hours after treatment. Each point represents a unique donor tested in technical singlet.

Figure 60A:
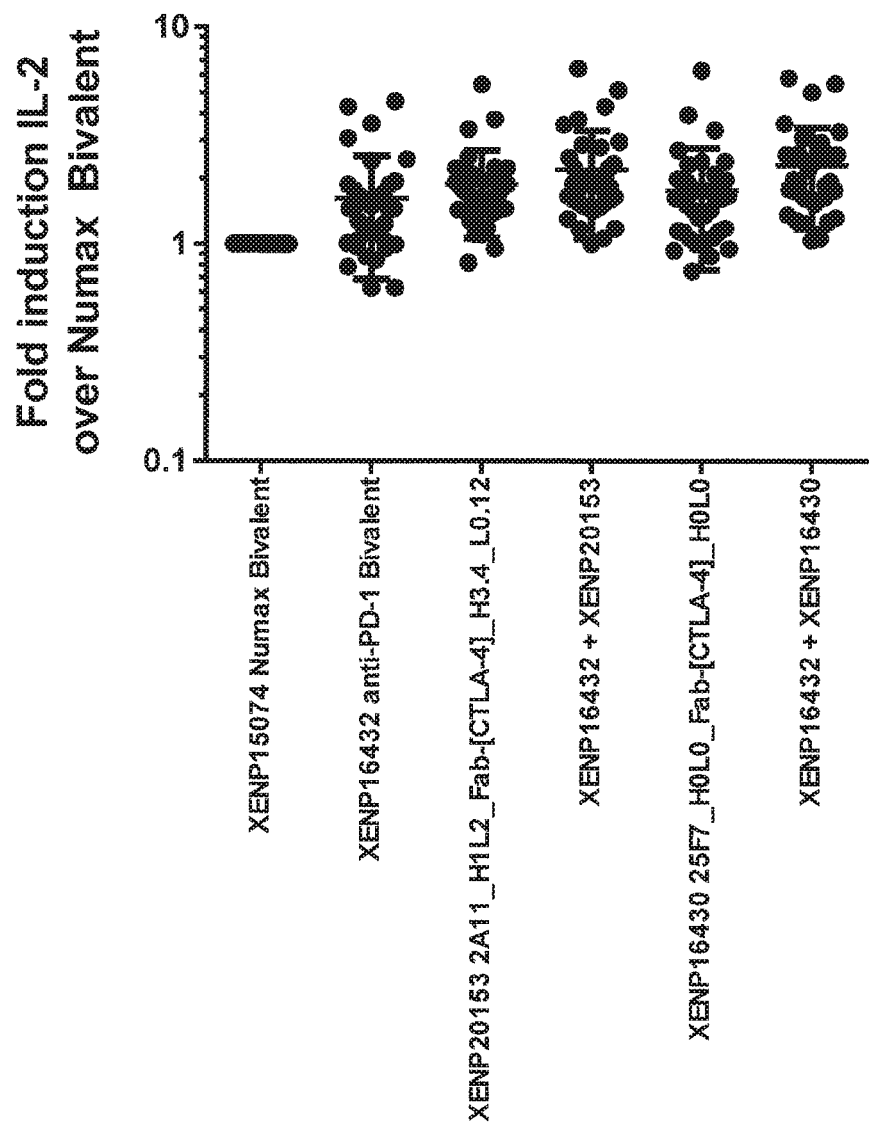
Figure 60B:
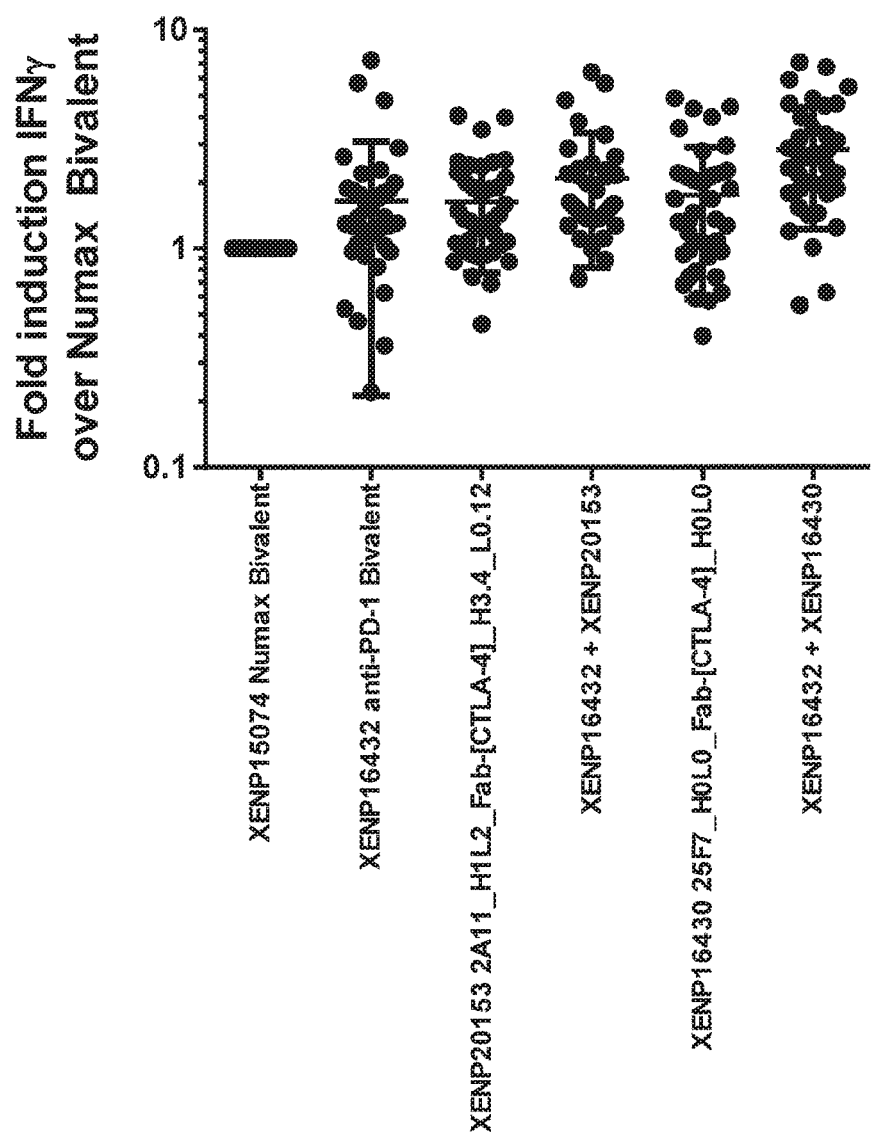

FIG. 60A-60B depicts mixed lymphocyte reactions (MLRs) with anti-LAG-3×anti-CTLA-4 bispecific antibodies. 40 unique MLR reactions were made in the presence of 20 μg/mL of indicated test articles. Cell supernatants were then assayed by MSD 6 days after treatment for A: IL-2 and B: IFNγ.

Figure 61A:
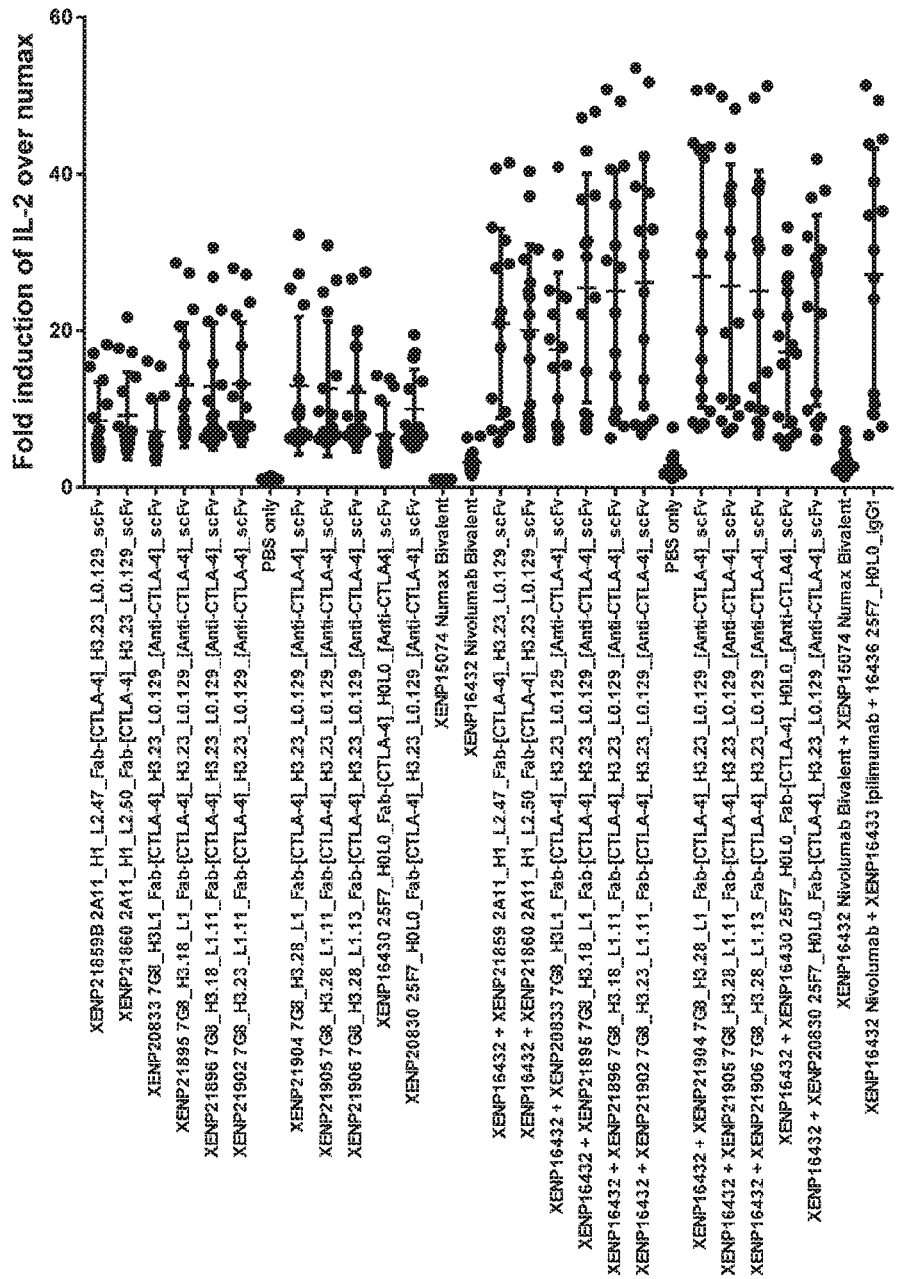
Figure 61B:
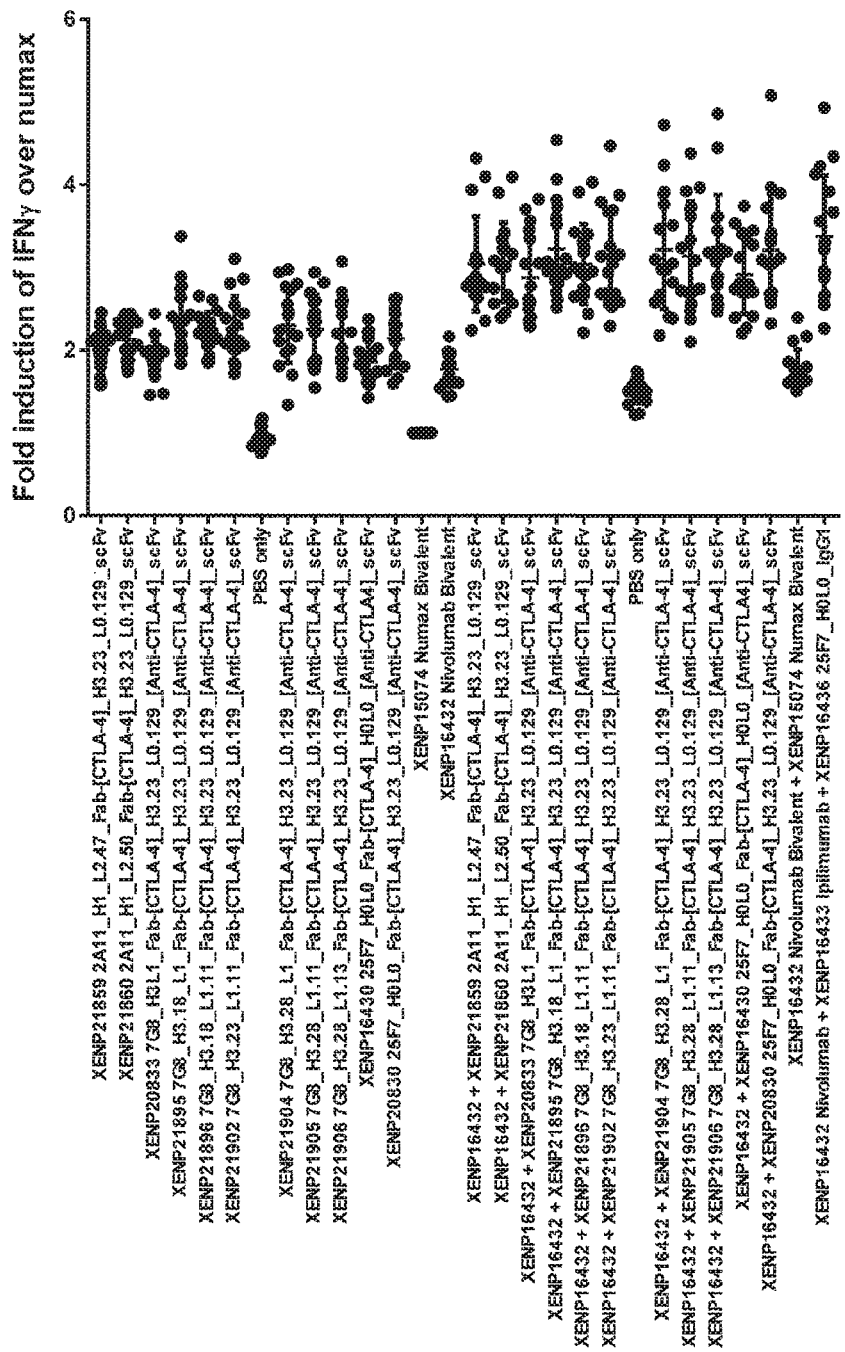

FIG. 61A-61B shows enhancement of IL-2 and IFNγ release by additional anti-LAG-3×anti-CTLA-4 candidates in the SEB assays. PBMCs were stimulated with 500 ng/mL SEB for 2 days. Cells were then washed twice in culture medium and stimulated with 500 ng/mL SEB in combination with indicated amounts of test articles. Cells were assayed for indicated analyte (either IL-2 or IFN-γ) 24 hours after treatment. Each point represents a unique donor tested in technical singlet.

FIG. 62A-62B depicts the Kds for anti-LAG-3×anti-PD-1 bispecific, heterodimeric bottle opener formats based on either optimized 2A11 or 7G8 anti-LAG-3 Fab arms as measured by OCTET®.

Figure 63A:
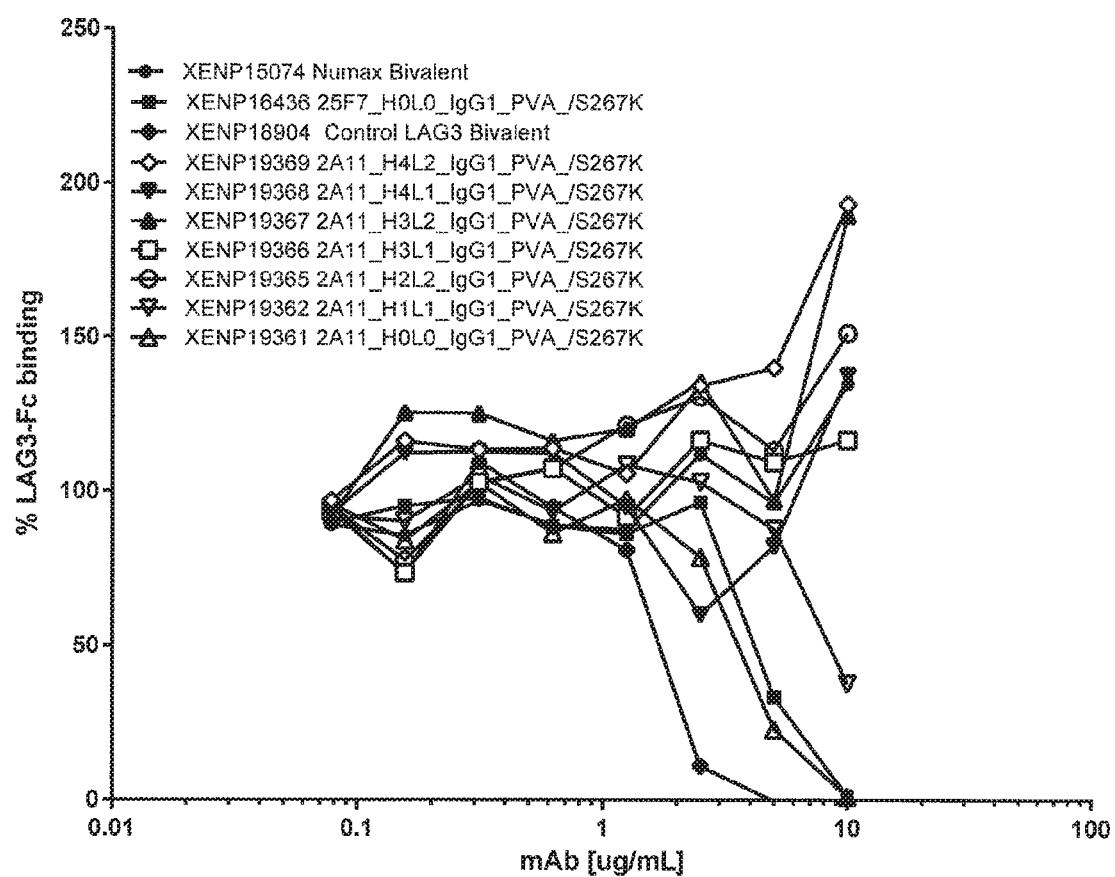
Figure 63B:
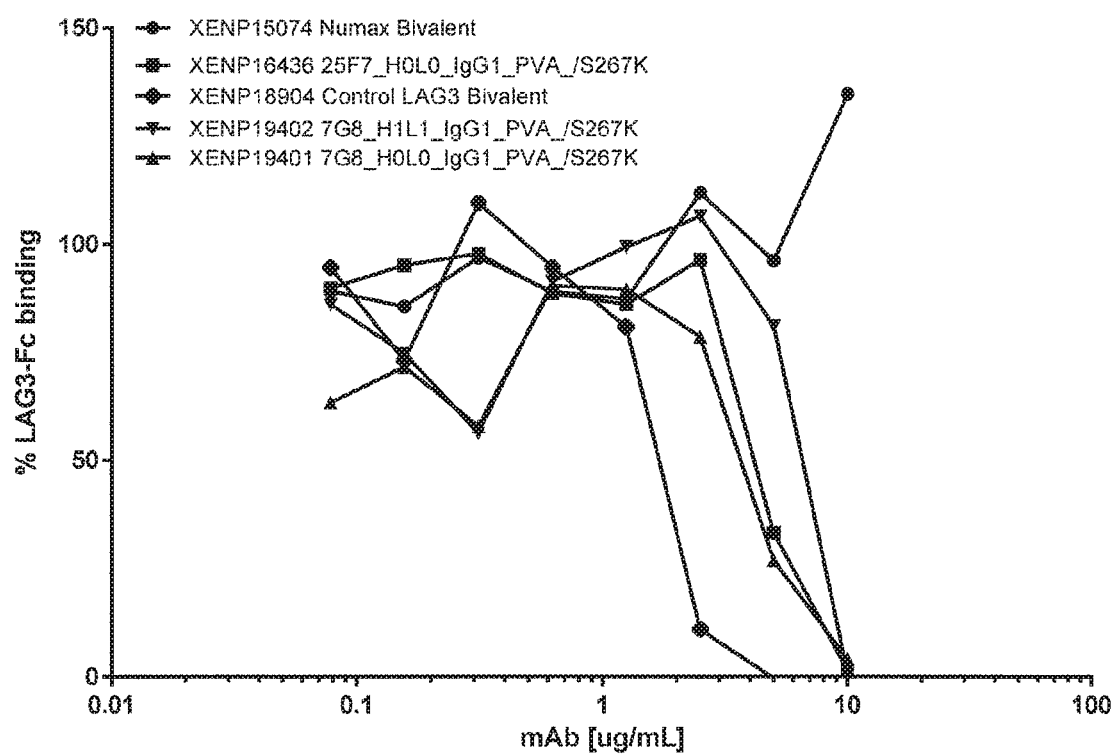

FIG. 63A-63B depicts the ability of humanized/optimized 7G8 and 2A11 anti-LAG-3 clones to block LAG-3 binding to Daudi cells endogenously expressing MHC-II.

Figure 64A:
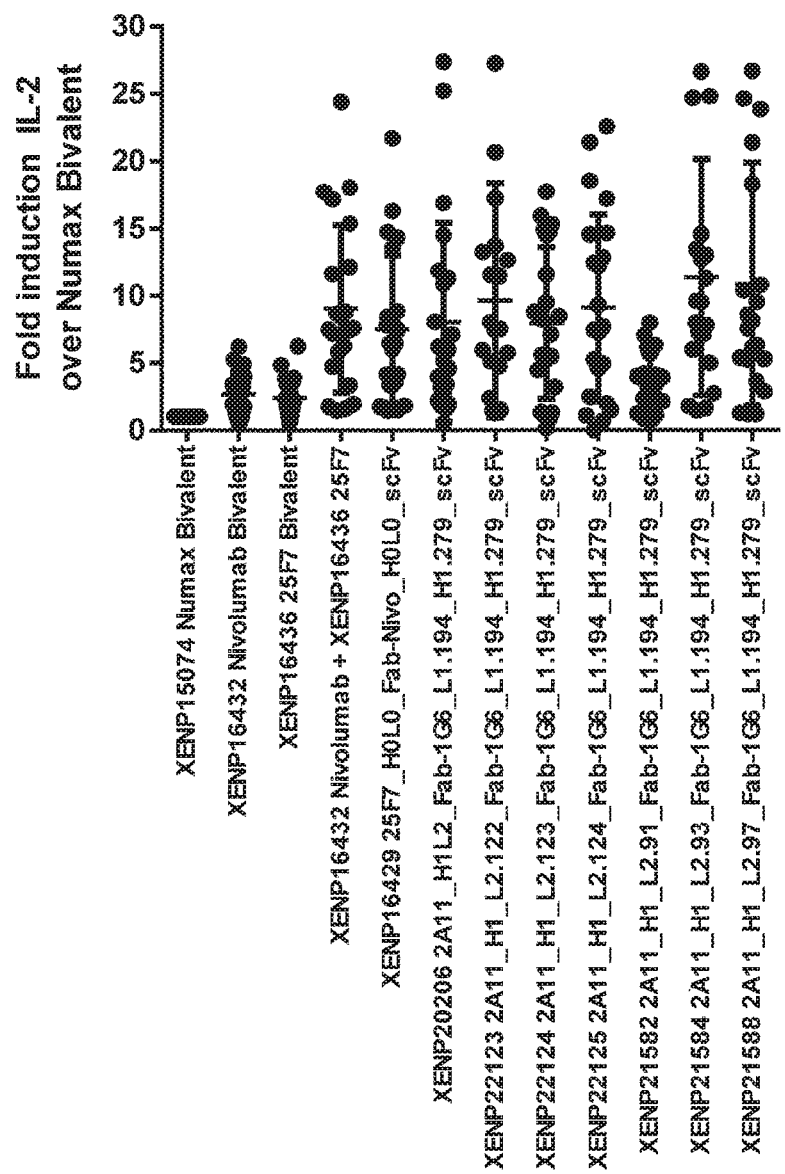
Figure 64B:
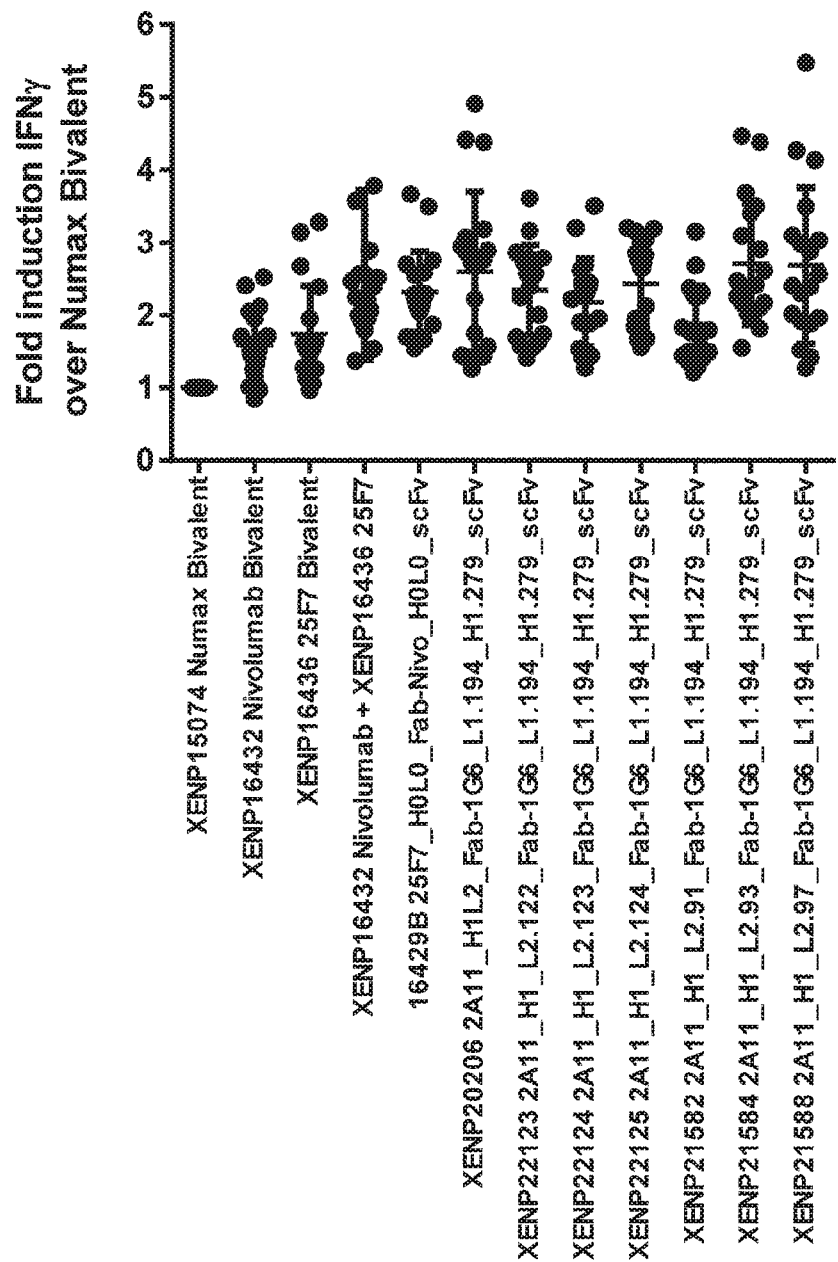

FIG. 64A-64B depicts anti-LAG-3×anti-PD-1 candidate function on SEB stimulated T cells. PBMCs were stimulated with 500 ng/ml SEB for 2 days. Cells were then washed twice in culture medium and stimulated with 500 ng/mL SEB in combination with indicated amounts of test articles. Cells were assayed for indicated analyte 24 h after treatment. Each point represents a unique donor tested in technical singlet.

Figure 65:
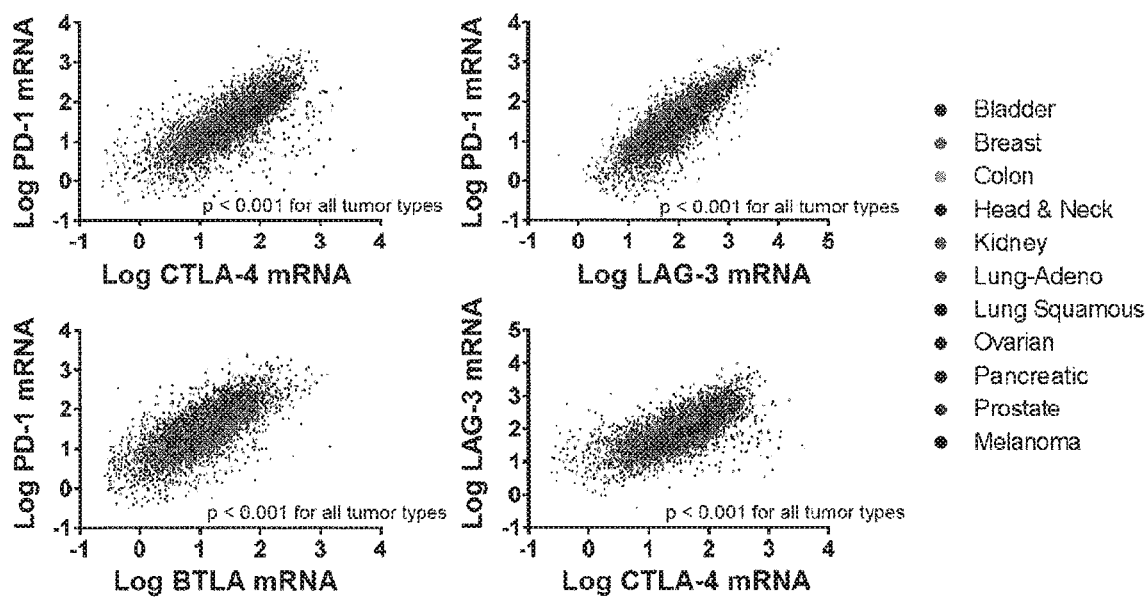

FIG. 65 are graphs, showing that tumor infiltrating lymphocytes (TILs) co-express multiple checkpoint receptors in various tumors. In particular, the graphs show that various tumors coexpress PD-1 and CTLA-4, PD-1 and BTLA, PD-1 and LAG-3; and LAG-3 and CTLA-4. The results shown are based upon data generated by the TCGA Research network: http://cancergenome.nih.gov/

Figure 66:
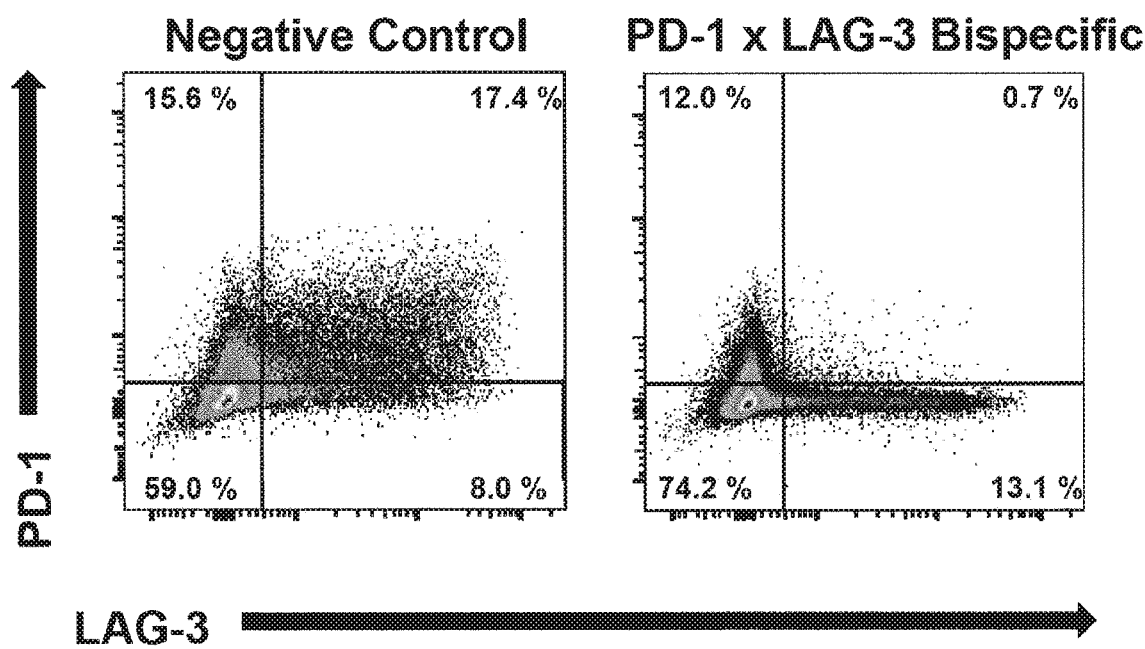
Figure 67A:
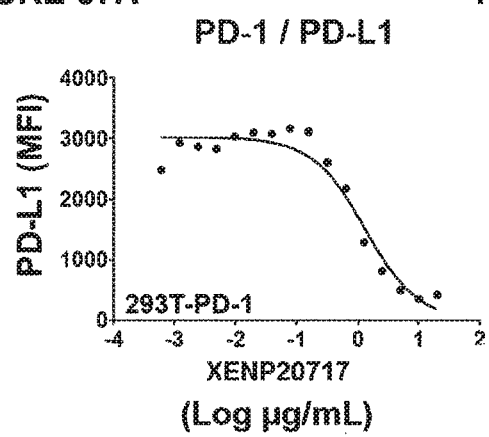
Figure 67B:
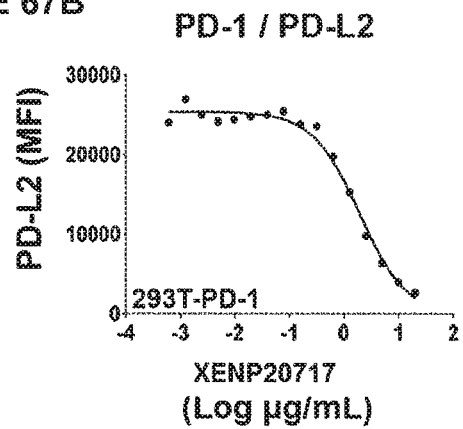
Figure 67C:
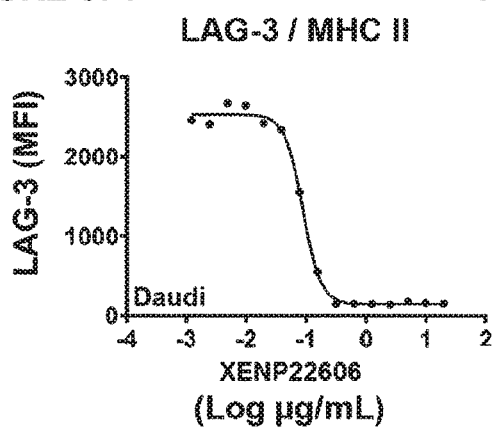
Figure 67D:
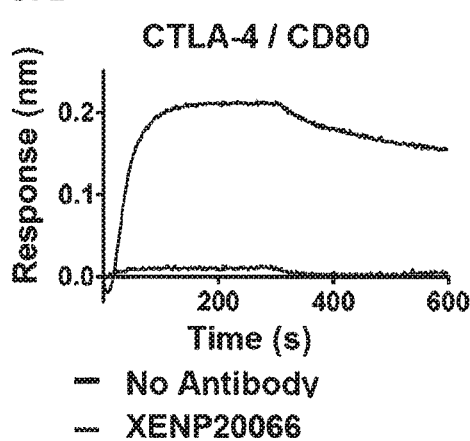
Figure 67E:
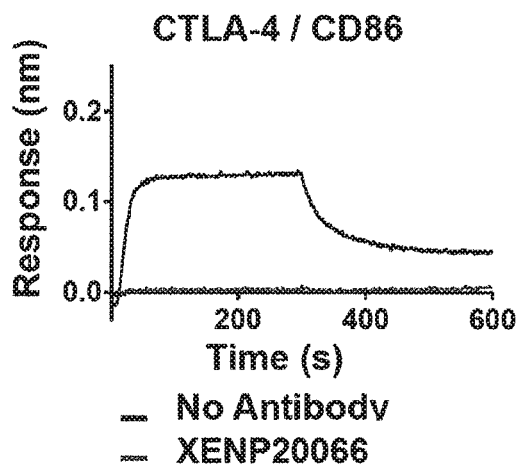
Figure 67F:
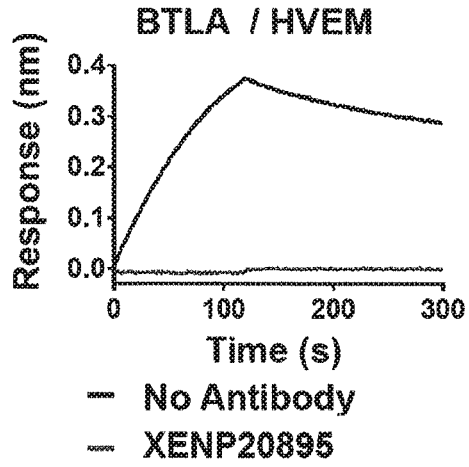

FIG. 66 shows that subject bispecific antibodies provided herein selectively target dual-checkpoint positive T cells. Bispeicifc PD-1×LAG-3 antibodies are used to show PD-1 and LAG-3 receptor occupancy in CD3+ T-cells stimulated with staphylococcal enterotoxin B (SEB) as compared to a negative control.

FIG. 67A-67F are graphs showing that component antibody domains of the subject antibodies provided herein are capable of blocking checkpoint receptor/ligand interactions. In particular, a bispecific antibody comprising a 1G6 anti-PD-1 scFv arm is capable of blocking PD-1/PD-L1 and PD-1/PD-L2 interactions; 7G8 anti-LAG-3 one arm is capable of blocking LAG-3/MHC II interaction; a bispecific antibody comprising an exemplary anti-PD-1 Fab arm is capable of blocking CTLA-4/CD80 and CTLA-4/CD86 interactions; and a bispecific antibody comprising a 9C6 anti-BTLA Fab arm is capable of blocking BTLA/HVEM interaction.

Figure 68:
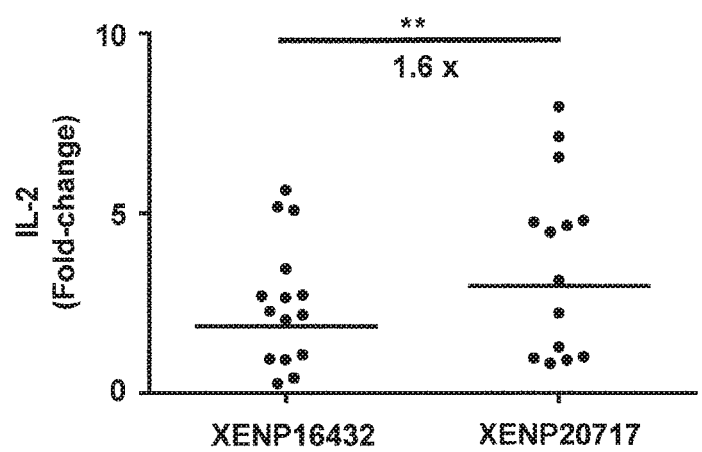

FIG. 68 compares the enhancement of IL-2 release by an exemplary anti-CTLA-4×anti-PD-1 bispecific antibody and nivolumab.

Figure 69:
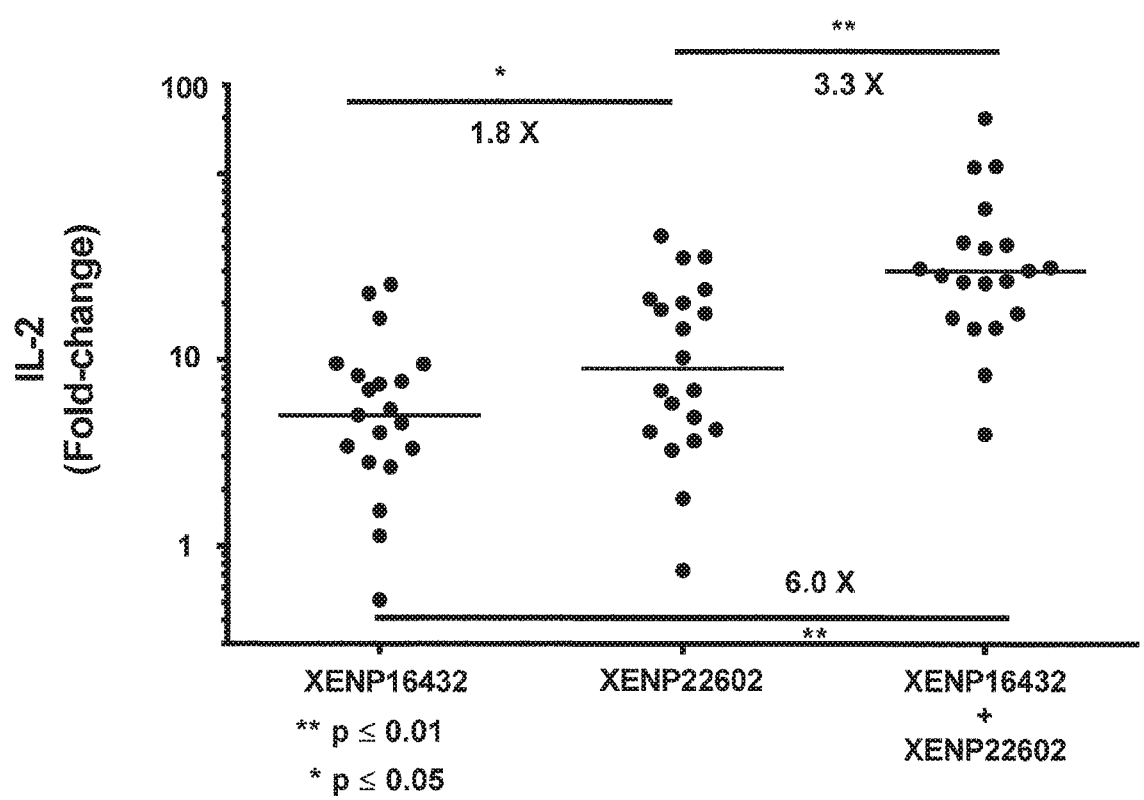

FIG. 69 compares the enhancement of IL-2 release by an exemplary anti-LAG-3×anti-CTLA-4 bispecific antibody, the same bispecific antibody in combination with nivolumab, and nivolumab alone.

Figure 70:
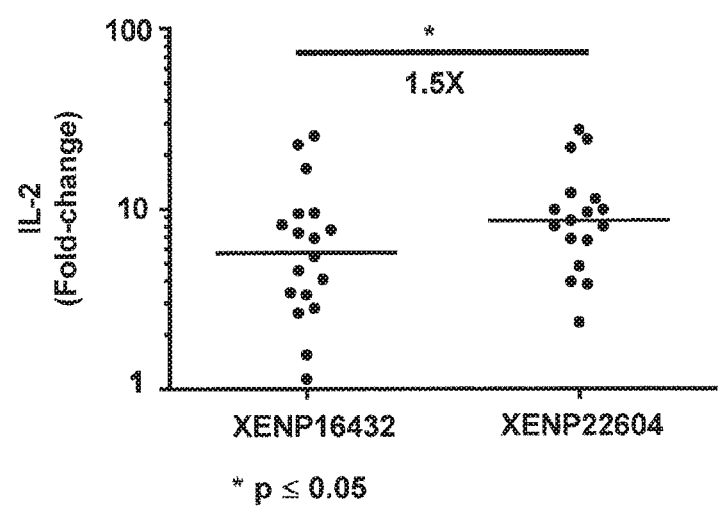

FIG. 70 compares the enhancement of IL-2 release by an exemplary anti-LAG-3×anti-PD-1 bispecific antibody and nivolumab.

Figure 71:
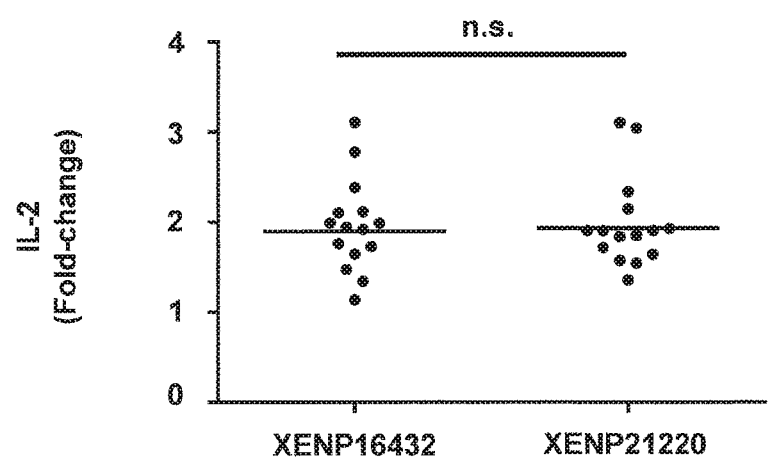

FIG. 71 compares the enhancement of IL-2 release by an exemplary anti-BTLA×anti-PD-1 bispecific antibody and nivolumab.

Figure 72:
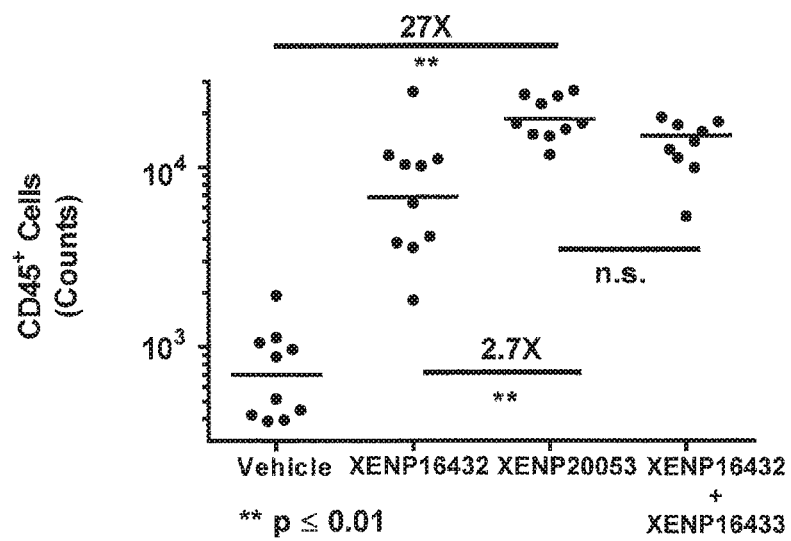

FIG. 72 compares the enhancement of GVHD (as indicated by CD45 cell count) by an exemplary anti-PD-1×anti-CTLA-4 bispecific antibody, nivolumab alone, and nivolumab in combination with ipilimumab.

Figure 73:
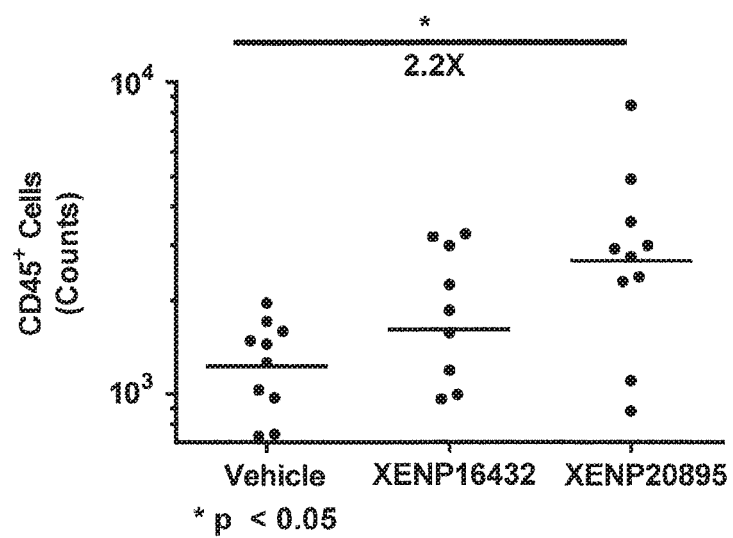

FIG. 73 compares the enhancement of GVHD (as indicated by CD45 cell count) by an exemplary anti-BTLA×anti-PD-1 bispecific antibody and nivolumab.

Figure 74:
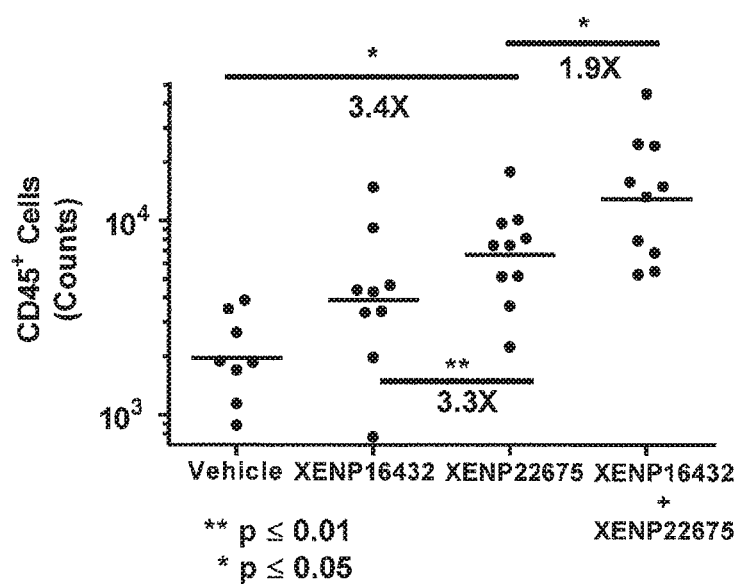

FIG. 74 compares the enhancement of GVHD (as indicated by CD45 cell count) by an exemplary anti-LAG-3×anti-CTLA-4 bispecific antibody, the same bispecific antibody in combination with nivolumab, and nivolumab alone.

Figure 75:
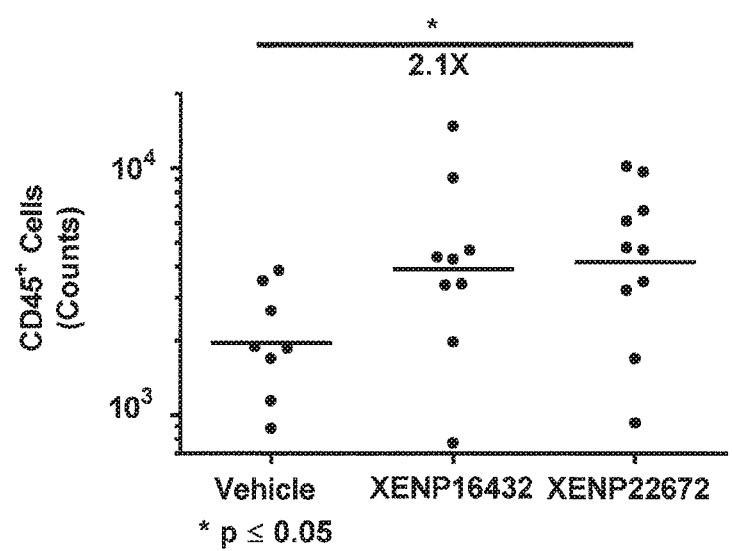
Figure 76A:
Figure 76B:
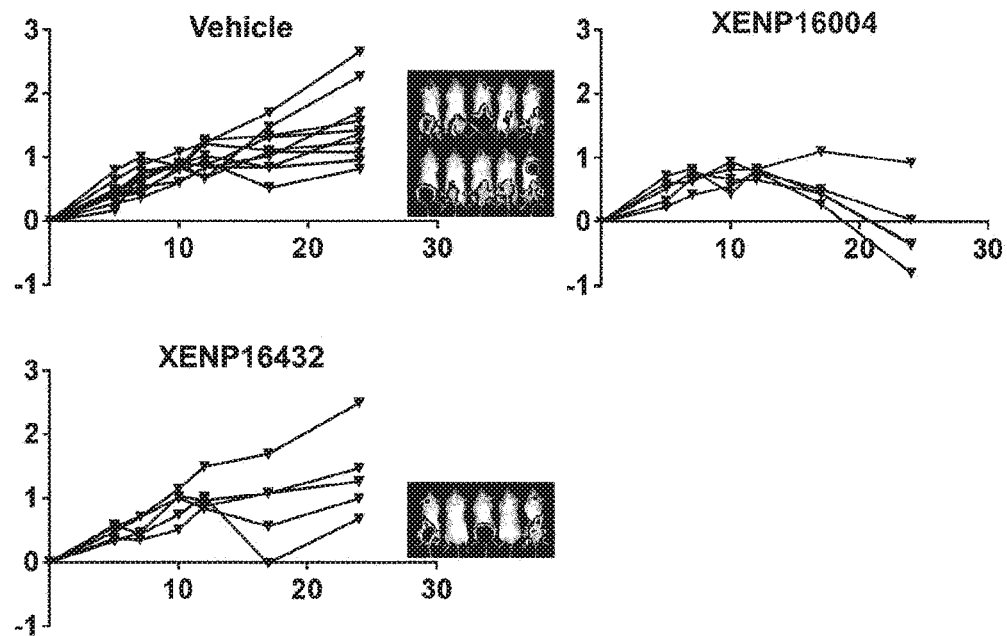

FIG. 75 compares the enhancement of GVHD (as indicated by CD45 cell count) by an exemplary anti-LAG-3×anti-PD-1 bispecific antibody and nivolumab.

FIGS. 76A-76D depicts two studies, showing that anti-CTLA-4×anti-PD-1 bispecific antibodies can promote in vivo T cell mediated anti-tumor efficacy. KG1a-luc cancer cells were engrafted into mice. Twenty-one days later, huPMCs were engrafted into the same mice and weekly antibody treatments (anti-CTLA-4×anti-PD-1 bispecific antibodies; anti-PD-1 bivalent antibodies; or anti-PD-1 bivalent antibody+anti-CTLA-4 bivalent antibody) were administered. IVIS cancer cell imaging was conducted on the mice to assess tumor size, as determined by change in tumor flux.

III. DETAILED DESCRIPTION OF THE INVENTION

A. Incorporation of Materials

1. Figures and Legends

All the figures and accompanying legends of U.S. Ser. Nos. 62/350,145, 62/353,511 and 62/420,500 are expressly and independently incorporated by reference herein in their entirety, particularly for the amino acid sequences depicted therein.

2. Sequences

Reference is made to the accompanying sequence listing as following: anti-PD-1 sequences suitable for use as ABDs include SEQ ID NOs: 6209-11464 (PD-1 scFv sequences, although the Fv sequences therein can be formatted as Fabs), SEQ ID NOs: 11465-17134 (PD-1 Fab sequences, although the Fv sequences therein can be formatted as scFvs), SEQ ID NOs: 33003-33072 (additional PD-1 Fab sequences, although the Fv sequences therein can be formatted as scFvs), SEQ ID NOs: 33073-35394 (additional PD-1 scFv sequences, although the Fv sequences therein can be formatted as Fabs) and SEQ ID NOs: 36127-36146 (PD-1 bivalent constructs, which can be formatted as either scFvs or Fabs). Anti-CTLA-4 sequences suitable for use as ABDs include SEQ ID NOs: 21-2918 (CTLA-4 scFv sequences, although the Fv sequences therein can be formatted as Fabs), SEQ ID NOs: 2919-6208 (CTLA-4 Fab sequences, although the Fv sequences therein can be formatted as scFvs), SEQ ID NOs: 36739-36818 (additional CTLA-4 Fab sequences, although the Fv sequences therein can be formatted as scFvs) and SEQ ID NOs: 35395-35416 (CTLA-4 one armed constructs, which can be formatted as either Fabs or scFvs). Anti-LAG-3 sequences suitable for use as ABDs include SEQ ID NOs: 17135-20764 (LAG-3 Fabs, although the Fv sequences therein can be formatted as scFvs), SEQ ID NOs: 36819-36962 (additional LAG-3 Fabs although the Fv sequences therein can be formatted as scFvs), SEQ ID NOs: 35417-35606 (additional LAG-3 Fabs although the Fv sequences therein can be formatted as scFvs), SEQ ID NOs: 25194-32793 (additional LAG-3 Fabs although the Fv sequences therein can be formatted as scFvs) and SEQ ID NOs: 32794-33002 (one armed LAG-3 constructs which can be formatted as either Fabs or scFvs). Anti-TIM-3 sequences suitable for use as ABDs include SEQ ID NOs: 20765-20884 (TIM-3 Fabs, although the Fv sequences therein can be formatted as scFvs), SEQ ID NOs: 37587-37698 (additional TIM-3 Fabs, the Fv sequences therein can be formatted as scFvs) and SEQ ID NOs: 36347-36706 (bivalent TIM-3 constructs which can be formatted as either Fabs or scFvs). Anti-BTLA sequences suitable for use as ABDs include SEQ ID NOs: 20885-21503 (BTLA Fabs although the Fv sequences therein can be formatted as scFvs) and SEQ ID NOs: 36707-36738 (additional BTLA Fabs although the Fv sequences therein can be formatted as scFvs). Anti-TIGIT sequences suitable for use as ABDs include SEQ ID NOs: 21504-21523 (TIGIT Fab although the Fv sequences therein can be formatted as scFvs) and SEQ ID NOs: 37435-37586 (additional TIGIT Fabs although the Fv sequences therein can be formatted as scFvs).

Bispecific antibodies of the invention include LAG3× CTLA4 constructs of SEQ ID NOs: 35607-35866 and SEQ ID NOs: 21524-22620. PD-1×CTLA4 constructs include those listed as SEQ ID NOs: 36167-36346 and SEQ ID NOs: 23316-23735. PD-1×TIM3 constructs include those listed as SEQ ID NOs: 25174-25193. PD-1×LAG3 constructs include those listed as SEQ ID NOs: 35867-36126 and SEQ ID NOs: 23736-25133. PD-1×TIGIT constructs include those listed as SEQ ID NOs: 25134-25173. PD-1×BTLA constructs include those listed as SEQ ID NOs: 22724-23315 and SEQ ID NOs: 36147-36166. CTLA4×BTLA constructs include those listed as SEQ ID NOs: 22624-22723. Finally, the names for XENP23552, XENP22841, XENP22842, XENP22843, XENP22844, XENP22845, XENP22846, XENP22847, XENP22848, XENP22849, XENP22850, XENP22851, XENP22852, XENP22858, XENP22854, XENP22855 all should have included the "M428L/N434S" notation in the title, which were inadvertently left off.

B. Overview

Therapeutic antibodies directed against immune checkpoint inhibitors such as PD-1 are showing great promise in limited circumstances in the clinic for the treatment of cancer. Cancer can be considered as an inability of the patient to recognize and eliminate cancerous cells. In many instances, these transformed (e.g. cancerous) cells counteract immunosurveillance. There are natural control mechanisms that limit T-cell activation in the body to prevent unrestrained T-cell activity, which can be exploited by cancerous cells to evade or suppress the immune response. Restoring the capacity of immune effector cells-especially T cells—to recognize and eliminate cancer is the goal of immunotherapy. The field of immuno-oncology, sometimes referred to as "immunotherapy" is rapidly evolving, with several recent approvals of T cell checkpoint inhibitory antibodies such as Yervoy, Keytruda and Opdivo. These antibodies are generally referred to as "checkpoint inhibitors" because they block normally negative regulators of T cell immunity. It is generally understood that a variety of immunomodulatory signals, both costimulatory and coinhibitory, can be used to orchestrate an optimal antigen-specific immune response.

Generally, these monoclonal antibodies bind to checkpoint inhibitor proteins such as CTLA-4 and PD-1, which under normal circumstances prevent or suppress activation of cytotoxic T cells (CTLs). By inhibiting the checkpoint protein, for example through the use of antibodies that bind these proteins, an increased T cell response against tumors can be achieved. That is, these cancer checkpoint proteins suppress the immune response; when the proteins are blocked, for example using antibodies to the checkpoint protein, the immune system is activated, leading to immune stimulation, resulting in treatment of conditions such as cancer and infectious disease.

However, as discussed above, studies have shown that TILs commonly express multiple checkpoint receptors; this may suggest that single checkpoint blockade could be insufficient to promote a complete T cell response. Moreover, it is likely that TILs that express multiple checkpoints are in fact the most tumor-reactive, thus suggesting that therapies that engage more than one checkpoint antigen could be very useful.

Accordingly, the present invention provides bispecific checkpoint antibodies, that bind to cells expressing the two antigens and methods of activating T cells and/or NK cells to treat diseases such as cancer and infectious diseases, and other conditions where increased immune activity results in treatment.

Thus, the invention is directed, in some instances, to solving the issue of toxicity and expense of administering multiple antibodies by providing bispecific antibodies that bind to two different checkpoint inhibitor molecules on a single cell and advantageously requiring administration of only one therapeutic substance.

Bispecific antibodies, which can bind two different targets simultaneously, offer the potential to improve the selectivity of targeting TILs vs peripheral T cells, while also reducing cost of therapy. The bivalent interaction of an antibody with two targets on a cell surface should—in some cases—lead to a higher binding avidity relative to a monovalent interaction with one target at a time. Because of this, normal bivalent antibodies tend to have high avidity for their target on a cell surface. With bispecific antibodies, the potential exists to create higher selectivity for cells that simultaneously express two different targets, utilizing the higher avidity afforded by simultaneous binding to both targets.

Accordingly, the present invention is directed to novel constructs to provide heterodimeric antibodies that allow binding to more than one checkpoint antigen or ligand, e.g. to allow for bispecific binding. Hence, for example, an anti-PD1×anti-CTLA4 (PD1×CTLA4) bispecific antibody is expected to be more selective for PD1+CTLA4+ double positive TILs versus single positive PD1-only or CTLA4-only T cells. Selective blockade of double-positive TILs versus single positive T cells is therefore expected to improve the therapeutic index of combined checkpoint blockade. This is similarly true for the other possible combinations as outlined herein. Accordingly, suitable bispecific antibodies of the invention bind PD-1 and CTLA-4, PD-1 and TIM-3, PD-1 and LAG-3, PD-1 and TIGIT, PD-1 and BTLA, CTLA-4 and TIM-3, CTLA-4 and LAG-3, CTLA-4 and TIGIT, CTLA-4 and BTLA, TIM-3 and LAG-3, TIM-3 and TIGIT, TIM-3 and BTLA, LAG-3 and TIGIT, LAG-3 and BTLA and TIGIT and BTLA. Note that generally these bispecific antibodies are named "anti-PD-1×anti-CTLA-4", or generally simplistically or for ease (and thus interchangeably) as "PD-1×CTLA-4", etc. for each pair.

The heterodimeric bispecific checkpoint antibodies of the invention are useful to treat a variety of types of cancers. As will be appreciated by those in the art, in contrast to traditional monoclonal antibodies that bind to tumor antigens, or to the newer classes of bispecific antibodies that bind, for example, CD3 and tumor antigens (such as described in U.S. Ser. No. 15/141,350, for example), checkpoint antibodies are used to increase the immune response but are not generally tumor specific in their action. That is, the bispecific checkpoint antibodies of the invention inhibit the suppression of the immune system, generally leading to T cell activation, which in turn leads to greater immune response to cancerous cells and thus treatment. Such antibodies can therefore be expected to find utility for treatment of a wide variety of tumor types. For example, the FDA recently approved Keytruda®, an anti-PD-1 monospecific antibody on the basis of a genetic feature, rather than a tumor type.

As discussed below, there are a variety of ways that T cell activation can be measured. Functional effects of the bispecific checkpoint antibodies on NK and T-cells can be assessed in vitro (and in some cases in vivo, as described more fully below) by measuring changes in the following parameters: proliferation, cytokine release and cell-surface makers. For NK cells, increases in cell proliferation, cytotoxicity (ability to kill target cells as measured by increases in CD107a, granzyme, and perforin expression, or by directly measuring target cells killing), cytokine production (e.g. IFN-γ and TNF), and cell surface receptor expression (e.g. CD25) is indicative of immune modulation, e.g. enhanced killing of cancer cells. For T-cells, increases in proliferation, increases in expression of cell surface markers of activation (e.g. CD25, CD69, CD137, and PD1), cytotoxicity (ability to kill target cells), and cytokine production (e.g. IL-2, IL-4, IL-6, IFN-γ, TNF-α, IL-10, IL-17A) are indicative of immune modulation, e.g. enhanced killing of cancer cells. Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases in cell number and/or activity of at least one of regulatory T cells and cells (xii) increases of tumor immune infiltrates.

Thus, in some embodiments the invention provides the use of bispecific checkpoint antibodies to perform one or more of the following in a subject in need thereof: (a) upregulating pro-inflammatory cytokines; (b) increasing T-cell proliferation, expansion or tumor infiltration; (c) increasing interferon-γ, TNF-α and other cytokine production by T-cells; (d) increasing IL-2 secretion; (e) stimulating antibody responses; (0 inhibiting cancer cell growth; (g) promoting antigenic specific T cell immunity; (h) promoting CD4+ and/or CD8+ T cell activation; (i) alleviating T-cell suppression; (j) promoting NK cell activity; (k) promoting apoptosis or lysis of cancer cells; and/or (l) cytotoxic or cytostatic effect on cancer cells.

Accordingly, the present invention provides bispecific, heterodimeric checkpoint antibodies. The heterodimeric antibody constructs are based on the self-assembling nature of the two Fc domains of the heavy chains of antibodies, e.g. two "monomers" that assemble into a "dimer". Heterodimeric antibodies are made by altering the amino acid sequence of each monomer as more fully discussed below. Thus, the present invention is generally directed to the creation of heterodimeric antibodies, which can co-engage checkpoint antigens in several ways, relying on amino acid variants in the constant regions that are different on each chain to promote heterodimeric formation and/or allow for ease of purification of heterodimers over the homodimers.

Thus, the present invention provides bispecific checkpoint antibodies. An ongoing problem in antibody technologies is the desire for "bispecific" antibodies that bind to two (or more) different antigens simultaneously, in general thus allowing the different antigens to be brought into proximity and resulting in new functionalities and new therapies. In general, these antibodies are made by including genes for each heavy and light chain into the host cells (generally, in the present invention, genes for two heavy chain monomers and a light chain as outlined herein). This generally results in the formation of the desired heterodimer (A-B), as well as the two homodimers (A-A and B-B). However, a major obstacle in the formation of bispecific antibodies is the difficulty in purifying the heterodimeric antibodies away from the homodimeric antibodies and/or biasing the formation of the heterodimer over the formation of the homodimers.

To solve this issue, there are a number of mechanisms that can be used to generate the heterodimers of the present invention. In addition, as will be appreciated by those in the art, these mechanisms can be combined to ensure high heterodimerization. Thus, amino acid variants that lead to the production of heterodimeric antibodies are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers.

One mechanism, generally referred to in the art as "knobs and holes" ("KIH") or sometimes herein as "skew" variants, referring to amino acid engineering that creates steric and/or electrostatic influences to favor heterodimeric formation and disfavor homodimeric formation can also optionally be used, as described in Ridgway et al., Protein Engineering 9(7):617 (1996); Atwell et al., J. Mol. Biol. 1997 270:26; U.S. Pat. No. 8,216,805, US 2012/0149876, all of which are hereby incorporated by reference in their entirety. The Figures identify a number of "monomer A-monomer B" pairs that include "knobs and holes" amino acid substitutions. In addition, as described in Merchant et al., Nature Biotech. 16:677 (1998), these "knobs and hole" mutations can be combined with disulfide bonds to skew formation to heterodimerization. Of use in the present invention are T366S/L368A/Y407V paired with T366W, as well as this variant with a bridging disulfide, T366S/L368A/Y407V/Y349C paired with T366W/S354C, particularly in combination with other heterodimerization variants including pI variants as outlined below.

An additional mechanism that finds use in the generation of heterodimeric antibodies is sometimes referred to as "electrostatic steering" or "charge pairs" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R and others shown in the Figures.

In the present invention, in some embodiments, pI variants are used to alter the pI of one or both of the monomers and thus allowing the isoelectric separation of A-A, A-B and B-B dimeric proteins.

In the present invention, there are several basic mechanisms that can lead to ease of purifying heterodimeric proteins; one relies on the use of pI variants, such that each monomer has a different pI, thus allowing the isoelectric purification of A-A, A-B and B-B dimeric proteins. Alternatively, some scaffold formats, such as the "triple F" format, also allows separation on the basis of size. As is further outlined below, it is also possible to "skew" the formation of heterodimers over homodimers. Thus, a combination of steric heterodimerization variants and pI or charge pair variants find particular use in the invention. Additionally, as more fully outlined below, scaffolds that utilize scFv(s) such as the Triple F format can include charged scFv linkers (either positive or negative), that give a further pI boost for purification purposes. As will be appreciated by those in the art, some Triple F formats are useful with just charged scFv linkers and no additional pI adjustments, although the invention does provide the use of skew variants with charged scFv linkers as well (and combinations of Fc, FcRn and KO variants discussed herein).

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B can be changed, with the pI of monomer A increasing and the pI of monomer B decreasing. As is outlined more fully below, the pI changes of either or both monomers can be done by removing or adding a charged residue (e.g. a neutral amino acid is replaced by a positively or negatively charged amino acid residue, e.g. glycine to glutamic acid), changing a charged residue from positive or negative to the opposite charge (e.g. aspartic acid to lysine) or changing a charged residue to a neutral residue (e.g. loss of a charge; lysine to serine). A number of these variants are shown in the Figures. In addition, suitable pI variants for use in the creation of heterodimeric antibodies herein are those that are isotypic, e.g. importing pI variants from different IgG isotypes such that pI is changed without introducing significant immunogenicity; see FIG. 29 from US Publication No. 20140288275, hereby incorporated by reference in its entirety.

Accordingly, in this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease it's pI_(wt A-+B or wt A--B), or by increasing one region and decreasing the other region (A+-B- or A-B+).

Thus, in general, a component of some embodiments of the present invention are amino acid variants in the constant regions of antibodies that are directed to altering the isoelectric point (pI) of at least one, if not both, of the monomers of a dimeric protein to form "pI heterodimers" (when the protein is an antibody, these are referred to as "pI antibodies") by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the scFv and Fab of interest. That is, to determine which monomer to engineer or in which "direction" (e.g. more positive or more negative), the Fv sequences of the two target antigens are calculated and a decision is made from there. As is known in the art, different Fvs will have different starting pIs which are exploited in the present invention. In general, as outlined herein, the pIs are engineered to result in a total pI difference of each monomer of at least about 0.1 logs, with 0.2 to 0.5 being preferred as outlined herein.

Furthermore, as will be appreciated by those in the art and outlined herein, in some cases (depending on the format) heterodimers can be separated from homodimers on the basis of size (e.g. molecular weight). For example, as shown in some embodiments of FIG. 1, some formats result in homodimers and heterodimers with different sizes (e.g. for bottle openers, one homodimer is a "dual scFv" format, one homodimer is a standard antibody, and the heterodimer has one Fab and one scFv.

In addition, as depicted in FIG. 1, it will be recognized that it is possible that some antigens are bound bivalently (e.g. two antigen binding sites to a single antigen). As will be appreciated, any combination of Fab and scFvs can be utilized to achieve the desired result and combinations.

In the case where pI variants are used to achieve purified heterodimers over homodimers, by using the constant region(s) of the heavy chain(s), a more modular approach to designing and purifying multispecific proteins, including antibodies, is provided. Thus, in some embodiments, heterodimerization variants (including skew and purification heterodimerization variants) are not included in the variable regions, such that each individual antibody must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification.

In addition, it should be noted that the pI variants of the heterodimerization variants give an additional benefit for the analytics and quality control process of bispecific antibodies, as the ability to either eliminate, minimize and distinguish when homodimers are present is significant. Similarly, the ability to reliably test the reproducibility of the heterodimeric protein production is important.

As will be appreciated by those in the art and discussed more fully below, the heterodimeric fusion proteins of the present invention can take on a wide variety of configurations, as are generally depicted in FIG. 1. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. Thus, the present invention is directed to novel immunoglobulin compositions that co-engage a first and a second antigen. First and second antigens of the invention are herein referred to as antigen-1 and antigen-2 respectively (or "checkpoint-1" and "checkpoint-2").

One heterodimeric scaffold that finds particular use in the present invention is the "triple F" or "bottle opener" scaffold format as depicted in FIG. 1A. In this embodiment, one heavy chain of the antibody contains an single chain Fv ("scFv", as defined below) and the other heavy chain is a "regular" FAb format, comprising a variable heavy chain and a light chain. This structure is sometimes referred to herein as "triple F" format (scFv-FAb-Fc) or the "bottle-opener" format, due to a rough visual similarity to a bottle-opener (see FIG. 1A). The two chains are brought together by the use of amino acid variants in the constant regions (e.g. the Fc domain and/or the hinge region) that promote the formation of heterodimeric antibodies as is described more fully below.

There are several distinct advantages to the present "triple F" format. As is known in the art, antibody analogs relying on two scFv constructs often have stability and aggregation problems, which can be alleviated in the present invention by the addition of a "regular" heavy and light chain pairing. In addition, as opposed to formats that rely on two heavy chains and two light chains, there is no issue with the incorrect pairing of heavy and light chains (e.g. heavy 1 pairing with light 2, etc.)

Furthermore, as outlined herein, additional amino acid variants may be introduced into the bispecific antibodies of the invention, to add additional functionalities. For example, amino acid changes within the Fc region can be added (either to one monomer or both) to facilitate increased ADCC or CDC (e.g. altered binding to Fcγ receptors) as well as to increase binding to FcRn and/or increase serum half-life of the resulting molecules. As is further described herein and as will be appreciated by those in the art, any and all of the variants outlined herein can be optionally and independently combined with other variants.

Similarly, another category of functional variants are "Fcγ ablation variants" or "Fc knock out (FcKO or KO) variants. In these embodiments, for some therapeutic applications, it is desirable to reduce or remove the normal binding of the Fc domain to one or more or all of the Fcγ receptors (e.g. FcγR1, FcγRIIa, FcγRIIb, FcγRIIIa, etc.) to avoid additional mechanisms of action. That is, for example, it is generally desirable to ablate FcγRIIIa binding to eliminate or significantly reduce ADCC activity. Suitable ablation variants are shown in FIG. 5.

C. Nomenclature

The bispecific antibodies of the invention are listed in several different formats. Each polypeptide is given a unique "XENP" number, although as will be appreciated in the art, a longer sequence might contain a shorter one. For example, the heavy chain of the scFv side monomer of a bottle opener format for a given sequence will have a first XENP number, while the scFv domain will have a different XENP number. Some molecules have three polypeptides, so the XENP number, with the components, is used as a name. Thus, the molecule XENP20717, which is in bottle opener format, comprises three sequences, generally referred to as "XENP20717 HC-Fab", XENP20717 HC-scFv" and "XENP20717 LC" or equivalents, although one of skill in the art would be able to identify these easily through sequence alignment. These XENP numbers are in the sequence listing as well as identifiers, and used in the Figures. In addition, one molecule, comprising the three components, gives rise to multiple sequence identifiers. For example, the listing of the Fab monomer has the full length sequence, the variable heavy sequence and the three CDRs of the variable heavy sequence; the light chain has a full length sequence, a variable light sequence and the three CDRs of the variable light sequence; and the scFv-Fc domain has a full length sequence, an scFv sequence, a variable light sequence, 3 light CDRs, a scFv linker, a variable heavy sequence and 3 heavy CDRs; note that all molecules herein with a scFv domain use a single charged scFv linker (+H), although others can be used. In addition, the naming nomenclature of particular variable domains uses a "Hx.xx_Ly.yy" type of format, with the numbers being unique identifiers to particular variable chain sequences. Thus, the variable domain of the Fab side of XENP22841 is "7G8_H3.30_L1.34", which indicates that the variable heavy domain H3.30 was combined with the light domain L1.34. In the case that these sequences are used as scFvs, the designation "7G8_H3.30_L1.34", indicates that the variable heavy domain H3.30 was combined with the light domain L1.34 and is in vh-linker-vl orientation, from N- to C-terminus. This molecule with the identical sequences of the heavy and light variable domains but in the reverse order would be named "7G8_L1.34_H3.30". Similarly, different constructs may "mix and match" the heavy and light chains as will be evident from the sequence listing and the Figures.

D. Definitions

In order that the application may be more completely understood, several definitions are set forth below. Such definitions are meant to encompass grammatical equivalents.

By "ablation" herein is meant a decrease or removal of activity. Thus for example, "ablating FcγR binding" means the Fc region amino acid variant has less than 50% starting binding as compared to an Fc region not containing the specific variant, with more than 70-80-90-95-98% loss of activity being preferred, and in general, with the activity being below the level of detectable binding in a BIA-CORE®, SPR or BLI assay. Of particular use in the ablation of FcγR binding are those shown in FIG. 5, which generally are added to both monomers.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

By "ADCP" or antibody dependent cell-mediated phagocytosis as used herein is meant the cell-mediated reaction wherein nonspecific phagocytic cells that express FcγRs recognize bound antibody on a target cell and subsequently cause phagocytosis of the target cell.

By "antigen binding domain" or "ABD" herein is meant a set of six Complementary Determining Regions (CDRs) that, when present as part of a polypeptide sequence, specifically binds a target antigen as discussed herein. Thus, a "checkpoint antigen binding domain" binds a target checkpoint antigen as outlined herein. As is known in the art, these CDRs are generally present as a first set of variable heavy CDRs (vhCDRs or VHCDRs) and a second set of variable light CDRs (vhCDRs or VLCDRs), each comprising three CDRs: vhCDR1, vhCDR2, vhCDR3 for the heavy chain and vlCDR1, vlCDR2 and vlCDR3 for the light. The CDRs are present in the variable heavy and variable light domains, respectively, and together form an Fv region. (See Table 1 and related discussion above for CDR numbering schemes). Thus, in some cases, the six CDRs of the antigen binding domain are contributed by a variable heavy and a variable light domain. In a "Fab" format, the set of 6 CDRs are contributed by two different polypeptide sequences, the variable heavy domain (vh or VH; containing the vhCDR1, vhCDR2 and vhCDR3) and the variable light domain (vl or VL; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain). In a scFv format, the vh and vl domains are covalently attached, generally through the use of a linker (a "scFv linker") as outlined herein, into a single polypeptide sequence, which can be either (starting from the N-terminus) vh-linker-vl or vl-linker-vh, with the former being generally preferred (including optional domain linkers on each side, depending on the format used (e.g. from FIG. 1). In general, the C-terminus of the scFv domain is attached to the N-terminus of the hinge in the second monomer.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233– or E233#, E233( ) or E233del designates a deletion of glutamic acid at position 233. Additionally, EDA233– or EDA233# designates a deletion of the sequence GluAspAla that begins at position 233.

By "variant protein" or "protein variant", or "variant" as used herein is meant a protein that differs from that of a parent protein by virtue of at least one amino acid modification. The protein variant has at least one amino acid modification compared to the parent protein, yet not so many that the variant protein will not align with the parental protein using an alignment program such as that described below. In general, variant proteins (such as variant Fc domains, etc., outlined herein, are generally at least 75, 80, 85, 90, 91, 92, 93, 94, 95, 96, 97, 98 or 99% identical to the parent protein, using the alignment programs described below, such as BLAST.

As described below, in some embodiments the parent polypeptide, for example an Fc parent polypeptide, is a human wild type sequence, such as the heavy constant domain or Fc region from IgG1, IgG2, IgG3 or IgG4, although human sequences with variants can also serve as "parent polypeptides", for example the IgG1/2 hybrid of US Publication 2006/0134105 can be included. The protein variant sequence herein will preferably possess at least about 80% identity with a parent protein sequence, and most preferably at least about 90% identity, more preferably at least about 95-98-99% identity. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain as compared to an Fc domain of human IgG1, IgG2 or IgG4.

The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, N434S/M428L is the same Fc variant as M428L/N434S, and so on. For all positions discussed in the present invention that relate to antibodies, unless otherwise noted, amino acid position numbering is according to the EU index. The EU index or EU index as in Kabat or EU numbering scheme refers to the numbering of the EU antibody. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference). See also Edelman et al., 1969, Proc Natl Acad Sci USA 63:78-85, hereby entirely incorporated by reference. The modification can be an addition, deletion, or substitution.

By "protein" herein is meant at least two covalently attached amino acids, which includes proteins, polypeptides, oligopeptides and peptides. In addition, polypeptides that make up the antibodies of the invention may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "Fab" or "Fab region" as used herein is meant the polypeptide that comprises the VH, CH1, VL, and CL immunoglobulin domains, generally on two different polypeptide chains (e.g. VH-CH1 on one chain and VL-CL on the other). Fab may refer to this region in isolation, or this region in the context of a bispecific antibody of the invention. In the context of a Fab, the Fab comprises an Fv region in addition to the CH1 and CL domains.

By "Fv" or "Fv fragment" or "Fv region" as used herein is meant a polypeptide that comprises the VL and VH domains of an ABD. Fv regions can be formatted as both Fabs (as discussed above, generally two different polypeptides that also include the constant regions as outlined above) and scFvs, where the vl and vh domains are combined (generally with a linker as discussed herein) to form an scFv.

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (vh-linker-vl or vl-linker-vh). In the sequences depicted in the sequence listing and in the figures, the order of the vh and vl domain is indicated in the name, e.g. H.X_L.Y means N- to C-terminal is vh-linker-vl, and L.Y_H.X is vl-linker-vh.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the human IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life. An "FcRn variant" is one that increases binding to the FcRn receptor, and suitable FcRn variants are shown below.

By "parent polypeptide" as used herein is meant a starting polypeptide that is subsequently modified to generate a variant. The parent polypeptide may be a naturally occurring polypeptide, or a variant or engineered version of a naturally occurring polypeptide. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below. In this context, a "parent Fc domain" will be relative to the recited variant; thus, a "variant human IgG1 Fc domain" is compared to the parent Fc domain of human IgG1, a "variant human IgG4 Fc domain" is compared to the parent Fc domain human IgG4, etc.

By "Fc" or "Fc region" or "Fc domain" as used herein is meant the polypeptide comprising the CH2-CH3 domains of an IgG molecule, and in some cases, inclusive of the hinge. In EU numbering for human IgG1, the CH2-CH3 domain comprises amino acids 231 to 447, and the hinge is 216 to 230. Thus the definition of "Fc domain" includes both amino acids 231-447 (CH2-CH3) or 216-447 (hinge-CH2-CH3), or fragments thereof. An "Fc fragment" in this context may contain fewer amino acids from either or both of the N- and C-termini but still retains the ability to form a dimer with another Fc domain or Fc fragment as can be detected using standard methods, generally based on size (e.g. non-denaturing chromatography, size exclusion chromatography, etc.) Human IgG Fc domains are of particular use in the present invention, and can be the Fc domain from human IgG1, IgG2 or IgG4.

A "variant Fc domain" contains amino acid modifications as compared to a parental Fc domain. Thus, a "variant human IgG1 Fc domain" is one that contains amino acid modifications (generally amino acid substitutions, although in the case of ablation variants, amino acid deletions are included) as compared to the human IgG1 Fc domain. In general, variant Fc domains have at least about 80, 85, 90, 95, 97, 98 or 99 percent identity to the corresponding parental human IgG Fc domain (using the identity algorithms discussed below, with one embodiment utilizing the BLAST algorithm as is known in the art, using default parameters). Alternatively, the variant Fc domains can have from 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Additionally, as discussed herein, the variant Fc domains herein still retain the ability to form a dimer with another Fc domain as measured using known techniques as described herein, such as non-denaturing gel electrophoresis.

By "heavy chain constant region" herein is meant the CH1-hinge-CH2-CH3 portion of an antibody (or fragments thereof), excluding the variable heavy domain; in EU numbering of human IgG1 this is amino acids 118-447 By "heavy chain constant region fragment" herein is meant a heavy chain constant region that contains fewer amino acids from either or both of the N- and C-termini but still retains the ability to form a dimer with another heavy chain constant region.

By "position" as used herein is meant a location in the sequence of a protein. Positions may be numbered sequentially, or according to an established format, for example the EU index for antibody numbering.

By "target antigen" as used herein is meant the molecule that is bound specifically by the antigen binding domain comprising the variable regions of a given antibody. As discussed below, in the present case the target antigens are checkpoint inhibitor proteins.

By "strandedness" in the context of the monomers of the heterodimeric antibodies of the invention herein is meant that, similar to the two strands of DNA that "match", heterodimerization variants are incorporated into each monomer so as to preserve the ability to "match" to form heterodimers. For example, if some pI variants are engineered into monomer A (e.g. making the pI higher) then steric variants that are "charge pairs" that can be utilized as well do not interfere with the pI variants, e.g. the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer one set of the pair will go, such that pI separation is maximized using the pI of the skews as well.

By "target cell" as used herein is meant a cell that expresses a target antigen.

By "host cell" in the context of producing a bispecific antibody according to the invention herein is meant a cell that contains the exogeneous nucleic acids encoding the components of the bispecific antibody and is capable of expressing the bispecific antibody under suitable conditions. Suitable host cells are discussed below.

By "variable region" or "variable domain" as used herein is meant the region of an immunoglobulin that comprises one or more Ig domains substantially encoded by any of the Vκ, Vλ, and/or VH genes that make up the kappa, lambda, and heavy chain immunoglobulin genetic loci respectively, and contains the CDRs that confer antigen specificity. Thus, a "variable heavy domain" pairs with a "variable light domain" to form an antigen binding domain ("ABD"). In addition, each variable domain comprises three hypervariable regions ("complementary determining regions," "CDRs") (vhCDR1, vhCDR2 and vhCDR3 for the variable heavy domain and vlCDR1, vlCDR2 and vlCDR3 for the variable light domain) and four framework (FR) regions, arranged from amino-terminus to carboxy-terminus in the following order: FR1-CDR1-FR2-CDR2-FR3-CDR3-FR4.

By "wild type or WT" herein is meant an amino acid sequence or a nucleotide sequence that is found in nature, including allelic variations. A WT protein has an amino acid sequence or a nucleotide sequence that has not been intentionally modified.

The invention provides a number of antibody domains that have sequence identity to human antibody domains. Sequence identity between two similar sequences (e.g., antibody variable domains) can be measured by algorithms such as that of Smith, T. F. & Waterman, M. S. (1981) "Comparison Of Biosequences," Adv. Appl. Math. 2:482 [local homology algorithm]; Needleman, S. B. & Wunsch, CD. (1970) "A General Method Applicable To The Search For Similarities In The Amino Acid Sequence Of Two Proteins," J. Mol. Biol. 48:443 [homology alignment algorithm], Pearson, W. R. & Lipman, D. J. (1988) "Improved Tools For Biological Sequence Comparison," Proc. Natl. Acad. Sci. (U.S.A.) 85:2444 [search for similarity method]; or Altschul, S. F. et al, (1990) "Basic Local Alignment Search Tool," J. Mol. Biol. 215:403-10, the "BLAST" algorithm, see https://blast.ncbi.nlm.nih.gov/Blast.cgi. When using any of the aforementioned algorithms, the default parameters (for Window length, gap penally, etc) are used. In one embodiment, sequence identity is done using the BLAST algorithm, using default parameters The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities. "Recombinant" means the antibodies are generated using recombinant nucleic acid techniques in exogenous host cells, and they can be isolated as well.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a BIACORE®, SPR or BLI assay.

E. Antibodies

The present invention relates to the generation of bispecific checkpoint antibodies that bind two different checkpoint antigens as discussed herein. As is discussed below, the term "antibody" is used generally. Antibodies that find use in the present invention can take on a number of formats as described herein, including traditional antibodies as well as antibody derivatives, fragments and mimetics, described herein and depicted in the figures.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to bispecific antibodies that generally are based on the IgG class, which has several subclasses, including, but not limited to IgG1, IgG2, IgG3, and IgG4. In general, IgG1, IgG2 and IgG4 are used more frequently than IgG3. It should be noted that IgG1 has different allotypes with polymorphisms at 356 (D or E) and 358 (L or M). The sequences depicted herein use the 356E/358M allotype, however the other allotype is included herein. That is, any sequence inclusive of an IgG1 Fc domain included herein can have 356D/358L replacing the 356E/358M allotype.

In addition, many of the antibodies herein have at least one of the cysteines at position 220 replaced by a serine; generally this is the on the "scFv monomer" side for most of the sequences depicted herein, although it can also be on the "Fab monomer" side, or both, to reduce disulfide formation. Specifically included within the sequences herein are one or both of these cysteines replaced (C220S).

Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US Publication 2009/0163699, incorporated by reference, the present invention the use of human IgG1/G2 hybrids.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g. vhCDR1, vhCDR2 and vhCDR3) and the disclosure of each variable light region is a disclosure of the vhCDRs (e.g. vlCDR1, vlCDR2 and vlCDR3). A useful comparison of CDR numbering is as below, see Lafranc et al., Dev. Comp. Immunol. 27(1):55-77 (2003):

TABLE 1

| | Kabat + Chothia | IMGT | Kabat | AbM | Chothia | Contact | Xencor |
|---|---|---|---|---|---|---|---|
| vhCDR1 | 26-35 | 27-38 | 31-35 | 26-35 | 26-32 | 30-35 | 27-35 |
| vhCDR2 | 50-65 | 56-65 | 50-65 | 50-58 | 52-56 | 47-58 | 54-61 |
| vhCDR3 | 95-102 | 105-117 | 95-102 | 95-102 | 95-102 | 93-101 | 103-116 |
| vlCDR1 | 24-34 | 27-38 | 24-34 | 24-34 | 24-34 | 30-36 | 27-38 |
| vlCDR2 | 50-56 | 56-65 | 50-56 | 50-56 | 50-56 | 46-55 | 56-62 |
| vlCDR3 | 89-97 | 105-117 | 89-97 | 89-97 | 89-97 | 89-96 | 97-105 |

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g, Kabat et al., supra (1991)).

Another type of Ig domain of the heavy chain is the hinge region. By "hinge" or "hinge region" or "antibody hinge region" or "hinge domain" herein is meant the flexible polypeptide comprising the amino acids between the first and second constant domains of an antibody. Structurally, the IgG CH1 domain ends at EU position 215, and the IgG CH2 domain begins at residue EU position 231. Thus for IgG the antibody hinge is herein defined to include positions 216 (E216 in IgG1) to 230 (p230 in IgG1), wherein the numbering is according to the EU index as in Kabat. In some cases, a "hinge fragment" is used, which contains fewer amino acids at either or both of the N- and C-termini of the hinge domain. As noted herein, pI variants can be made in the hinge region as well.

The light chain generally comprises two domains, the variable light domain (containing the light chain CDRs and together with the variable heavy domains forming the Fv region), and a constant light chain region (often referred to as CL or ClO.

Another region of interest for additional substitutions, outlined below, is the Fc region.

The present invention provides a large number of different CDR sets. In this case, a "full CDR set" comprises the three variable light and three variable heavy CDRs, e.g. a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains.

Thus, the present invention provides different antibody domains. As described herein and known in the art, the heterodimeric antibodies of the invention comprise different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2-CH3), the variable heavy domain, the variable light domain, the light constant domain, Fab domains and scFv domains.

Thus, the "Fc domain" includes the —CH2-CH3 domain, and optionally a hinge domain (—H-CH2-CH3). In the embodiments herein, when a scFv is attached to an Fc domain, it is the C-terminus of the scFv construct that is attached to all or part of the hinge of the Fc domain; for example, it is generally attached to the sequence EPKS which is the beginning of the hinge. The heavy chain comprises a variable heavy domain and a constant domain, which includes a CH1-optional hinge-Fc domain comprising a CH2-CH3. The light chain comprises a variable light chain and the light constant domain. A scFv comprises a variable heavy chain, an scFv linker, and a variable light domain. In most of the constructs and sequences outlined herein, the C-terminus of the variable heavy chain is attached to the N-terminus of the scFv linker, the C-terminus of which is attached to the N-terminus of a variable light chain (N-vh-linker-vl-C) although that can be switched (N-vl-linker-vh-C).

Some embodiments of the invention comprise at least one scFv domain, which, while not naturally occurring, generally includes a variable heavy domain and a variable light domain, linked together by a scFv linker. As outlined herein, while the scFv domain is generally from N- to C-terminus oriented as vh-scFv linker-vl, this can be reversed for any of the scFv domains (or those constructed using vh and vl sequences from Fabs), to vl-scFv linker-vh, with optional linkers at one or both ends depending on the format (see generally FIG. 1).

As shown herein, there are a number of suitable linkers (for use as either domain linkers or scFv linkers) that can be used to covalently attach the recited domains, including traditional peptide bonds, generated by recombinant techniques. In some embodiments, the linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n (SEQ ID NO: 37756), (GGGGS)n (SEQ ID NO: 37757), and (GGGS)n (SEQ ID NO: 37758), where n is an integer of at least one (and generally from 3 to 4), glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example Cκ or Cλ. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g. TCR, FcR, KIR), hinge region-derived sequences, and other natural sequences from other proteins.

In some embodiments, the linker is a "domain linker", used to link any two domains as outlined herein together. For example, in FIG. 1F, there may be a domain linker that attaches the C-terminus of the CH1 domain of the Fab to the N-terminus of the scFv, with another optional domain linker attaching the C-terminus of the scFv to the CH2 domain (although in many embodiments the hinge is used as this domain linker). While any suitable linker can be used, many embodiments utilize a glycine-serine polymer as the domain linker, including for example (GS)n, (GSGGS)n (SEQ ID NO: 37756), (GGGGS)n (SEQ ID NO: 37757), and (GGGS)n (SEQ ID NO: 37758), where n is an integer of at least one (and generally from 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers, as used in some embodiments of scFv linkers can be used.

In some embodiments, the linker is a scFv linker, used to covalently attach the vh and vl domains as discussed herein. In many cases, the scFv linker is a charged scFv linker, a number of which are shown in FIG. 7. Accordingly, the present invention further provides charged scFv linkers, to facilitate the separation in pI between a first and a second monomer. That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make triple F format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the invention as well, and thus those included in FIG. 7 can be used in any embodiment herein where a linker is utilized.

In particular, the formats depicted in FIG. 1 are antibodies, usually referred to as "heterodimeric antibodies", meaning that the protein has at least two associated Fc sequences self-assembled into a heterodimeric Fc domain and at least two Fv regions, whether as Fabs or as scFvs.

F. Chimeric and Humanized Antibodies

In certain embodiments, the antibodies of the invention comprise a heavy chain variable region from a particular germline heavy chain immunoglobulin gene and/or a light chain variable region from a particular germline light chain immunoglobulin gene. For example, such antibodies may comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody (using the methods outlined herein). A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody may be at least 95, 96, 97, 98 or 99%, or even at least 96%, 97%, 98%, or 99% identical in amino acid sequence to the amino acid sequence encoded by the germline immunoglobulin gene. Typically, a humanized antibody derived from a particular human germline sequence will display no more than 10-20 amino acid differences from the amino acid sequence encoded by the human germline immunoglobulin gene (prior to the introduction of any skew, pI and ablation variants herein; that is, the number of variants is generally low, prior to the introduction of the variants of the invention). In certain cases, the humanized antibody may display no more than 5, or even no more than 4, 3, 2, or 1 amino acid difference from the amino acid sequence encoded by the germline immunoglobulin gene (again, prior to the introduction of any skew, pI and ablation variants herein; that is, the number of variants is generally low, prior to the introduction of the variants of the invention).

In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

IV. HETERODIMERIC ANTIBODIES

Accordingly, in some embodiments the present invention provides heterodimeric checkpoint antibodies that rely on the use of two different heavy chain variant Fc sequences, that will self-assemble to form heterodimeric Fc domains and heterodimeric antibodies.

The present invention is directed to novel constructs to provide heterodimeric antibodies that allow binding to more than one checkpoint antigen or ligand, e.g. to allow for bispecific binding. The heterodimeric antibody constructs are based on the self-assembling nature of the two Fc domains of the heavy chains of antibodies, e.g. two "monomers" that assemble into a "dimer". Heterodimeric antibodies are made by altering the amino acid sequence of each monomer as more fully discussed below. Thus, the present invention is generally directed to the creation of heterodimeric checkpoint antibodies which can co-engage antigens in several ways, relying on amino acid variants in the constant regions that are different on each chain to promote heterodimeric formation and/or allow for ease of purification of heterodimers over the homodimers.

Thus, the present invention provides bispecific antibodies. An ongoing problem in antibody technologies is the desire for "bispecific" antibodies that bind to two different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B (not including the light chain heterodimeric issues)). However, a major obstacle in the formation of bispecific antibodies is the difficulty in purifying the heterodimeric antibodies away from the homodimeric antibodies and/or biasing the formation of the heterodimer over the formation of the homodimers.

There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers. As is generally described in WO2014/145806, hereby incorporated by reference in its entirety and specifically as below for the discussion of "heterodimerization variants", useful mechanisms for heterodimerization include "knobs and holes" ("KIH"; sometimes herein as "skew" variants (see discussion in WO2014/145806), "electrostatic steering" or "charge pairs" as described in WO2014/145806, pI variants as described in WO2014/145806, and general additional Fc variants as outlined in WO2014/145806 and below.

In the present invention, there are several basic mechanisms that can lead to ease of purifying heterodimeric antibodies; one relies on the use of pI variants, such that each monomer has a different pI, thus allowing the isoelectric purification of A-A, A-B and B-B dimeric proteins. Alternatively, some scaffold formats, such as the "triple F" format, also allows separation on the basis of size. As is further outlined below, it is also possible to "skew" the formation of heterodimers over homodimers. Thus, a combination of steric heterodimerization variants and pI or charge pair variants find particular use in the invention.

In general, embodiments of particular use in the present invention rely on sets of variants that include skew variants, which encourage heterodimerization formation over homodimerization formation, coupled with pI variants, which increase the pI difference between the two monomers to facilitate purification of heterodimers away from homodimers.

Additionally, as more fully outlined below, depending on the format of the heterodimer antibody, pI variants can be either contained within the constant and/or Fc domains of a monomer, or charged linkers, either domain linkers or scFv linkers, can be used. That is, scaffolds that utilize scFv(s) such as the Triple F format can include charged scFv linkers (either positive or negative), that give a further pI boost for purification purposes. As will be appreciated by those in the art, some Triple F formats are useful with just charged scFv linkers and no additional pI adjustments, although the invention does provide pI variants that are on one or both of the monomers, and/or charged domain linkers as well. In addition, additional amino acid engineering for alternative functionalities may also confer pI changes, such as Fc, FcRn and KO variants.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B change be changed, with the pI of monomer A increasing and the pI of monomer B decreasing. As discussed, the pI changes of either or both monomers can be done by removing or adding a charged residue (e.g. a neutral amino acid is replaced by a positively or negatively charged amino acid residue, e.g. glycine to glutamic acid), changing a charged residue from positive or negative to the opposite charge (e.g. aspartic acid to lysine) or changing a charged residue to a neutral residue (e.g. loss of a charge; lysine to serine). A number of these variants are shown in the Figures.

Accordingly, this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease its pI_(wt A−+B or wt A−−B), or by increasing one region and decreasing the other region (A+−B− or A−B+).

Thus, in general, a component of some embodiments of the present invention are amino acid variants in the constant regions of antibodies that are directed to altering the isoelectric point (pI) of at least one, if not both, of the monomers of a dimeric protein to form "pI antibodies" by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components, for example in the triple F format, the starting pI of the scFv and Fab of interest. That is, to determine which monomer to engineer or in which "direction" (e.g. more positive or more negative), the Fv sequences of the two target antigens are calculated and a decision is made from there. As is known in the art, different Fvs will have different starting pIs which are exploited in the present invention. In general, as outlined herein, the pIs are engineered to result in a total pI difference of each monomer of at least about 0.1 logs, with 0.2 to 0.5 being preferred as outlined herein.

Furthermore, as will be appreciated by those in the art and outlined herein, in some embodiments, heterodimers can be separated from homodimers on the basis of size. As shown in FIG. 1 for example, several of the formats allow separation of heterodimers and homodimers on the basis of size.

A. Heterodimerization Variants

The present invention provides heterodimeric proteins, including heterodimeric antibodies in a variety of formats, which utilize heterodimeric variants to allow for heterodimeric formation and/or purification away from homodimers.

There are a number of suitable pairs of sets of heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other; that is, these pairs of sets form an interface between the two monomers that encourages heterodimer formation and discourages homodimer formation, allowing the percentage of heterodimers that spontaneously form under biological conditions to be over 90%, rather than the expected 50% (25% homodimer A/A: 50% heterodimer A/B:25% homodimer B/B).

B. Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are included in in the Figures.

One mechanism is generally referred to in the art as "knobs and holes", referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R.

Additional monomer A and monomer B variants that can be combined with other variants, optionally and independently in any amount, such as pI variants outlined herein or other steric variants that are shown in FIG. 37 of US 2012/0149876, the figure and legend and SEQ ID NOs of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the invention.

A list of suitable skew variants is found in FIG. 3 and FIG. 8 showing some pairs of particular utility in many embodiments. Of particular use in many embodiments are the pairs of sets including, but not limited to, S364K/E357Q:L368D/K370S; L368D/K370S:S364K; L368E/K370S:S364K; T411T/E360E/Q362E:D401K; L368D/K370S:S364K/E357L, K370S:S364K/E357Q and T366S/L368A/Y407V:T366W (optionally including a bridging disulfide, T366S/L368A/Y407V/Y349C:T366W/S354C). In terms of nomenclature, the pair "S364K/E357Q:L368D/K370S" means that one of the monomers has the double variant set S364K/E357Q and the other has the double variant set L368D/K370S; as above, the "strandedness" of these pairs depends on the starting pI.

C. pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Preferred combinations of pI variants are shown in FIG. 4. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, for example in the FIGS. 1A, E, F, G, H and I formats, a preferred combination of pI variants has one monomer (the negative Fab side) comprising 208D/295E/384D/418E/421D variants (N208D/Q295E/N384D/Q418E/N421D when relative to human IgG1) and a second monomer (the positive scFv side) comprising a positively charged scFv linker, including (GKPGS)$_4$ (SEQ ID NO: 37755). However, as will be appreciated by those in the art, the first monomer includes a CH1 domain, including position 208. Accordingly, in constructs that do not include a CH1 domain (for example for antibodies that do not utilize a CH1 domain on one of the domains, for example in a dual scFv format or a "one armed" format such as those depicted in FIG. 1B, C or D), a preferred negative pI variant Fc set includes 295E/384D/418E/421D variants (Q295E/N384D/Q418E/N421D when relative to human IgG1).

Accordingly, in some embodiments, one monomer has a set of substitutions from FIG. 4 and the other monomer has a charged linker (either in the form of a charged scFv linker because that monomer comprises an scFv or a charged domain linker, as the format dictates, which can be selected from those depicted in FIG. 7).

1. Isotypic Variants

In addition, many embodiments of the invention rely on the "importation" of pI amino acids at particular positions from one IgG isotype into another, thus reducing or eliminating the possibility of unwanted immunogenicity being introduced into the variants. A number of these are shown in FIG. 21 of US Publ. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g. by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

D. Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Pub. 2014/0370013. As discussed herein, which monomer to engineer is generally decided by the inherent pI of the Fv and scaffold regions. Alternatively, the pI of each monomer can be compared.

E. pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall'Acqua et al. showed that Fc mutants with increased FcRn binding at pH 6 and pH 7.4 actually had reduced serum concentrations and the same half life as wild-type Fc (Dall'Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Recently it has been suggested that antibodies with variable regions that have lower isoelectric points may also have longer serum half-lives (Igawa et al., 2010 PEDS. 23(5): 385-392, entirely incorporated by reference). However, the mechanism of this is still poorly understood. Moreover, variable regions differ from antibody to antibody. Constant region variants with reduced pI and extended half-life would provide a more modular approach to improving the pharmacokinetic properties of antibodies, as described herein.

F. Additional Fc Variants for Additional Functionality

In addition to pI amino acid variants, there are a number of useful Fc amino acid modification that can be made for a variety of reasons, including, but not limited to, altering binding to one or more FcγR receptors, altered binding to FcRn receptors, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

G. FcγR Variants

Accordingly, there are a number of useful Fc substitutions that can be made to alter binding to one or more of the FcγR receptors. Substitutions that result in increased binding as well as decreased binding can be useful. For example, it is known that increased binding to FcγRIIIa results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T.

In addition, there are additional Fc substitutions that find use in increased binding to the FcRn receptor and increased serum half life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259I/308F/428L.

H. Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g. FcγR1, FcγRIIa, FcγRIIb, FcγRIIIa, etc.) to avoid additional mechanisms of action. That is, for example, in many embodiments, particularly in the use of bispecific checkpoint antibodies desirable to ablate FcγRIIIa binding to eliminate or significantly reduce ADCC activity such that one of the Fc domains comprises one or more Fcγ receptor ablation variants. These ablation variants are depicted in FIG. 5, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del. It should be noted that the ablation variants referenced herein ablate FcγR binding but generally not FcRn binding.

As is known in the art, the Fc domain of human IgG1 has the highest binding to the Fcγ receptors, and thus ablation variants can be used when the constant domain (or Fc domain) in the backbone of the heterodimeric antibody is IgG1. Alternatively, or in addition to ablation variants in an IgG1 background, mutations at the glycosylation position 297 (generally to A or S) can significantly ablate binding to FcγRIIIa, for example. Human IgG2 and IgG4 have naturally reduced binding to the Fcγ receptors, and thus those backbones can be used with or without the ablation variants.

I. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, are also independently and optionally combined with Fc ablation variants, Fc variants, FcRn variants, as generally outlined herein.

V. Useful Formats of the Invention

As will be appreciated by those in the art and discussed more fully below, the bispecific heterodimeric antibodies of the present invention can take on a wide variety of configurations, as are generally depicted in FIG. 1. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. Thus, the present invention is directed to novel immunoglobulin compositions that co-engage a different first and a second antigen.

As will be appreciated by those in the art, the heterodimeric formats of the invention can have different valencies as well as be bispecific. That is, heterodimeric antibodies of the invention can be bivalent and bispecific, wherein one checkpoint target is bound by one ABD and the other checkpoint target is bound by a second ABD. The heterodimeric antibodies can also be trivalent and bispecific, wherein the first antigen is bound by two ABDs and the second antigen by a second ABD.

A. Bottle Opener Format

One heterodimeric scaffold that finds particular use in the present invention is the "triple F" or "bottle opener" scaffold format as shown in FIG. 1A. In this embodiment, one heavy chain of the antibody contains a single chain Fv ("scFv", as defined below) and the other heavy chain is a "regular" Fab format, comprising a variable heavy chain and a light chain. This structure is sometimes referred to herein as "triple F" format (scFv-Fab-Fc) or the "bottle-opener" format, due to a rough visual similarity to a bottle-opener (see FIG. 1A). The two chains are brought together by the use of amino acid variants in the constant regions (e.g. the Fc domain, the CH1 domain and/or the hinge region) that promote the formation of heterodimeric antibodies as is described more fully below.

There are several distinct advantages to the present "triple F" format. As is known in the art, antibody analogs relying on two scFv constructs often have stability and aggregation problems, which can be alleviated in the present invention by the addition of a "regular" heavy and light chain pairing. In addition, as opposed to formats that rely on two heavy chains and two light chains, there is no issue with the incorrect pairing of heavy and light chains (e.g. heavy 1 pairing with light 2, etc.).

Many of the embodiments outlined herein rely in general on the bottle opener format that comprises a first monomer comprising an scFv, comprising a variable heavy and a variable light domain, covalently attached using an scFv linker (charged, in many but not all instances), where the scFv is covalently attached to the N-terminus of a first Fc domain usually through a domain linker (which, as outlined herein can either be un-charged or charged and can be exogeneous or endogeneous (e.g. all or part of the native hinge domain). The second monomer of the bottle opener format is a heavy chain, and the composition further comprises a light chain.

In addition, the Fc domains of the bottle opener format generally comprise skew variants (e.g. a set of amino acid substitutions as shown in FIG. 3 and FIG. 8, with particularly useful skew variants being selected from the group consisting of S364K/E357Q:L368D/K370S; L368D/K370S: S364K; L368E/K370S:S364K; T411T/E360E/Q362E: D401K; L368D/K370S:S364K/E357L, K370S:S364K/ E357Q, T366S/L368A/Y407V:T366W and T366S/L368A/ Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the bottle opener format includes skew variants, pI variants, and ablation variants. Accordingly, some embodiments include bottle opener formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/ L235A/G236del/S267K, and an Fv that binds to a checkpoint receptor as outlined herein; b) a second monomer (the "Fab monomer") that comprises the skew variants L368D/ K370S, the pI variants N208D/Q295E/N384D/Q418E/ N421D, the ablation variants E233P/L234V/L235A/ G236del/S267K, and a variable heavy domain that, with the variable light domain, makes up an Fv that binds to a second checkpoint receptor as outlined herein; and c) a light chain. In this particular embodiment, suitable monomer Fv pairs include (Fabs listed first, scFvs second) PD-1 and CTLA-4, CTLA-4 and PD-1, PD-1 and TIM-3, TIM-3 and PD-1, PD-1 and LAG-3, LAG-3×PD1, PD-1 and TIGIT, TIGIT and PD-1, PD-1 and BTLA, BTLA and PD-1, CTLA-4 and TIM-3, TIM-3 and CTLA-4, CTLA-4 and LAG-3, LAG-3 and CTLA-4, CTLA-4 and TIGIT, TIGIT and CTLA-4, CTLA-4 and BTLA, BTLA and CTLA-4, TIM-3 and LAG-3, LAG-3 and TIM-3, TIM-3 and TIGIT, TIGIT and TIM-3, TIM-3 and BTLA, BTLA and TIM-3. LAG-3 and TIGIT, TIGIT and LAG-3, LAG-3 and BTLA, BTLA and LAG-3, BTLA and TIGIT, and TIGIT and BTLA. In this particular embodiment, a bottle opener with these variants have the scFv side comprising the ABD 1G6_L1.194_H1.279 that binds to PD-1 finds particular use. In this particular embodiment, a bottle opener with these variants have the scFv side comprising the [CTLA-4]_H3.23_L0.129 ABD that binds to CTLA-4 finds particular use.

Of particular use in some embodiments, particularly in the bottle opener format, are CTLA-4×PD-1, LAG-3×PD-1, BTLA×PD-1, TIM-3×PD-1 and LAG-3×CTLA-4.

The ABD sequences for these combinations can be as disclosed in the sequence listing or as shown in FIGS. 9 to 13, and in any combination as shown in FIG. 39 and FIG. 40.

In some embodiments, the bottle opener format includes skew variants, pI variants, ablation variants and FcRn variants. Accordingly, some embodiments include bottle opener formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/L235A/G236del/S267K, the FcRn variants M428L/N434S and an Fv that binds to a checkpoint inhibitor as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain, makes up an Fv that binds to a second checkpoint inhibitor as outlined herein; and c) a light chain. In this particular embodiment, suitable Fv pairs include (Fabs listed first, scFvs second) PD-1 and CTLA-4, CTLA-4 and PD-1, PD-1 and TIM-3, TIM-3 and PD-1, PD-1 and LAG-3, LAG-3×PD1, PD-1 and TIGIT, TIGIT and PD-1, PD-1 and BTLA, BTLA and PD-1, CTLA-4 and TIM-3, TIM-3 and CTLA-4, CTLA-4 and LAG-3, LAG-3 and CTLA-4, CTLA-4 and TIGIT, TIGIT and CTLA-4, CTLA-4 and BTLA, BTLA and CTLA-4, TIM-3 and LAG-3, LAG-3 and TIM-3, TIM-3 and TIGIT, TIGIT and TIM-3, TIM-3 and BTLA, BTLA and TIM-3. LAG-3 and TIGIT, TIGIT and LAG-3, LAG-3 and BTLA, BTLA and LAG-3, BTLA and TIGIT, and TIGIT and BTLA. In this particular embodiment, a bottle opener with these variants have the scFv side comprising the ABD 1G6_L1.194_H1.279 that binds to PD-1 finds particular use. In this particular embodiment, a bottle opener with these variants have the scFv side comprising the [CTLA-4]_H3.23_L0.129 ABD that binds to CTLA-4 finds particular use.

Of particular use in some embodiments, particularly in the bottle opener format, are CTLA-4×PD-1, LAG-3×PD-1, BTLA×PD-1, TIM-3×PD-1 and LAG-3×CTLA-4.

Specifically, FIG. 37 shows some bottle opener "backbone" sequences that are missing the Fv sequences that can be used in the present invention. That is, Fv sequences for the scFv portion and the Fab portion can be used from any combination of PD-1 and CTLA-4, PD-1 and TIM-3, PD-1 and LAG-3, PD-1 and TIGIT, PD-1 and BTLA, CTLA-4 and TIM-3, CTLA-4 and LAG-3, CTLA-4 and TIGIT, CTLA-4 and BTLA, TIM-3 and LAG-3, TIM-3 and TIGIT, TIM-3 and BTLA, LAG-3 and TIGIT, LAG-3 and BTLA and TIGIT and BTLA. The sequences can be any of those disclosed herein in the sequence listing and/or in FIGS. 9 to 13.

For bottle opener backbone 1 from FIG. 37, specific Fv combinations of use in the present invention include PD-1 and CTLA-4, PD-1 and TIM-3, PD-1 and LAG-3, PD-1 and TIGIT, PD-1 and BTLA, CTLA-4 and TIM-3, CTLA-4 and LAG-3, CTLA-4 and TIGIT, CTLA-4 and BTLA, TIM-3 and LAG-3, TIM-3 and TIGIT, TIM-3 and BTLA, LAG-3 and TIGIT, LAG-3 and BTLA and TIGIT and BTLA. The sequences can be any of those disclosed herein in the sequence listing and/or in FIGS. 9 to 13.

For bottle opener backbone 1 from FIG. 37, specific Fv combinations of use in the present invention include CTLA-4 (Fab)×PD-1 (scFv), PD-1 (Fab)×CTLA-4 (scFv), LAG-3 (Fab)×PD-1 (scFv), BTLA (Fab)×PD-1 (scFv) and LAG-3 (Fab)×CTLA-4 (scFv).

For bottle opener backbone 1 from FIG. 37 (optionally including the 428L/434S variants), specific ABDs that bind human PD-1 include, but are not limited to, 1G6_H1.279_L1.194, 1G6_H1.280_L1.224; 1G6_L1.194_H1.279, 1G6_L1.210_H1.288 and 2E9_H1L1, as well as those listed in SEQ ID NOs: 6209-11464, SEQ ID NOs: 11465-17134, SEQ ID NOs: 33003-33072, SEQ ID NOs: 33073-35394 and SEQ ID NOs: 36127-36146.

For bottle opener backbone 1 from FIG. 37 (optionally including the 428L/434S variants), specific ABDs that bind human CTLA-4 include, but are not limited to, [CTLA-4]_H0.25_L0; [CTLA-4]_H0.26_L0; [CTLA-4]_H0.27_L0; [CTLA-4]_H0.29_L0; [CTLA-4]_H0.38_L0; [CTLA-4]_H0.39_L0; [CTLA-4]_H0.40_L0; [CTLA-4]_H0.70_L0; [CTLA-4]_H0_L0.22; [CTLA-4]_H2_L0; [CTLA-4]_H3.21_L0.124; [CTLA-4]_H3.21_L0.129; [CTLA-4]_H3.21_L0.132; [CTLA-4]_H3.23_L0.124; [CTLA-4]_H3.23_L0.129; [CTLA-4]_H3.23_L0.132; [CTLA-4]_H3.25_L0.124; [CTLA-4]_H3.25_L0.129; [CTLA-4]_H3.25_L0.132; [CTLA-4]_H3.4_L0.118; [CTLA-4]_H3.4_L0.119; [CTLA-4]_H3.4_L0.12; [CTLA-4]_H3.4_L0.121; [CTLA-4]_H3.4_L0.122; [CTLA-4]_H3.4_L0.123; [CTLA-4]_H3.4_L0.124; [CTLA-4]_H3.4_L0.125; [CTLA-4]_H3.4_L0.126; [CTLA-4]_H3.4_L0.127; [CTLA-4]_H3.4_L0.128; [CTLA-4]_H3.4_L0.129; [CTLA-4]_H3.4_L0.130; [CTLA-4]_H3.4_L0.131; [CTLA-4]_H3.4_L0.132; [CTLA-4]_H3.5_L2.1; [CTLA-4]_H3.5_L2.2; [CTLA-4]_H3.5_L2.3; [CTLA-4]_H3_L0; [CTLA-4]_H3_L0.22; [CTLA-4]_H3_L0.44; [CTLA-4]_H3_L0.67 and [CTLA-4]_H3_L0.74, as well as those listed in SEQ ID NOs: 21-2918, SEQ ID NOs: 2919-6208, SEQ ID NOs: 36739-36818 and SEQ ID NOs: 35395-35416.

For bottle opener backbone 1 from FIG. 37 (optionally including the 428L/434S variants), specific ABDs that bind human LAG-3 include, but are not limited to, 2A11_H0L0; 2A11_H1.125_L2.113; 2A11_H1.144_L2.142; 2A11_H1_L2.122; 2A11_H1_L2.123; 2A11_H1_L2.124; 2A11_H1_L2.25; 2A11_H1_L2.47; 2A11_H1_L2.50; 2A11_H1_L2.91; 2A11_H1_L2.93; 2A11_H1_L2.97; 2A11_H1L1; 2A11_H1L2; 2A11_H2L2; 2A11_H3L1; 2A11_H3L2; 2A11_H4L1; 2A11_H4L2; 7G8_H0L0; 7G8_H1L1; 7G8_H3.18_L1.11; 7G8_H3.23_L1.11; 7G8_H3.28_L1; 7G8_H3.28_L1.11; 7G8_H3.28_L1.13; 7G8_H3.30_L1.34; 7G8_H3.30_L1.34; and 7G8_H3L1, as well as those listed in SEQ ID NOs: 17135-20764, SEQ ID NOs: 36819-36962, SEQ ID NOs: 35417-35606, SEQ ID NOs: 25194-32793 and SEQ ID NOs: 32794-33002.

For bottle opener backbone 1 from FIG. 37 (optionally including the 428L/434S variants), specific ABDs that bind human BTLA include, but are not limited to, 9C6_H0L0; 9C6_H1.1_L1; and 9C6_H1.11_L1, as well as those listed in SEQ ID SEQ ID NOs: 20885-21503 and SEQ ID NOs: 36707-36738.

For bottle opener backbone 1 from FIG. 37 (optionally including the 428L/434S variants), specific ABDs that bind human TIM-3 include, but are not limited to, 1D10_H0L0; 1D12_H0L0; 3H3_H1_L2.1; 6C8_H0L0; 6D9_H0_1D12_L0; 7A9_H0L0; 7B11_H0L0; 7B11var_H0L0 and 7C2_H0L0, as well as those listed in SEQ ID NOs: 20765-20884, SEQ ID NOs: 37587-37698 and SEQ ID NOs: 36347-36706.

Specific bottle opener embodiments are outlined below.

B. mAb-Fv Format

One heterodimeric scaffold that finds particular use in the present invention is the mAb-Fv format shown in FIG. 1H. In this embodiment, the format relies on the use of a C-terminal attachment of an "extra" variable heavy domain to one monomer and the C-terminal attachment of an "extra" variable light domain to the other monomer, thus forming a third antigen binding domain, wherein the Fab portions of the two monomers bind one checkpoint target and the "extra" scFv domain binds a different checkpoint target.

In this embodiment, the first monomer comprises a first heavy chain, comprising a first variable heavy domain and a first constant heavy domain comprising a first Fc domain, with a first variable light domain covalently attached to the C-terminus of the first Fc domain using a domain linker (vh1-CH1-hinge-CH2-CH3-[optional linker]-vl2). The second monomer comprises a second variable heavy domain of the second constant heavy domain comprising a second Fc domain, and a third variable heavy domain covalently attached to the C-terminus of the second Fc domain using a domain linker (vh1-CH1-hinge-CH2-CH3-[optional linker]-vh2. The two C-terminally attached variable domains make up a scFv. This embodiment further utilizes a common light chain comprising a variable light domain and a constant light domain, which associates with the heavy chains to form two identical Fabs. As for many of the embodiments herein, these constructs include skew variants, pI variants, ablation variants, additional Fc variants, etc. as desired and described herein. In this embodiment, suitable Fv pairs include (Fabs listed first, scFvs second) PD-1 and CTLA-4, CTLA-4 and PD-1, PD-1 and TIM-3, TIM-3 and PD-1, PD-1 and LAG-3, LAG-3×PD1, PD-1 and TIGIT, TIGIT and PD-1, PD-1 and BTLA, BTLA and PD-1, CTLA-4 and TIM-3, TIM-3 and CTLA-4, CTLA-4 and LAG-3, LAG-3 and CTLA-4, CTLA-4 and TIGIT, TIGIT and CTLA-4, CTLA-4 and BTLA, BTLA and CTLA-4, TIM-3 and LAG-3, LAG-3 and TIM-3, TIM-3 and TIGIT, TIGIT and TIM-3, TIM-3 and BTLA, BTLA and TIM-3. LAG-3 and TIGIT, TIGIT and LAG-3, LAG-3 and BTLA, BTLA and LAG-3, BTLA and TIGIT, and TIGIT and BTLA.

The ABD sequences for these combinations can be as disclosed in the sequence listing or as shown in FIGS. 9 to 13, and in any combination as shown in FIG. 39 and FIG. 40.

In addition, the Fc domains of the mAb-Fv format comprise skew variants (e.g. a set of amino acid substitutions as shown in FIG. 3 and FIG. 8, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the mAb-Fv format includes skew variants, pI variants, and ablation variants. Accordingly, some embodiments include bottle opener formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. Of particular use in some embodiments in this format, are (Fab-scFv order) CTLA-4×PD-1, LAG-3×PD-1, BTLA×PD-1, and LAG-3×CTLA-4.

In some embodiments, the mAb-Fv format includes skew variants, pI variants, ablation variants and FcRn variants. Accordingly, some embodiments include bottle opener formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. Of particular use in some embodiments in this format, are (Fab-scFv order) CTLA-4×PD-1, LAG-3×PD-1, BTLA×PD-1, and LAG-3×CTLA-4.

For mAb-Fv sequences that are similar to the mAb-scFv backbone 1 (optionally including M428L/N434S) from FIG. 38, specific ABDs that bind human PD-1 include, but are not limited to, 1G6_H1.279_L1.194, 1G6_H1.280_L1.224; 1G6_L1.194_H1.279, 1G6_L1.210_H1.288 and 2E9_H1L1, as well as those listed in SEQ ID NOs: 6209-11464, SEQ ID NOs: 11465-17134, SEQ ID NOs: 33003-33072, SEQ ID NOs: 33073-35394 and SEQ ID NOs: 36127-36146.

For mAb-Fv sequences that are similar to the mAb-scFv backbone 1 (optionally including M428L/N434S) from FIG. 38, specific ABDs that bind human CTLA-4 include, but are not limited to, [CTLA-4]_H0.25_L0; [CTLA-4]_H0.26_L0; [CTLA-4]_H0.27_L0; [CTLA-4]_H0.29_L0; [CTLA-4]_H0.38_L0; [CTLA-4]_H0.39_L0; [CTLA-4]_H0.40_L0; [CTLA-4]_H0.70_L0; [CTLA-4]_H0_L0.22; [CTLA-4]_H2_L0; [CTLA-4]_H3.21_L0.124; [CTLA-4]_H3.21_L0.129; [CTLA-4]_H3.21_L0.132; [CTLA-4]_H3.23_L0.124; [CTLA-4]_H3.23_L0.129; [CTLA-4]_H3.23_L0.132; [CTLA-4]_H3.25_L0.124; [CTLA-4]_H3.25_L0.129; [CTLA-4]_H3.25_L0.132; [CTLA-4]_H3.4_L0.118; [CTLA-4]_H3.4_L0.119; [CTLA-4]_H3.4_L0.12; [CTLA-4]_H3.4_L0.121; [CTLA-4]_H3.4_L0.122; [CTLA-4]_H3.4_L0.123; [CTLA-4]_H3.4_L0.124; [CTLA-4]_H3.4_L0.125; [CTLA-4]_H3.4_L0.126; [CTLA-4]_H3.4_L0.127; [CTLA-4]_H3.4_L0.128; [CTLA-4]_H3.4_L0.129; [CTLA-4]_H3.4_L0.130; [CTLA-4]_H3.4_L0.131; [CTLA-4]_H3.4_L0.132; [CTLA-4]_H3.5_L2.1; [CTLA-4]_H3.5_L2.2; [CTLA-4]_H3.5_L2.3; [CTLA-4]_H3_L0; [CTLA-4]_H3_L0.22; [CTLA-4]_H3_L0.44; [CTLA-4]_H3_L0.67 and [CTLA-4]_H3_L0.74, as well as those listed in SEQ ID NOs: 21-2918, SEQ ID NOs: 2919-6208, SEQ ID NOs: 36739-36818 and SEQ ID NOs: 35395-35416.

For mAb-Fv sequences that are similar to the mAb-scFv backbone 1 (optionally including M428L/N434S) from FIG. 38, specific ABDs that bind human LAG-3 include, but are not limited to, 2A11_H0L0; 2A11_H1.125_L2.113; 2A11_H1.144_L2.142; 2A11_H1_L2.122; 2A11_H1_L2.123; 2A11_H1_L2.124; 2A11_H1_L2.25; 2A11_H1_L2.47; 2A11_H1_L2.50; 2A11_H1_L2.91; 2A11_H1_L2.93; 2A11_H1_L2.97; 2A11_H1L1; 2A11_H1L2; 2A11_H2L2; 2A11_H3L1; 2A11_H3L2; 2A11_H4L1; 2A11_H4L2; 7G8_H0L0; 7G8_H1L1; 7G8_H3.18_L1.11; 7G8_H3.23_L1.11; 7G8_H3.28_L1; 7G8_H3.28_L1.11; 7G8_H3.28_L1.13; 7G8_H3.30_L1.34; 7G8_H3.30_L1.34; and 7G8_H3L1, as well as those listed in SEQ ID NOs: 17135-20764, SEQ ID NOs: 36819-36962, SEQ ID NOs: 35417-35606, SEQ ID NOs: 25194-32793 and SEQ ID NOs: 32794-33002.

For mAb-Fv sequences that are similar to the mAb-scFv backbone 1 (optionally including M428L/N434S) from FIG. 38, specific ABDs that bind human BTLA include, but are not limited to, 9C6_H0L0; 9C6_H1.1_L1; and 9C6_H1.11_L1, as well as those listed in SEQ ID NOs: 20885-21503 and SEQ ID NOs: 36707-36738.

For mAb-Fv sequences that are similar to the mAb-scFv backbone 1 (optionally including M428L/N434S) from FIG. 38, specific ABDs that bind human TIM-3 include, but are not limited to, 1D10_H0L0; 1D12_H0L0; 3H3_H1_L2.1; 6C8_H0L0; 6D9_H0_1D12_L0; 7A9_H0L0; 7B11_H0L0; 7B11var_H0L0 and 7C2_H0L0, as well as those listed in SEQ ID NOs: 20765-20884, SEQ ID NOs: 37587-37698 and SEQ ID NOs: 36347-36706.

C. mAb-scFv

One heterodimeric scaffold that finds particular use in the present invention is the mAb-scFv format shown in FIG. 11. In this embodiment, the format relies on the use of a C-terminal attachment of an scFv to one of the monomers, thus forming a third antigen binding domain, wherein the Fab portions of the two monomers bind one checkpoint target and the "extra" scFv domain binds a different checkpoint target.

In this embodiment, the first monomer comprises a first heavy chain (comprising a variable heavy domain and a constant domain), with a C-terminally covalently attached scFv comprising a scFv variable light domain, an scFv linker and a scFv variable heavy domain in either orientation (vh1-CH1-hinge-CH2-CH3-[optional linker]-vh2-scFv linker-vl2 or vh1-CH1-hinge-CH2-CH3-[optional linker]-vl2-scFv linker-vh2). This embodiment further utilizes a common light chain comprising a variable light domain and a constant light domain, which associates with the heavy chains to form two identical Fabs that bind one of the target antigens. As for many of the embodiments herein, these constructs include skew variants, pI variants, ablation variants, additional Fc variants, etc. as desired and described herein. In this embodiment, suitable Fv pairs include (Fabs listed first, scFvs second) PD-1 and CTLA-4, CTLA-4 and PD-1, PD-1 and TIM-3, TIM-3 and PD-1, PD-1 and LAG-3, LAG-3×PD1, PD-1 and TIGIT, TIGIT and PD-1, PD-1 and BTLA, BTLA and PD-1, CTLA-4 and TIM-3, TIM-3 and CTLA-4, CTLA-4 and LAG-3, LAG-3 and CTLA-4, CTLA-4 and TIGIT, TIGIT and CTLA-4, CTLA-4 and BTLA, BTLA and CTLA-4, TIM-3 and LAG-3, LAG-3 and TIM-3, TIM-3 and TIGIT, TIGIT and TIM-3, TIM-3 and BTLA, BTLA and TIM-3. LAG-3 and TIGIT, TIGIT and LAG-3, LAG-3 and BTLA, BTLA and LAG-3, BTLA and TIGIT, and TIGIT and BTLA.

The ABD sequences for these combinations can be as disclosed in the sequence listing or as shown in FIGS. 9 to 13, and in any combination as shown in FIG. 39 and FIG. 40.

In addition, the Fc domains of the mAb-scFv format generally comprise skew variants (e.g. a set of amino acid substitutions as shown in FIG. 3 and FIG. 8, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the mAb-scFv format includes skew variants, pI variants, and ablation variants. Accordingly, some embodiments include bottle opener formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. Of particular use in some embodiments in this format, are (Fab-scFv order) CTLA-4×PD-1, LAG-3×PD-1, BTLA×PD-1, and LAG-3×CTLA-4.

In some embodiments, the mAb-scFv format includes skew variants, pI variants, ablation variants and FcRn variants. Accordingly, some embodiments include bottle opener formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. In mAb-scFv formats, specific Fv combinations of use in the present invention include CTLA-4 (Fab)×PD-1 (scFv), PD-1 (Fab)×CTLA-4 (scFv), LAG-3 (Fab)×PD-1 (scFv), BTLA (Fab)×PD-1 (scFv) and LAG-3 (Fab)×CTLA-4 (scFv).

In mAb-scFv backbone 1 (optionally including M428L/N434S) from FIG. 38, specific ABDs that bind human PD-1 include, but are not limited to, 1G6_H1.279_L1.194, 1G6_H1.280_L1.224; 1G6_L1.194_H1.279, 1G6_L1.210_H1.288 and 2E9_H1L1, as well as those listed in SEQ ID NOs: 6209-11464, SEQ ID NOs: 11465-17134, SEQ ID NOs: 33003-33072, SEQ ID NOs: 33073-35394 and SEQ ID NOs: 36127-36146.

In mAb-scFv backbone 1 (optionally including M428L/N434S) from FIG. 38, specific ABDs that bind human CTLA-4 include, but are not limited to, [CTLA-4]_H0.25_L0; [CTLA-4]_H0.26_L0; [CTLA-4]_H0.27_L0; [CTLA-4]_H0.29_L0; [CTLA-4]_H0.38_L0; [CTLA-4]_H0.39_L0; [CTLA-4]_H0.40_L0; [CTLA-4]_H0.70_L0; [CTLA-4]_H0_L0.22; [CTLA-4]_H2_L0; [CTLA-4]_H3.21_L0.124; [CTLA-4]_H3.21_L0.129; [CTLA-4]_H3.21_L0.132; [CTLA-4]_H3.23_L0.124; [CTLA-4]_H3.23_L0.129; [CTLA-4]_H3.23_L0.132; [CTLA-4]_H3.25_L0.124; [CTLA-4]_H3.25_L0.129; [CTLA-4]_H3.25_L0.132; [CTLA-4]_H3.4_L0.118; [CTLA-4]_H3.4_L0.119; [CTLA-4]_H3.4_L0.12; [CTLA-4]_H3.4_L0.121; [CTLA-4]_H3.4_L0.122; [CTLA-4]_H3.4_L0.123; [CTLA-4]_H3.4_L0.124; [CTLA-4]_H3.4_L0.125; [CTLA-4]_H3.4_L0.126; [CTLA-4]_H3.4_L0.127; [CTLA-4]_H3.4_L0.128; [CTLA-4]_H3.4_L0.129; [CTLA-4]_H3.4_L0.130; [CTLA-4]_H3.4_L0.131; [CTLA-4]_H3.4_L0.132; [CTLA-4]_H3.5_L2.1; [CTLA-4]_H3.5_L2.2; [CTLA-4]_H3.5_L2.3; [CTLA-4]_H3_L0; [CTLA-4]_H3_L0.22; [CTLA-4]_H3_L0.44; [CTLA-4]_H3_L0.67 and [CTLA-4]_H3_L0.74, as well as those listed in SEQ ID NOs: 21-2918, SEQ ID NOs: 2919-6208, SEQ ID NOs: 36739-36818 and SEQ ID NOs: 35395-35416.

In mAb-scFv backbone 1 (optionally including M428L/N434S) from FIG. 38, specific ABDs that bind human LAG-3 include, but are not limited to, 2A11_H0L0;

2A11_H1.125_L2.113; 2A11_H1.144_L2.142; 2A11_H1_L2.122; 2A11_H1_L2.123; 2A11_H1_L2.124; 2A11_H1_L2.25; 2A11_H1_L2.47; 2A11_H1_L2.50; 2A11_H1_L2.91; 2A11_H1_L2.93; 2A11_H1_L2.97; 2A11 H1L1 2A11_H1L2; 2A11_H2L2; 2A11_H3L1; 2A11_H3L2; 2A11_H4L1; 2A11_H4L2; 7G8_H0L0; 7G8_H1L1; 7G8_H3.18_L1.11; 7G8_H3.23_L1.11; 7G8_H3.28_L1; 7G8_H3.28_L1.11; 7G8_H3.28_L1.13; 7G8_H3.30_L1.34; 7G8_H3.30_L1.34; and 7G8_H3L1, as well as those listed in SEQ ID NOs: 17135-20764, SEQ ID NOs: 36819-36962, SEQ ID NOs: 35417-35606, SEQ ID NOs: 25194-32793 and SEQ ID NOs: 32794-33002.

In mAb-scFv backbone 1 (optionally including M428L/ N434S) from FIG. 38, specific ABDs that bind human BTLA include, but are not limited to, 9C6_H0L0; 9C6_H1.1_L1; and 9C6_H1.11_L1, as well as those listed in SEQ ID NOs: 20885-21503 and SEQ ID NOs: 36707-36738.

In mAb-scFv backbone 1 (optionally including M428L/ N434S) from FIG. 38, specific ABDs that bind human TIM-3 include, but are not limited to, 1D10_H0L0; 1D12_H0L0; 3H3_H1_L2.1; 6C8_H0L0; 6D9_H0_1D12_L0; 7A9_H0L0; 7B11_H0L0; 7B11var_H0L0 and 7C2_H0L0, as well as those listed in SEQ ID NOs: 20765-20884, SEQ ID NOs: 37587-37698 and SEQ ID NOs: 36347-36706.

D. Central scFv

One heterodimeric scaffold that finds particular use in the present invention is the Central-scFv format shown in FIG. 1F. In this embodiment, the format relies on the use of an inserted scFv domain thus forming a third antigen binding domain, wherein the Fab portions of the two monomers bind one checkpoint target and the "extra" scFv domain binds another. The scFv domain is inserted between the Fc domain and the CH1-Fv region of one of the monomers, thus providing a third antigen binding domain.

In this embodiment, one monomer comprises a first heavy chain comprising a first variable heavy domain, a CH1 domain (and optional hinge) and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using optional domain linkers (vh1-CH1-[optional linker]-vh2-scFv linker-vl2-[optional linker including the hinge]-CH2-CH3, or the opposite orientation for the scFv, vh1-CH1-[optional linker]-vl2-scFv linker-vh2-[optional linker including the hinge]-CH2-CH3). The other monomer is a standard Fab side. This embodiment further utilizes a common light chain comprising a variable light domain and a constant light domain, which associates with the heavy chains to form two identical Fabs that bind a checkpoint inhibitor. As for many of the embodiments herein, these constructs include skew variants, pI variants, ablation variants, additional Fc variants, etc. as desired and described herein. In this embodiment, suitable Fv pairs include (Fabs listed first, scFvs second) PD-1 and CTLA-4, CTLA-4 and PD-1, PD-1 and TIM-3, TIM-3 and PD-1, PD-1 and LAG-3, LAG-3×PD1, PD-1 and TIGIT, TIGIT and PD-1, PD-1 and BTLA, BTLA and PD-1, CTLA-4 and TIM-3, TIM-3 and CTLA-4, CTLA-4 and LAG-3, LAG-3 and CTLA-4, CTLA-4 and TIGIT, TIGIT and CTLA-4, CTLA-4 and BTLA, BTLA and CTLA-4, TIM-3 and LAG-3, LAG-3 and TIM-3, TIM-3 and TIGIT, TIGIT and TIM-3, TIM-3 and BTLA, BTLA and TIM-3. LAG-3 and TIGIT, TIGIT and LAG-3, LAG-3 and BTLA, BTLA and LAG-3, BTLA and TIGIT, and TIGIT and BTLA.

The ABD sequences for these combinations can be as disclosed in the sequence listing or as shown in FIGS. 9 to 13, and in any combination as shown in FIG. 39 and FIG. 40.

In addition, the Fc domains of the central scFv format generally comprise skew variants (e.g. a set of amino acid substitutions as shown in FIG. 3 and FIG. 8, with particularly useful skew variants being selected from the group consisting of S364K/E357Q:L368D/K370S; L368D/K370S: S364K; L368E/K370S:S364K; T411T/E360E/Q362E: D401K; L368D/K370S:S364K/E357L, K370S:S364K/ E357Q, T366S/L368A/Y407V:T366W and T366S/L368A/ Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the central scFv format includes skew variants, pI variants, and ablation variants. Accordingly, some embodiments include bottle opener formats that comprise: a) a first monomer that comprises the skew variants S364K/E357Q, the ablation variants E233P/ L234V/L235A/G236del/S267K, and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. In this embodiment, suitable Fv pairs include (Fabs listed first, scFvs second) CTLA-4×PD-1, PD-1×CTLA-4, LAG-3×PD-1, BTLA×PD-1, and LAG-3× CTLA-4.

In some embodiments, the central scFv format includes skew variants, pI variants, ablation variants and FcRn variants. Accordingly, some embodiments include bottle opener formats that comprise: a) a first monomer that comprises the skew variants S364K/E357Q, the ablation variants E233P/ L234V/L235A/G236del/S267K, the FcRn variants M428L/ N434S and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/ Q295E/N384D/Q418E/N421D, the ablation variants E233P/ L234V/L235A/G236del/S267K, the FcRn variants M428L/ N434S and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. In this embodiment, suitable Fv pairs include (Fabs listed first, scFvs second) CTLA-4×PD-1, PD-1×CTLA-4, LAG-3×PD-1, BTLA×PD-1, and LAG-3×CTLA-4.

For central-scFv sequences that are similar to/utilize the bottle opener backbone 1 of FIG. 37 (optionally including M428L/N434S), specific Fv combinations of use in the present invention include CTLA-4 (Fab)×PD-1 (scFv), PD-1 (Fab)×CTLA-4 (scFv), LAG-3 (Fab)×PD-1 (scFv), BTLA (Fab)×PD-1 (scFv) and LAG-3 (Fab)×CTLA-4 (scFv).

For central-scFv sequences that are similar to/utilize the bottle opener backbone 1 of FIG. 37, (optionally including M428L/N434S), specific ABDs that bind human PD-1 include, but are not limited to, 1G6_H1.279_L1.194, 1G6_H1.280_L1.224; 1G6_L1.194_H1.279, 1G6_L1.210_H1.288 and 2E9_H1L1, as well as those listed in SEQ ID NOs: 6209-11464, SEQ ID NOs: 11465-17134, SEQ ID NOs: 33003-33072, SEQ ID NOs: 33073-35394 and SEQ ID NOs: 36127-36146.

For central-scFv sequences that are similar to/utilize the bottle opener backbone 1 of FIG. 37 (optionally including M428L/N434S), specific ABDs that bind human CTLA-4 include, but are not limited to, [CTLA-4]_H0.25_L0; [CTLA-4]_H0.26_L0; [CTLA-4]_H0.27_L0; [CTLA-4]_H0.29_L0; [CTLA-4]_H0.38_L0; [CTLA-4]_H0.39_L0; [CTLA-4]_H0.40_L0; [CTLA-4]_H0.70_L0; [CTLA-4]_H0_L0.22; [CTLA-4]_H2_L0; [CTLA-4]_H3.21_L0.124; [CTLA-4]_H3.21_L0.129; [CTLA-4]_H3.21_L0.132; [CTLA-4]_H3.23_L0.124; [CTLA-4]_H3.23_L0.129; [CTLA-4]_H3.23_L0.132; [CTLA-4]_H3.25_L0.124; [CTLA-4]_H3.25_L0.129; [CTLA-4]_H3.25_L0.132; [CTLA-4]_H3.4_L0.118; [CTLA-4]_H3.4_L0.119; [CTLA-4]_H3.4_L0.12; [CTLA-4]_H3.4_L0.121; [CTLA-4]_H3.4_L0.122; [CTLA-4]_H3.4_L0.123; [CTLA-4]_H3.4_L0.124; [CTLA-4]_H3.4_L0.125; [CTLA-4]_H3.4_L0.126; [CTLA-4]_H3.4_L0.127; [CTLA-4]_H3.4_L0.128; [CTLA-4]_H3.4_L0.129; [CTLA-4]_H3.4_L0.130; [CTLA-4]_H3.4_L0.131; [CTLA-4]_H3.4_L0.132; [CTLA-4]_H3.5_L2.1; [CTLA-4]_H3.5_L2.2; [CTLA-4]_H3.5_L2.3; [CTLA-4]_H3_L0; [CTLA-4]_H3_L0.22; [CTLA-4]_H3_L0.44; [CTLA-4]_H3_L0.67 and [CTLA-4]_H3_L0.74, as well as those listed in SEQ ID NOs: 21-2918, SEQ ID NOs: 2919-6208, SEQ ID NOs: 36739-36818 and SEQ ID NOs: 35395-35416.

For central-scFv sequences that are similar to/utilize the bottle opener backbone 1 of FIG. 37 (optionally including M428L/N434S), specific ABDs that bind human LAG-3 include, but are not limited to, 2A11_H0L0; 2A11_H1.125_L2.113; 2A11_H1.144_L2.142; 2A11_H1_L2.122; 2A11_H1_L2.123; 2A11_H1_L2.124; 2A11_H1_L2.25; 2A11_H1_L2.47; 2A11_H1_L2.50; 2A11_H1_L2.91; 2A11_H1_L2.93; 2A11_H1_L2.97; 2A11_H1L1; 2A11_H1L2; 2A11_H2L2; 2A11_H3L1; 2A11_H3L2; 2A11_H4L1; 2A11_H4L2; 7G8_H0L0; 7G8_H1L1; 7G8_H3.18_L1.11; 7G8_H3.23_L1.11; 7G8_H3.28_L1; 7G8_H3.28_L1.11; 7G8_H3.28_L1.13; 7G8_H3.30_L1.34; 7G8_H3.30_L1.34; and 7G8_H3L1, as well as those listed in SEQ ID NOs: 17135-20764, SEQ ID NOs: 36819-36962, SEQ ID NOs: 35417-35606, SEQ ID NOs: 25194-32793 and SEQ ID NOs: 32794-33002.

For central-scFv sequences that are similar to/utilize the bottle opener backbone 1 of FIG. 37 (optionally including M428L/N434S), specific ABDs that bind human BTLA include, but are not limited to, 9C6_H0L0; 9C6_H1.1_L1; and 9C6_H1.11_L1, as well as those listed in SEQ ID NOs: 20885-21503 and SEQ ID NOs: 36707-36738.

For central-scFv sequences that are similar to/utilize the bottle opener backbone 1 of FIG. 37 (optionally including M428L/N434S), specific ABDs that bind human TIM-3 include, but are not limited to, 1D10_H0L0; 1D12_H0L0; 3H3_H1_L2.1; 6C8_H0L0; 6D9_H0_1D12_L0; 7A9_H0L0; 7B11_H0L0; 7B11var_H0L0 and 7C2_H0L0, as well as those listed in SEQ ID NOs: 20765-20884, SEQ ID NOs: 37587-37698 and SEQ ID NOs: 36347-36706.

E. Central-Fv Format

One heterodimeric scaffold that finds particular use in the present invention is the Central-Fv format shown in FIG. 1G. In this embodiment, the format relies on the use of an inserted scFv domain thus forming a third antigen binding domain, wherein the Fab portions of the two monomers bind one checkpoint target and the "extra" scFv domain binds another. The scFv domain is inserted between the Fc domain and the CH1-Fv region of the monomers, thus providing a third antigen binding domain, wherein each monomer contains a component of the scFv (e.g. one monomer comprises a variable heavy domain and the other a variable light domain).

In this embodiment, one monomer comprises a first heavy chain comprising a first variable heavy domain, a CH1 domain, and Fc domain and an additional variable light domain. The light domain is covalently attached between the C-terminus of the CH1 domain of the heavy constant domain and the N-terminus of the first Fc domain using domain linkers (vh1-CH1-[optional linker]-vl2-hinge-CH2-CH3). The other monomer comprises a first heavy chain comprising a first variable heavy domain, a CH1 domain and Fc domain and an additional variable heavy domain (vh1-CH1-[optional linker]-vh2-hinge-CH2-CH3). The light domain is covalently attached between the C-terminus of the CH1 domain of the heavy constant domain and the N-terminus of the first Fc domain using domain linkers. This embodiment further utilizes a common light chain comprising a variable light domain and a constant light domain, that associates with the heavy chains to form two identical Fabs that bind a TTA. As for many of the embodiments herein, these constructs include skew variants, pI variants, ablation variants, additional Fc variants, etc. as desired and described herein. In this embodiment, suitable Fv pairs include (Fabs listed first, scFvs second) PD-1 and CTLA-4, CTLA-4 and PD-1, PD-1 and TIM-3, TIM-3 and PD-1, PD-1 and LAG-3, LAG-3×PD1, PD-1 and TIGIT, TIGIT and PD-1, PD-1 and BTLA, BTLA and PD-1, CTLA-4 and TIM-3, TIM-3 and CTLA-4, CTLA-4 and LAG-3, LAG-3 and CTLA-4, CTLA-4 and TIGIT, TIGIT and CTLA-4, CTLA-4 and BTLA, BTLA and CTLA-4, TIM-3 and LAG-3, LAG-3 and TIM-3, TIM-3 and TIGIT, TIGIT and TIM-3, TIM-3 and BTLA, BTLA and TIM-3. LAG-3 and TIGIT, TIGIT and LAG-3, LAG-3 and BTLA, BTLA and LAG-3, BTLA and TIGIT, and TIGIT and BTLA.

The ABD sequences for these combinations can be as disclosed in the sequence listing or as shown in FIGS. 9 to 13, and in any combination as shown in FIG. 39 and FIG. 40.

In central-scFv formats, specific Fv combinations of use in the present invention include CTLA-4 (Fab)×PD-1 (scFv), PD-1 (Fab)×CTLA-4 (scFv), LAG-3 (Fab)×PD-1 (scFv), BTLA (Fab)×PD-1 (scFv) and LAG-3 (Fab)×CTLA-4 (scFv).

In central-scFv formats, specific ABDs that bind human PD-1 include, but are not limited to, 1G6_H1.279_L1.194, 1G6_H1.280_L1.224; 1G6_L1.194_H1.279, 1G6_L1.210_H1.288 and 2E9_H1L1, as well as those listed in SEQ ID NOs: 6209-11464, SEQ ID NOs: 11465-17134, SEQ ID NOs: 33003-33072, SEQ ID NOs: 33073-35394 and SEQ ID NOs: 36127-36146.

In central-scFv formats, specific ABDs that bind human CTLA-4 include, but are not limited to, [CTLA-4]_H0.25_L0; [CTLA-4]_H0.26_L0; [CTLA-4]_H0.27_L0; [CTLA-4]_H0.29_L0; [CTLA-4]_H0.38_L0; [CTLA-4]_H0.39_L0; [CTLA-4]_H0.40_L0; [CTLA-4]_H0.70_L0; [CTLA-4]_H0_L0.22; [CTLA-4]_H2_L0;

[CTLA-4]_H3.21_L0.124; [CTLA-4]_H3.21_L0.129; [CTLA-4]_H3.21_L0.132; [CTLA-4]_H3.23_L0.124; [CTLA-4]_H3.23_L0.129; [CTLA-4]_H3.23_L0.132; [CTLA-4]_H3.25_L0.124; [CTLA-4]_H3.25_L0.129; [CTLA-4]_H3.25_L0.132; [CTLA-4]_H3.4_L0.118; [CTLA-4]_H3.4_L0.119; [CTLA-4]_H3.4_L0.12; [CTLA-4]_H3.4_L0.121; [CTLA-4]_H3.4_L0.122; [CTLA-4]_H3.4_L0.123; [CTLA-4]_H3.4_L0.124; [CTLA-4]_H3.4_L0.125; [CTLA-4]_H3.4_L0.126; [CTLA-4]_H3.4_L0.127; [CTLA-4]_H3.4_L0.128; [CTLA-4]_H3.4_L0.129; [CTLA-4]_H3.4_L0.130; [CTLA-4]_H3.4_L0.131; [CTLA-4]_H3.4_L0.132; [CTLA-4]_H3.5_L2.1; [CTLA-4]_H3.5_L2.2; [CTLA-4]_H3.5_L2.3; [CTLA-4]_H3_L0; [CTLA-4]_H3_L0.22; [CTLA-4]_H3_L0.44; [CTLA-4]_H3_L0.67 and [CTLA-4]_H3_L0.74, as well as those listed in SEQ ID NOs: 21-2918, SEQ ID NOs: 2919-6208, SEQ ID NOs: 36739-36818 and SEQ ID NOs: 35395-35416.

In central-scFv formats, specific ABDs that bind human LAG-3 include, but are not limited to, 2A11_H0L0; 2A11_H1.125_L2.113; 2A11_H1.144_L2.142; 2A11_H1_L2.122; 2A11_H1_L2.123; 2A11_H1_L2.124; 2A11_H1_L2.25; 2A11_H1_L2.47; 2A11_H1_L2.50; 2A11_H1_L2.91; 2A11_H1_L2.93; 2A11_H1_L2.97; 2A11_H1L1; 2A11_H1L2; 2A11_H2L2; 2A11_H3L1; 2A11_H3L2; 2A11_H4L1; 2A11_H4L2; 7G8_H0L0; 7G8_H1L1; 7G8_H3.18_L1.11; 7G8_H3.23_L1.11; 7G8_H3.28_L1; 7G8_H3.28_L1.11; 7G8_H3.28_L1.13; 7G8_H3.30_L1.34; 7G8_H3.30_L1.34; and 7G8_H3L1, as well as those listed in SEQ ID NOs: 17135-20764, SEQ ID NOs: 36819-36962, SEQ ID NOs: 35417-35606, SEQ ID NOs: 25194-32793 and SEQ ID NOs: 32794-33002.

In central-scFv formats, specific ABDs that bind human BTLA include, but are not limited to, 9C6_H0L0; 9C6_H1.1_L1; and 9C6_H1.11_L1, as well as those listed in SEQ ID NOs: 20885-21503 and SEQ ID NOs: 36707-36738.

In central-scFv formats, specific ABDs that bind human TIM-3 include, but are not limited to, 1D10_H0L0; 1D12_H0L0; 3H3_H1_L2.1; 6C8_H0L0; 6D9_H0_1D12_L0; 7A9_H0L0; 7B11_H0L0; 7B11var_H0L0 and 7C2_H0L0, as well as those listed in SEQ ID NOs: 20765-20884, SEQ ID NOs: 37587-37698 and SEQ ID NOs: 36347-36706.

F. One Armed Central-scFv

One heterodimeric scaffold that finds particular use in the present invention is the one armed central-scFv format shown in FIG. 1C. In this embodiment, one monomer comprises just an Fc domain, while the other monomer uses an inserted scFv domain thus forming the second antigen binding domain. In this format, either the Fab portion binds one checkpoint target and the scFv binds another. The scFv domain is inserted between the Fc domain and the CH1-Fv region of one of the monomers.

In this embodiment, one monomer comprises a first heavy chain comprising a first variable heavy domain, a CH1 domain and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using domain linkers. The second monomer comprises an Fc domain. This embodiment further utilizes a light chain comprising a variable light domain and a constant light domain, that associates with the heavy chain to form a Fab. As for many of the embodiments herein, these constructs include skew variants, pI variants, ablation variants, additional Fc variants, etc. as desired and described herein. In this embodiment, suitable Fv pairs include (Fabs listed first, scFvs second) PD-1 and CTLA-4, CTLA-4 and PD-1, PD-1 and TIM-3, TIM-3 and PD-1, PD-1 and LAG-3, LAG-3×PD1, PD-1 and TIGIT, TIGIT and PD-1, PD-1 and BTLA, BTLA and PD-1, CTLA-4 and TIM-3, TIM-3 and CTLA-4, CTLA-4 and LAG-3, LAG-3 and CTLA-4, CTLA-4 and TIGIT, TIGIT and CTLA-4, CTLA-4 and BTLA, BTLA and CTLA-4, TIM-3 and LAG-3, LAG-3 and TIM-3, TIM-3 and TIGIT, TIGIT and TIM-3, TIM-3 and BTLA, BTLA and TIM-3. LAG-3 and TIGIT, TIGIT and LAG-3, LAG-3 and BTLA, BTLA and LAG-3, BTLA and TIGIT, and TIGIT and BTLA.

The ABD sequences for these combinations can be as disclosed in the sequence listing or as shown in FIGS. 9 to 13, and in any combination as shown in FIG. 39 and FIG. 40.

In addition, the Fc domains of the one armed central-scFv format generally comprise skew variants (e.g. a set of amino acid substitutions as shown in FIG. 3 and FIG. 8, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the one armed central-scFv format includes skew variants, pI variants, and ablation variants. Accordingly, some embodiments include bottle opener formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. In this embodiment, suitable Fv pairs include (Fabs listed first, scFvs second) CTLA-4×PD-1, PD-1×CTLA-4, LAG-3×PD-1, BTLA×PD-1, and LAG-3×CTLA-4.

In some embodiments, the one armed central-scFv format includes skew variants, pI variants, ablation variants and FcRn variants. Accordingly, some embodiments include bottle opener formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. In this embodiment, suitable Fv pairs include (Fabs listed first, scFvs second) CTLA-4×PD-1, PD-1×CTLA-4, LAG-3×PD-1, BTLA×PD-1, and LAG-3×CTLA-4.

In one armed central-scFv formats, specific ABDs that bind human PD-1 include, but are not limited to, 1G6_H1.279_L1.194, 1G6_H1.280_L1.224; 1G6_L1.194_H1.279, 1G6_L1.210_H1.288 and 2E9_H1L1, as well as those listed in SEQ ID NOs: 6209-11464, SEQ ID NOs: 11465-17134, SEQ ID NOs: 33003-33072, SEQ ID NOs: 33073-35394 and SEQ ID NOs: 36127-36146.

In one armed central-scFv formats, specific ABDs that bind human CTLA-4 include, but are not limited to, [CTLA-4]_H0.25_L0; [CTLA-4]_H0.26_L0; [CTLA-4]_H0.27_L0; [CTLA-4]_H0.29_L0; [CTLA-4]_H0.38_L0; [CTLA-4]_H0.39_L0; [CTLA-4]_H0.40_L0; [CTLA-4]_H0.70_L0; [CTLA-4]_H0_L0.22; [CTLA-4]_H2_L0; [CTLA-4]_H3.21_L0.124; [CTLA-4]_H3.21_L0.129; [CTLA-4]_H3.21_L0.132; [CTLA-4]_H3.23_L0.124; [CTLA-4]_H3.23_L0.129; [CTLA-4]_H3.23_L0.132; [CTLA-4]_H3.25_L0.124; [CTLA-4]_H3.25_L0.129; [CTLA-4]_H3.25_L0.132; [CTLA-4]_H3.4_L0.118; [CTLA-4]_H3.4_L0.119; [CTLA-4]_H3.4_L0.12; [CTLA-4]_H3.4_L0.121; [CTLA-4]_H3.4_L0.122; [CTLA-4]_H3.4_L0.123; [CTLA-4]_H3.4_L0.124; [CTLA-4]_H3.4_L0.125; [CTLA-4]_H3.4_L0.126; [CTLA-4]_H3.4_L0.127; [CTLA-4]_H3.4_L0.128; [CTLA-4]_H3.4_L0.129; [CTLA-4]_H3.4_L0.130; [CTLA-4]_H3.4_L0.131; [CTLA-4]_H3.4_L0.132; [CTLA-4]_H3.5_L2.1; [CTLA-4]_H3.5_L2.2; [CTLA-4]_H3.5_L2.3; [CTLA-4]_H3_L0; [CTLA-4]_H3_L0.22; [CTLA-4]_H3_L0.44; [CTLA-4]_H3_L0.67 and [CTLA-4]_H3_L0.74, as well as those listed in SEQ ID NOs: 21-2918, SEQ ID NOs: 2919-6208, SEQ ID NOs: 36739-36818 and SEQ ID NOs: 35395-35416.

In one armed central-scFv formats, specific ABDs that bind human LAG-3 include, but are not limited to, 2A11_H0L0; 2A11_H1.125_L2.113; 2A11_H1.144_L2.142; 2A11_H1_L2.122; 2A11_H1_L2.123; 2A11_H1_L2.124; 2A11_H1_L2.25; 2A11_H1_L2.47; 2A11_H1_L2.50; 2A11_H1_L2.91; 2A11_H1_L2.93; 2A11_H1_L2.97; 2A11_H1L1; 2A11_H1L2; 2A11_H2L2; 2A11_H3L1; 2A11_H3L2; 2A11_H4L1; 2A11_H4L2; 7G8_H0L0; 7G8_H1L1; 7G8_H3.18_L1.11; 7G8_H3.23_L1.11; 7G8_H3.28_L1; 7G8_H3.28_L1.11; 7G8_H3.28_L1.13; 7G8_H3.30_L1.34; 7G8_H3.30_L1.34; and 7G8_H3L1, as well as those listed in SEQ ID NOs: 17135-20764, SEQ ID NOs: 36819-36962, SEQ ID NOs: 35417-35606, SEQ ID NOs: 25194-32793 and SEQ ID NOs: 32794-33002.

In one armed central-scFv formats, specific ABDs that bind human BTLA include, but are not limited to, 9C6_H0L0; 9C6_H1.1_L1; and 9C6_H1.11_L1, as well as those listed in SEQ ID NOs: 20885-21503 and SEQ ID NOs: 36707-36738.

In one armed central-scFv formats, specific ABDs that bind human TIM-3 include, but are not limited to, 1D10_H0L0; 1D12_H0L0; 3H3_H1_L2.1; 6C8_H0L0; 6D9_H0_1D12_L0; 7A9_H0L0; 7B11_H0L0; 7B11var_H0L0 and 7C2_H0L0, as well as those listed in SEQ ID NOs: 20765-20884, SEQ ID NOs: 37587-37698 and SEQ ID NOs: 36347-36706.

G. One Armed scFv-mAb

One heterodimeric scaffold that finds particular use in the present invention is the one armed scFv-mAb format shown in FIG. 1D. In this embodiment, one monomer comprises just an Fc domain, while the other monomer uses a scFv domain attached at the N-terminus of the heavy chain, generally through the use of a linker: vh-scFv linker-vl-[optional domain linker]-CH1-hinge-CH2-CH3 or (in the opposite orientation) vl-scFv linker-vh-[optional domain linker]-CH1-hinge-CH2-CH3. In this format, either the Fab portion binds one checkpoint target and the scFv binds another. This embodiment further utilizes a light chain comprising a variable light domain and a constant light domain, that associates with the heavy chain to form a Fab. As for many of the embodiments herein, these constructs include skew variants, pI variants, ablation variants, additional Fc variants, etc. as desired and described herein. In this embodiment, suitable Fv pairs include (Fabs listed first, scFvs second) PD-1 and CTLA-4, CTLA-4 and PD-1, PD-1 and TIM-3, TIM-3 and PD-1, PD-1 and LAG-3, LAG-3× PD1, PD-1 and TIGIT, TIGIT and PD-1, PD-1 and BTLA, BTLA and PD-1, CTLA-4 and TIM-3, TIM-3 and CTLA-4, CTLA-4 and LAG-3, LAG-3 and CTLA-4, CTLA-4 and TIGIT, TIGIT and CTLA-4, CTLA-4 and BTLA, BTLA and CTLA-4, TIM-3 and LAG-3, LAG-3 and TIM-3, TIM-3 and TIGIT, TIGIT and TIM-3, TIM-3 and BTLA, BTLA and TIM-3. LAG-3 and TIGIT, TIGIT and LAG-3, LAG-3 and BTLA, BTLA and LAG-3, BTLA and TIGIT, and TIGIT and BTLA.

The ABD sequences for these combinations can be as disclosed in the sequence listing or as shown in FIGS. 9 to 13, and in any combination as shown in FIG. 39 and FIG. 40.

In addition, the Fc domains of the comprise skew variants (e.g. a set of amino acid substitutions as shown in FIG. 3 and FIG. 8, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the one armed scFv-mAb format includes skew variants, pI variants, and ablation variants. Accordingly, some embodiments include bottle opener formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. In this embodiment, suitable Fv pairs include (Fabs listed first, scFvs second) CTLA-4×PD-1, PD-1×CTLA-4, LAG-3×PD-1, BTLA×PD-1, and LAG-3×CTLA-4.

In some embodiments, the one armed scFv-mAb format includes skew variants, pI variants, ablation variants and FcRn variants. Accordingly, some embodiments include bottle opener formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. In this embodiment, suitable Fv pairs include (Fabs listed first, scFvs second) CTLA-4×PD-1, PD-1×CTLA-4, LAG-3×PD-1, BTLA×PD-1, and LAG-3×CTLA-4.

In one armed scFv-mAb formats, specific ABDs that bind human PD-1 include, but are not limited to, 1G6_H1.279_L1.194, 1G6_H1.280_L1.224; 1G6_L1.194_H1.279, 1G6_L1.210_H1.288 and 2E9_H1L1, as well as those listed in SEQ ID NOs: 6209-11464, SEQ ID NOs: 11465-17134, SEQ ID NOs: 33003-33072, SEQ ID NOs: 33073-35394 and SEQ ID NOs: 36127-36146.

In one armed scFv-mAb formats, specific ABDs that bind human CTLA-4 include, but are not limited to, [CTLA-4]_H0.25_L0; [CTLA-4]_H0.26_L0; [CTLA-4]_H0.27_L0; [CTLA-4]_H0.29_L0; [CTLA-4]_H0.38_L0; [CTLA-4]_H0.39_L0; [CTLA-4]_H0.40_L0; [CTLA-4]_H0.70_L0; [CTLA-4]_H0_L0.22; [CTLA-4]_H2_L0; [CTLA-4]_H3.21_L0.124; [CTLA-4]_H3.21_L0.129; [CTLA-4]_H3.21_L0.132; [CTLA-4]_H3.23_L0.124; [CTLA-4]_H3.23_L0.129; [CTLA-4]_H3.23_L0.132; [CTLA-4]_H3.25_L0.124; [CTLA-4]_H3.25_L0.129; [CTLA-4]_H3.25_L0.132; [CTLA-4]_H3.4_L0.118; [CTLA-4]_H3.4_L0.119; [CTLA-4]_H3.4_L0.12; [CTLA-4]_H3.4_L0.121; [CTLA-4]_H3.4_L0.122; [CTLA-4]_H3.4_L0.123; [CTLA-4]_H3.4_L0.124; [CTLA-4]_H3.4_L0.125; [CTLA-4]_H3.4_L0.126; [CTLA-4]_H3.4_L0.127; [CTLA-4]_H3.4_L0.128; [CTLA-4]_H3.4_L0.129; [CTLA-4]_H3.4_L0.130; [CTLA-4]_H3.4_L0.131; [CTLA-4]_H3.4_L0.132; [CTLA-4]_H3.5_L2.1; [CTLA-4]_H3.5_L2.2; [CTLA-4]_H3.5_L2.3; [CTLA-4]_H3_L0; [CTLA-4]_H3_L0.22; [CTLA-4]_H3_L0.44; [CTLA-4]_H3_L0.67 and [CTLA-4]_H3_L0.74, as well as those listed in SEQ ID NOs: 21-2918, SEQ ID NOs: 2919-6208, SEQ ID NOs: 36739-36818 and SEQ ID NOs: 35395-35416.

In one armed scFv-mAb formats, specific ABDs that bind human LAG-3 include, but are not limited to, 2A11_H0L0; 2A11_H1.125_L2.113; 2A11_H1.144_L2.142; 2A11_H1_L2.122; 2A11_H1_L2.123; 2A11_H1_L2.124; 2A11_H1_L2.25; 2A11_H1_L2.47; 2A11_H1_L2.50; 2A11_H1_L2.91; 2A11_H1_L2.93; 2A11_H1_L2.97; 2A11_H1L1; 2A11_H1L2; 2A11_H2L2; 2A11_H3L1; 2A11_H3L2; 2A11_H4L1; 2A11_H4L2; 7G8_H0L0; 7G8_H1L1; 7G8_H3.18_L1.11; 7G8_H3.23_L1.11; 7G8_H3.28_L1; 7G8_H3.28_L1.11; 7G8_H3.28_L1.13; 7G8_H3.30_L1.34; 7G8_H3.30_L1.34; and 7G8_H3L1, as well as those listed in SEQ ID NOs: 17135-20764, SEQ ID NOs: 36819-36962, SEQ ID NOs: 35417-35606, SEQ ID NOs: 25194-32793 and SEQ ID NOs: 32794-33002.

In one armed scFv-mAb formats, specific ABDs that bind human BTLA include, but are not limited to, 9C6_H0L0; 9C6_H1.1_L1; and 9C6_H1.11_L1, as well as those listed in SEQ ID NOs: 20885-21503 and SEQ ID NOs: 36707-36738.

In one armed scFv-mAb formats, specific ABDs that bind human TIM-3 include, but are not limited to, 1D10_H0L0; 1D12_H0L0; 3H3_H1_L2.1; 6C8_H0L0; 6D9_H0_1D12_L0; 7A9_H0L0; 7B11_H0L0; 7B11var_H0L0 and 7C2_H0L0, as well as those listed in SEQ ID NOs: 20765-20884, SEQ ID NOs: 37587-37698 and SEQ ID NOs: 36347-36706.

H. scFv-mAb Format

One heterodimeric scaffold that finds particular use in the present invention is the mAb-scFv format shown in FIG. 1E. In this embodiment, the format relies on the use of a N-terminal attachment of a scFv to one of the monomers, thus forming a third antigen binding domain, wherein the Fab portions of the two monomers bind one checkpoint target and the "extra" scFv domain binds a different checkpoint target.

In this embodiment, the first monomer comprises a first heavy chain (comprising a variable heavy domain and a constant domain), with a N-terminally covalently attached scFv comprising a scFv variable light domain, an scFv linker and a scFv variable heavy domain in either orientation ((vh1-scFv linker-vl1-[optional domain linker]-vh2-CH1-hinge-CH2-CH3) or (with the scFv in the opposite orientation) ((vl1-scFv linker-vh1-[optional domain linker]-vh2-CH1-hinge-CH2-CH3)). This embodiment further utilizes a common light chain comprising a variable light domain and a constant light domain, that associates with the heavy chains to form two identical Fabs that bind one of the target antigens. As for many of the embodiments herein, these constructs include skew variants, pI variants, ablation variants, additional Fc variants, etc. as desired and described herein. In this embodiment, suitable Fv pairs include (Fabs listed first, scFvs second) PD-1 and CTLA-4, CTLA-4 and PD-1, PD-1 and TIM-3, TIM-3 and PD-1, PD-1 and LAG-3, LAG-3×PD1, PD-1 and TIGIT, TIGIT and PD-1, PD-1 and BTLA, BTLA and PD-1, CTLA-4 and TIM-3, TIM-3 and CTLA-4, CTLA-4 and LAG-3, LAG-3 and CTLA-4, CTLA-4 and TIGIT, TIGIT and CTLA-4, CTLA-4 and BTLA, BTLA and CTLA-4, TIM-3 and LAG-3, LAG-3 and TIM-3, TIM-3 and TIGIT, TIGIT and TIM-3, TIM-3 and BTLA, BTLA and TIM-3. LAG-3 and TIGIT, TIGIT and LAG-3, LAG-3 and BTLA, BTLA and LAG-3, BTLA and TIGIT, and TIGIT and BTLA.

The ABD sequences for these combinations can be as disclosed in the sequence listing or as shown in FIGS. 9 to 13, and in any combination as shown in FIG. 39 and FIG. 40.

In addition, the Fc domains of the scFv-mAb format comprise skew variants (e.g. a set of amino acid substitutions as shown in FIG. 3 and FIG. 8, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the mAb-scFv format includes skew variants, pI variants, and ablation variants. Accordingly, some embodiments include bottle opener formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. Of particular use in some embodiments in this format, are (Fab-scFv order) CTLA-4×PD-1, LAG-3×PD-1, BTLA×PD-1, and LAG-3×CTLA-4.

In some embodiments, the mAb-scFv format includes skew variants, pI variants, ablation variants and FcRn variants. Accordingly, some embodiments include bottle opener formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. Of particular use in some embodiments in this format, are (Fab-scFv order) CTLA-4×PD-1, LAG-3×PD-1, BTLA×PD-1, and LAG-3×CTLA-4.

For the mAb-scFv format backbone 1 (optionally including M428L/N434S) from FIG. 38, specific ABDs that bind human PD-1 include, but are not limited to, 1G6_H1.279_L1.194; 1G6_H1.280_L1.224; 1G6_L1.194_H1.279, 1G6_L1.210_H1.288 and 2E9_H1L1, as well as those listed in SEQ ID NOs: 6209-11464, SEQ ID NOs: 11465-17134, SEQ ID NOs: 33003-33072, SEQ ID NOs: 33073-35394 and SEQ ID NOs: 36127-36146.

For the mAb-scFv format backbone 1 (optionally including M428L/N434S) from FIG. 38, specific ABDs that bind human CTLA-4 include, but are not limited to, [CTLA-4]_H0.25_L0; [CTLA-4]_H0.26_L0; [CTLA-4]_H0.27_L0; [CTLA-4]_H0.29_L0; [CTLA-4]_H0.38_L0; [CTLA-4]_H0.39_L0; [CTLA-4]_H0.40_L0; [CTLA-4]_H0.70_L0; [CTLA-4]_H0_L0.22; [CTLA-4]_H2_L0; [CTLA-4]_H3.21_L0.124; [CTLA-4]_H3.21_L0.129; [CTLA-4]_H3.21_L0.132; [CTLA-4]_H3.23_L0.124; [CTLA-4]_H3.23_L0.129; [CTLA-4]_H3.23_L0.132; [CTLA-4]_H3.25_L0.124; [CTLA-4]_H3.25_L0.129; [CTLA-4]_H3.25_L0.132; [CTLA-4]_H3.4_L0.118; [CTLA-4]_H3.4_L0.119; [CTLA-4]_H3.4_L0.12; [CTLA-4]_H3.4_L0.121; [CTLA-4]_H3.4_L0.122; [CTLA-4]_H3.4_L0.123; [CTLA-4]_H3.4_L0.124; [CTLA-4]_H3.4_L0.125; [CTLA-4]_H3.4_L0.126; [CTLA-4]_H3.4_L0.127; [CTLA-4]_H3.4_L0.128; [CTLA-4]_H3.4_L0.129; [CTLA-4]_H3.4_L0.130; [CTLA-4]_H3.4_L0.131; [CTLA-4]_H3.4_L0.132; [CTLA-4]_H3.5_L2.1; [CTLA-4]_H3.5_L2.2; [CTLA-4]_H3.5_L2.3; [CTLA-4]_H3_L0; [CTLA-4]_H3_L0.22; [CTLA-4]_H3_L0.44; [CTLA-4]_H3_L0.67 and [CTLA-4]_H3_L0.74, as well as those listed in SEQ ID NOs: 21-2918, SEQ ID NOs: 2919-6208, SEQ ID NOs: 36739-36818 and SEQ ID NOs: 35395-35416.

For the mAb-scFv format backbone 1 (optionally including M428L/N434S) from FIG. 38, specific ABDs that bind human LAG-3 include, but are not limited to, 2A11_H0L0; 2A11_H1.125_L2.113; 2A11_H1.144_L2.142; 2A11_H1_L2.122; 2A11_H1_L2.123; 2A11_H1_L2.124; 2A11_H1_L2.25; 2A11_H1_L2.47; 2A11_H1_L2.50; 2A11_H1_L2.91; 2A11_H1_L2.93; 2A11_H1_L2.97; 2A11_H1L1; 2A11_H1L2; 2A11_H2L2; 2A11_H3L1; 2A11_H3L2; 2A11_H4L1; 2A11_H4L2; 7G8_H0L0; 7G8_H1L1; 7G8_H3.18_L1.11; 7G8_H3.23_L1.11; 7G8_H3.28_L1; 7G8_H3.28_L1.11; 7G8_H3.28_L1.13; 7G8_H3.30_L1.34; 7G8_H3.30_L1.34; and 7G8_H3L1, as well as those listed in SEQ ID NOs: 17135-20764, SEQ ID NOs: 36819-36962, SEQ ID NOs: 35417-35606, SEQ ID NOs: 25194-32793 and SEQ ID NOs: 32794-33002.

For the mAb-scFv format backbone 1 (optionally including M428L/N434S) from FIG. 38, specific ABDs that bind human BTLA include, but are not limited to, 9C6_H0L0; 9C6_H1.1_L1; and 9C6_H1.11_L1, as well as those listed in SEQ ID NOs: 20885-21503 and SEQ ID NOs: 36707-36738.

For the mAb-scFv format backbone 1 (optionally including M428L/N434S) from FIG. 38, specific ABDs that bind human TIM-3 include, but are not limited to, 1D10_H0L0; 1D12_H0L0; 3H3_H1_L2.1; 6C8_H0L0; 6D9_H0_1D12_L0; 7A9_H0L0; 7B11_H0L0; 7B11var_H0L0 and 7C2_H0L0, as well as those listed in SEQ ID NOs: 20765-20884, SEQ ID NOs: 37587-37698 and SEQ ID NOs: 36347-36706.

I. Dual scFv Formats

The present invention also provides dual scFv formats as are known in the art and shown in FIG. 1B. In this embodiment, the heterodimeric bispecific antibody is made up of two scFv-Fc monomers (both in either (vh-scFv linker-vl-[optional domain linker]-CH2-CH3) format or (vl-scFv linker-vh-[optional domain linker]-CH2-CH3) format, or with one monomer in one orientation and the other in the other orientation.

In this case, all ABDs are in the scFv format, with any combination of PD-1 and CTLA-4, PD-1 and TIM-3, PD-1 and LAG-3, PD-1 and TIGIT, PD-1 and BTLA, CTLA-4 and TIM-3, CTLA-4 and LAG-3, CTLA-4 and TIGIT, CTLA-4 and BTLA, TIM-3 and LAG-3, TIM-3 and TIGIT, TIM-3 and BTLA, LAG-3 and TIGIT, LAG-3 and BTLA and TIGIT and BTLA being useful. The ABD sequences for these combinations can be as disclosed in the sequence listing or as shown in FIGS. 9 to 13, and in any combination as shown in FIG. 39 and FIG. 40.

In addition, the Fc domains of the dual scFv format comprise skew variants (e.g. a set of amino acid substitutions as shown in FIG. 3 and FIG. 8, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the dual scFv format includes skew variants, pI variants, and ablation variants. Accordingly, some embodiments include bottle opener formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. Of particular use in some embodiments in this format, are (Fab-scFv order) CTLA-4×PD-1, LAG-3×PD-1, BTLA×PD-1, and LAG-3×CTLA-4.

In some embodiments, the dual scFv format includes skew variants, pI variants, ablation variants and FcRn variants. Accordingly, some embodiments include bottle opener formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to a first checkpoint inhibitor, and a second variable heavy domain; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to the first checkpoint inhibitor as outlined herein, and a second variable light chain, that together with the second variable heavy chain forms an Fv (ABD) that binds a second checkpoint inhibitors; and c) a light chain comprising a first variable light domain and a constant light domain. Of particular use in some embodiments in this format, are (Fab-scFv order) CTLA-4×PD-1, LAG-3×PD-1, BTLA×PD-1, and LAG-3×CTLA-4.

J. Non-Heterodimeric Bispecific Antibodies

As will be appreciated by those in the art, the Fv sequences outlined herein can also be used in both monospecific antibodies (e.g. "traditional monoclonal antibodies") or non-heterodimeric bispecific formats.

Suitable non-heterodimeric bispecific formats are known in the art, and include a number of different formats as generally depicted in Spiess et al., Molecular Immunology (67):95-106 (2015) and Kontermann, mAbs 4:2, 182-197 (2012), both of which are expressly incorporated by reference and in particular for the figures, legends and citations to the formats therein.

K. Monospecific, Monoclonal Antibodies

As will be appreciated by those in the art, the novel Fv sequences outlined herein can also be used in both monospecific antibodies (e.g. "traditional monoclonal antibodies") or non-heterodimeric bispecific formats. Accordingly, the present invention provides monoclonal (monospecific) antibodies comprising the 6 CDRs and/or the vh and vl sequences from the figures, generally with IgG1, IgG2, IgG3 or IgG4 constant regions, with IgG1, IgG2 and IgG4 (including IgG4 constant regions comprising a S228P amino acid substitution) finding particular use in some embodiments. That is, any sequence herein with a "H_L" designation can be linked to the constant region of a human IgG1 antibody.

VI. ANTIGEN BINDING DOMAINS TO TARGET ANTIGENS

The bispecific antibodies of the invention have two different antigen binding domains (ABDs) that bind to two different target checkpoint antigens ("target pairs"), in either bivalent, bispecific formats or trivalent, bispecific formats as generally shown in FIG. 1. Suitable target checkpoint antigens include human (and sometimes cyno) PD-1, CTLA-4, TIM-3, LAG-3, TIGIT and BTLA, the sequences of which are shown in FIG. 2. Accordingly, suitable bispecific antibodies bind PD-1 and CTLA-4, PD-1 and TIM-3, PD-1 and LAG-3, PD-1 and TIGIT, PD-1 and BTLA, CTLA-4 and TIM-3, CTLA-4 and LAG-3, CTLA-4 and TIGIT, CTLA-4 and BTLA, TIM-3 and LAG-3, TIM-3 and TIGIT, TIM-3 and BTLA, LAG-3 and TIGIT, LAG-3 and BTLA and TIGIT and BTLA. Note that generally these bispecific antibodies are named "anti-PD-1×anti-CTLA-4", or generally simplistically or for ease (and thus interchangeably) as "PD-1×CTLA-4", etc. for each pair. Note that unless specified herein, the order of the antigen list in the name does not confer structure; that is a PD-1×CTLA-4 bottle opener antibody can have the scFv bind to PD-1 or CTLA-4, although in some cases, the order specifies structure as indicated.

As is more fully outlined herein, these combinations of ABDs can be in a variety of formats, as outlined below, generally in combinations where one ABD is in a Fab format and the other is in an scFv format. As discussed herein and shown in FIG. 1, some formats use a single Fab and a single scFv (FIGS. 1A, C and D), and some formats use two Fabs and a single scFv (FIGS. 1E, F, G, H and I).

A. Antigen Binding Domains

As discussed herein, the bispecific checkpoint heterodimeric antibodies of the invention include two antigen binding domains (ABDs), each of which bind to a different checkpoint protein. As outlined herein, these heterodimeric antibodies can be bispecific and bivalent (each antigen is bound by a single ABD, for example, in the format depicted in FIG. 1A), or bispecific and trivalent (one antigen is bound by a single ABD and the other is bound by two ABDs, for example as depicted in FIG. 1F).

In addition, in general, one of the ABDs comprises a scFv as outlined herein, in an orientation from N- to C-terminus of vh-scFv linker-vl or vl-scFv linker-vh. One or both of the other ABDs, according to the format, generally is a Fab, comprising a vh domain on one protein chain (generally as a component of a heavy chain) and a vl on another protein chain (generally as a component of a light chain).

The invention provides a number of ABDs that bind to a number of different checkpoint proteins, as outlined below. As will be appreciated by those in the art, any set of 6 CDRs or vh and vl domains can be in the scFv format or in the Fab format, which is then added to the heavy and light constant domains, where the heavy constant domains comprise variants (including within the CH1 domain as well as the Fc domain). The scFv sequences contained in the sequence listing utilize a particular charged linker, but as outlined herein, uncharged or other charged linkers can be used, including those depicted in FIG. 7.

In addition, as discussed above, the numbering used in the Sequence Listing for the identification of the CDRs is Kabat, however, different numbering can be used, which will change the amino acid sequences of the CDRs as shown in Table 1.

For all of the variable heavy and light domains listed herein, further variants can be made. As outlined herein, in some embodiments the set of 6 CDRs can have from 0, 1, 2, 3, 4 or 5 amino acid modifications (with amino acid substitutions finding particular use), as well as changes in the framework regions of the variable heavy and light domains, as long as the frameworks (excluding the CDRs) retain at least about 80, 85 or 90% identity to a human germline sequence selected from those listed in FIG. 1 of U.S. Pat. No. 7,657,380, which Figure and Legend is incorporated by reference in its entirety herein. Thus, for example, the identical CDRs as described herein can be combined with different framework sequences from human germline sequences, as long as the framework regions retain at least 80, 85 or 90% identity to a human germline sequence selected from those listed in FIG. 1 of U.S. Pat. No. 7,657,380. Alternatively, the CDRs can have amino acid modifications (e.g. from 1, 2, 3, 4 or 5 amino acid modifications in the set of CDRs (that is, the CDRs can be modified as long as the total number of changes in the set of 6 CDRs is less than 6 amino acid modifications, with any combination of CDRs being changed; e.g. there may be one change in vlCDR1, two in vhCDR2, none in vhCDR3, etc.)), as well as having framework region changes, as long as the framework regions retain at least 80, 85 or 90% identity to a human germline sequence selected from those listed in FIG. 1 of U.S. Pat. No. 7,657,380.

B. PD-1 Antigen Binding Domains

In some embodiments, one of the ABDs binds PD-1. Suitable sets of 6 CDRs and/or vh and vl domains, as well as scFv sequences, are depicted in SEQ ID NOs: 6209-11464, SEQ ID NOs: 11465-17134, SEQ ID NOs: 33003-33072, SEQ ID NOs: 33073-35394 and SEQ ID NOs: 36127-36146. ABD sequences of particular interest in some embodiments are shown in FIG. 9 and include those sequences in the sequence listing with the identifiers 1G6_H1.279_L1.194; 1G6_H1.280_L1.224; 1G6_L1.194_H1.279; 1G6_L1.210_H1.288; and 2E9_H1L1.

As will be appreciated by those in the art, suitable anti-PD-1 ABDs can comprise a set of 6 CDRs as depicted in these sequences and Figures, either as they are underlined or, in the case where a different numbering scheme is used as described herein and as shown in Table 1, as the CDRs that are identified using other alignments within the vh and vl sequences of SEQ ID NOs: 6209-11464, SEQ ID NOs: 11465-17134, SEQ ID NOs: 33003-33072, SEQ ID NOs: 33073-35394 and SEQ ID NOs: 36127-36146. Suitable ABDs can also include the entire vh and vl sequences as depicted in these sequences and Figures, used as scFvs or as Fabs. In many of the embodiments herein that contain an Fv to PD-1, it is the scFv monomer that binds PD-1. As discussed herein, the other of the target pair when PD-1 is one of the antigens is selected from CTLA-4 (suitable sequences are depicted in SEQ ID NOs: 21-2918, SEQ ID NOs: 2919-6208, SEQ ID NOs: 36739-36818 and SEQ ID NOs: 35395-35416 (which can be scFv sequences, CDR sequence sets or vh and vl sequences)), TIM-3 (suitable sequences are depicted in SEQ ID NOs: 20765-20884, SEQ ID NOs: 37587-37698 and SEQ ID NOs: 36347-36706 (which can be scFv sequences, CDR sequence sets or vh and vl sequences)), LAG-3 (suitable sequences are depicted in SEQ ID NOs: 17135-20764, SEQ ID NOs: 36819-36962, SEQ ID NOs: 35417-35606, SEQ ID NOs: 25194-32793 and SEQ ID NOs: 32794-33002 (which can be scFv sequences, CDR sequence sets or vh and vl sequences)), BTLA (suitable sequences are depicted in SEQ ID NOs: 20885-21503 and SEQ ID NOs: 36707-36738 (which can be scFv sequences, CDR sequence sets or vh and vl sequences)), and TIGIT (suitable sequences are depicted in SEQ ID NOs: 21504-21523 and SEQ ID NOs: 37435-37586 (which can be scFv sequences, CDR sequence sets or vh and vl sequences)).

Particularly useful ABDs that bind human PD-1 include, but are not limited to, 1G6_H1.279_L1.194, 1G6_H1.280_L1.224; 1G6_L1.194_H1.279, 1G6_L1.210_H1.288 and 2E9_H1L1.

In addition to the parental CDR sets disclosed in the sequence listing that form an ABD to PD-1, the invention provides variant CDR sets. In one embodiment, a set of 6 CDRs can have 1, 2, 3, 4 or 5 amino acid changes from the parental CDRs, as long as the ABD is still able to bind to the target antigen, as measured by at least one of a BIACORE®, surface plasmon resonance (SPR) and/or BLI (biolayer interferometry, e.g. OCTET® assay) assay, with the latter finding particular use in many embodiments.

In addition to the parental variable heavy and variable light domains disclosed herein that form an ABD to PD-1, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured at least one of a BIACORE®, surface plasmon resonance (SPR) and/or BLI (biolayer interferometry, e.g. OCTET® assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a BIACORE®, surface plasmon resonance (SPR) and/or BLI (biolayer interferometry, e.g. OCTET® assay) assay, with the latter finding particular use in many embodiments.

Specific preferred embodiments include the 1G6_L1.194_H1.279 anti-PD-1 Fv, in a scFv format, included within any of the bottle opener format backbones of FIG. 37.

Specific preferred embodiments include the 1G6_L1.194_H1.279 anti-PD-1 Fv, in a scFv format, included within any of the mAb-scFv format backbones of FIG. 38.

C. CTLA-4 Antigen Binding Domains

In some embodiments, one of the ABDs binds CTLA-4. Suitable sets of 6 CDRs and/or vh and vl domains, as well as scFv sequences, are depicted in SEQ ID NOs: 21-2918, SEQ ID NOs: 2919-6208, SEQ ID NOs: 36739-36818 and SEQ ID NOs: 35395-35416. ABD sequences of particular interest in some embodiments are shown in FIG. 10 and also include those sequences in the sequence listing with the identifiers [CTLA-4]_H0.25_L0; [CTLA-4]_H0.26_L0; [CTLA-4]_H0.27_L0; [CTLA-4]_H0.29_L0; [CTLA-4]_H0.38_L0; [CTLA-4]_H0.39_L0; 0[CTLA-4]_H0.40_L0; [CTLA-4]_H0.70_L0; [CTLA-4]_H0_L0.22; [CTLA-4]_H2_L0; [CTLA-4]_H3.21_L0.124; [CTLA-4]_H3.21_L0.129; [CTLA-4]_H3.21_L0.132; [CTLA-4]_H3.23_L0.124; [CTLA-4]_H3.23_L0.129; [CTLA-4]_H3.23_L0.132; [CTLA-4]_H3.25_L0.124; [CTLA-4]_H3.25_L0.129; [CTLA-4]_H3.25_L0.132; [CTLA-4]_H3.4_L0.118;

[CTLA-4]_H3.4_L0.119; [CTLA-4]_H3.4_L0.12; [CTLA-4]_H3.4_L0.121; [CTLA-4]_H3.4_L0.122; [CTLA-4]_H3.4_L0.123; [CTLA-4]_H3.4_L0.124; [CTLA-4]_H3.4_L0.125; [CTLA-4]_H3.4_L0.126; [CTLA-4]_H3.4_L0.127; [CTLA-4]_H3.4_L0.128; [CTLA-4]_H3.4_L0.129; [CTLA-4]_H3.4_L0.130; [CTLA-4]_H3.4_L0.131; [CTLA-4]_H3.4_L0.132; [CTLA-4]_H3.5_L2.1; [CTLA-4]_H3.5_L2.2; [CTLA-4]_H3.5_L2.3; [CTLA-4]_H3_L0; [CTLA-4]_H3_L0.22; [CTLA-4]_H3_L0.44; [CTLA-4]_H3_L0.67; and [CTLA-4]_H3_L0.74.

As will be appreciated by those in the art, suitable anti-CTLA-4 ABDs can comprise a set of 6 CDRs as depicted in these sequences and Figures, either as they are underlined or, in the case where a different numbering scheme is used as described herein and as shown in Table 1, as the CDRs that are identified using other alignments within the vh and vl sequences of SEQ ID NOs: 21-2918, SEQ ID NOs: 2919-6208, SEQ ID NOs: 36739-36818 and SEQ ID NOs: 35395-35416. Suitable ABDs can also include the entire vh and vl sequences as depicted in these sequences and Figures, used as scFvs or as Fabs. In many of the embodiments herein that contain an Fv to CTLA-4, it is the scFv monomer that binds CTLA-4. As discussed herein, the other of the target pair when CTLA-4 is one of the antigens is selected from PD-1 (suitable sequences are depicted in SEQ ID NOs: 6209-11464, SEQ ID NOs: 11465-17134, SEQ ID NOs: 33003-33072, SEQ ID NOs: 33073-35394 and SEQ ID NOs: 36127-36146 (which can be scFv sequences, CDR sequence sets or vh and vl sequences)), TIM-3 (suitable sequences are depicted in SEQ ID NOs: 20765-20884, SEQ ID NOs: 37587-37698 and SEQ ID NOs: 36347-36706 (which can be scFv sequences, CDR sequence sets or vh and vl sequences)), LAG-3 (suitable sequences are depicted in SEQ ID NOs: 17135-20764, SEQ ID NOs: 36819-36962, SEQ ID NOs: 35417-35606, SEQ ID NOs: 25194-32793 and SEQ ID NOs: 32794-33002 (which can be scFv sequences, CDR sequence sets or vh and vl sequences)), BTLA (suitable sequences are depicted in SEQ ID NOs: 20885-21503 and SEQ ID NOs: 36707-36738 (which can be scFv sequences, CDR sequence sets or vh and vl sequences)), and TIGIT (suitable sequences are depicted in SEQ ID NOs: 21504-21523 and SEQ ID NOs: 37435-37586 (which can be scFv sequences, CDR sequence sets or vh and vl sequences)).

In addition to the parental CDR sets disclosed in the sequence listing that form an ABD to CTLA-4, the invention provides variant CDR sets. In one embodiment, a set of 6 CDRs can have 1, 2, 3, 4 or 5 amino acid changes from the parental CDRs, as long as the ABD is still able to bind to the target antigen, as measured by at least one of a BIACORE®, surface plasmon resonance (SPR) and/or BLI (biolayer interferometry, e.g. OCTET® assay) assay, with the latter finding particular use in many embodiments.

In addition to the parental variable heavy and variable light domains disclosed herein that form an ABD to CTLA-4, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured by at least one of a BIACORE®, surface plasmon resonance (SPR) and/or BLI (biolayer interferometry, e.g. OCTET® assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a BIACORE®, surface plasmon resonance (SPR) and/or BLI (biolayer interferometry, e.g. OCTET® assay) assay, with the latter finding particular use in many embodiments.

Specific preferred embodiments include the [CTLA-4]_H3_L0.22 anti-CTLA-4 Fv, in a Fab format, included within any of the bottle opener format backbones of FIG. 37.

Specific preferred embodiments include the [CTLA-4]_H3_L0.22 anti-CTLA-4 Fv, in a scFv format, included within any of the bottle opener format backbones of FIG. 37.

Specific preferred embodiments include the [CTLA-4]_H3_L0.22 anti-CTLA-4 Fv, in a scFv format, included within any of the mAb-scFv format backbones of FIG. 38.

Specific preferred embodiments include the [CTLA-4]_H3_L0.22 anti-CTLA-4 Fv, in a Fab format, included within any of the mAb-scFv format backbones of FIG. 38.

D. TIM-3 Antigen Binding Domains

In some embodiments, one of the ABDs binds TIM-3. Suitable sets of 6 CDRs and/or vh and vl domains, as well as scFv sequences, are depicted SEQ ID NOs: 20765-20884, SEQ ID NOs: 37587-37698 and SEQ ID NOs: 36347-36706. ABD sequences of particular interest in some embodiments include those sequences in the sequence listing with the identifiers 1D10_H0L0; 1D12_H0L0; 3H3_H1_L2.1; 6C8_H0L0; 6D9_H0_1D12_L0; 7A9_H0L0; 7B11_H0L0; 7B11var_H0L0; and 7C2_H0L0.

As will be appreciated by those in the art, suitable anti-TIM-3 ABDs can comprise a set of 6 CDRs as depicted in these sequences and Figures, either as they are underlined or, in the case where a different numbering scheme is used as described herein and as shown in Table 1, as the CDRs that are identified using other alignments within the vh and vl sequences of SEQ ID NOs: 20765-20884, SEQ ID NOs: 37587-37698 and SEQ ID NOs: 36347-36706. Suitable ABDs can also include the entire vh and vl sequences as depicted in these sequences and Figures, used as scFvs or as Fabs. In many of the embodiments herein that contain an Fv to TIM-3, it is the Fab monomer that binds TIM-3. As discussed herein, the other of the target pair when TIM-3 is one of the antigens is selected from PD-1 (suitable sequences are depicted in SEQ ID NOs: 6209-11464, SEQ ID NOs: 11465-17134, SEQ ID NOs: 33003-33072, SEQ ID NOs: 33073-35394 and SEQ ID NOs: 36127-36146 (which can be scFv sequences, CDR sequence sets or vh and vl sequences)), CTLA-4 (suitable sequences are depicted in SEQ ID NOs: 21-2918, SEQ ID NOs: 2919-6208, SEQ ID NOs: 36739-36818 and SEQ ID NOs: 35395-35416 (which can be scFv sequences, CDR sequence sets or vh and vl sequences)), LAG-3 (suitable sequences are depicted in SEQ ID NOs: 17135-20764, SEQ ID NOs: 36819-36962, SEQ ID NOs: 35417-35606, SEQ ID NOs: 25194-32793 and SEQ ID NOs: 32794-33002 (which can be scFv sequences, CDR sequence sets or vh and vl sequences)), BTLA (suitable sequences are depicted in SEQ ID NOs: 20885-21503 and SEQ ID NOs: 36707-36738 (which can be scFv sequences, CDR sequence sets or vh and vl sequences)), and TIGIT (suitable sequences are depicted in SEQ ID NOs: 21504-21523 and SEQ ID NOs: 37435-37586 (which can be scFv sequences, CDR sequence sets or vh and vl sequences)).

In addition to the parental CDR sets disclosed in the sequence listing that form an ABD to TIM-3, the invention provides variant CDR sets. In one embodiment, a set of 6

CDRs can have 1, 2, 3, 4 or 5 amino acid changes from the parental CDRs, as long as the ABD is still able to bind to the target antigen, as measured by at least one of a BIACORE®, surface plasmon resonance (SPR) and/or BLI (biolayer interferometry, e.g. OCTET® assay) assay, with the latter finding particular use in many embodiments.

In addition to the parental variable heavy and variable light domains disclosed herein that form an ABD to TIM-3, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured at least one of a BIACORE®, surface plasmon resonance (SPR) and/or BLI (biolayer interferometry, e.g. OCTET® assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a BIACORE®, surface plasmon resonance (SPR) and/or BLI (biolayer interferometry, e.g. OCTET® assay) assay, with the latter finding particular use in many embodiments.

LAG-3 Antigen Binding Domains

In some embodiments, one of the ABDs binds LAG-3. Suitable sets of 6 CDRs and/or vh and vl domains, as well as scFv sequences, are depicted SEQ ID NOs: 17135-20764, SEQ ID NOs: 36819-36962, SEQ ID NOs: 35417-35606, SEQ ID NOs: 25194-32793 and SEQ ID NOs: 32794-33002. ABD sequences of particular interest in some embodiments are shown in FIG. 11 and also include those sequences in the sequence listing with the identifiers 2A11_H0L0; 2A11_H1.125_L2.113; 2A11_H1.144_L2.142; 2A11_H1_L2.122; 2A11_H1_L2.123; 2A11_H1_L2.124; 2A11_H1_L2.25; 2A11_H1_L2.47; 2A11_H1_L2.50; 2A11_H1_L2.91; 2A11_H1_L2.93; 2A11_H1_L2.97; 2A11_H1L1; 2A11_H1L2; 2A11_H2L2; 2A11_H3L1; 2A11_H3L2; 2A11_H4L1; 2A11_H4L2; 7G8_H0L0; 7G8_H1L1; 7G8_H3.18_L1.11; 7G8_H3.23_L1.11; 7G8_H3.28_L1; 7G8_H3.28_L1.11; 7G8_H3.28_L1.13; 7G8_H3.30_L1.34; 7G8_H3.30_L1.34; and 7G8_H3L1.

As will be appreciated by those in the art, suitable anti-LAG-3 ABDs can comprise a set of 6 CDRs as depicted in these sequences and Figures, either as they are underlined or, in the case where a different numbering scheme is used as described herein and as shown in Table 1, as the CDRs that are identified using other alignments within the vh and vl sequences of SEQ ID NOs: 17135-20764, SEQ ID NOs: 36819-36962, SEQ ID NOs: 35417-35606, SEQ ID NOs: 25194-32793 and SEQ ID NOs: 32794-33002. Suitable ABDs can also include the entire vh and vl sequences as depicted in these sequences and Figures, used as scFvs or as Fabs. In many of the embodiments herein that contain an Fv to LAG-3, it is the Fab monomer that binds LAG-3. As discussed herein, the other of the target pair when LAG-3 is one of the antigens is selected from PD-1 (suitable sequences are depicted in SEQ ID NOs: 6209-11464, SEQ ID NOs: 11465-17134, SEQ ID NOs: 33003-33072, SEQ ID NOs: 33073-35394 and SEQ ID NOs: 36127-36146 (which can be scFv sequences, CDR sequence sets or vh and vl sequences)), CTLA-4 (suitable sequences are depicted in SEQ ID NOs: 21-2918, SEQ ID NOs: 2919-6208, SEQ ID NOs: 36739-36818 and SEQ ID NOs: 35395-35416 (which can be scFv sequences, CDR sequence sets or vh and vl sequences)), TIM-3 (suitable sequences are depicted in SEQ ID NOs: 20765-20884, SEQ ID NOs: 37587-37698 and SEQ ID NOs: 36347-36706 (which can be scFv sequences, CDR sequence sets or vh and vl sequences)), BTLA (suitable sequences are depicted in SEQ ID NOs: 20885-21503 and SEQ ID NOs: 36707-36738 (which can be scFv sequences, CDR sequence sets or vh and vl sequences)), and TIGIT (suitable sequences are depicted in SEQ ID NOs: 21504-21523 and SEQ ID NOs: 37435-37586 (which can be scFv sequences, CDR sequence sets or vh and vl sequences).

In addition to the parental CDR sets disclosed in the sequence listing that form an ABD to LAG-3, the invention provides variant CDR sets. In one embodiment, a set of 6 CDRs can have 1, 2, 3, 4 or 5 amino acid changes from the parental CDRs, as long as the ABD is still able to bind to the target antigen, as measured by at least one of a BIACORE®, surface plasmon resonance (SPR) and/or BLI (biolayer interferometry, e.g. OCTET® assay) assay, with the latter finding particular use in many embodiments.

In addition to the parental variable heavy and variable light domains disclosed herein that form an ABD to LAG-3, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured by at least one of a BIACORE®, surface plasmon resonance (SPR) and/or BLI (biolayer interferometry, e.g. OCTET® assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a BIACORE®, surface plasmon resonance (SPR) and/or BLI (biolayer interferometry, e.g. OCTET® assay) assay, with the latter finding particular use in many embodiments.

Specific preferred embodiments include the 7G8_H3.30_L1.34 anti-LAG-3 Fv, in a Fab format, included within any of the bottle opener format backbones of FIG. 37.

Specific preferred embodiments include the 7G8_H3.30_L1.34 anti-LAG-3 Fv, in a scFv format, included within any of the bottle opener format backbones of FIG. 37.

E. BTLA Antigen Binding Domains

In some embodiments, one of the ABDs binds BTLA. Suitable sets of 6 CDRs and/or vh and vl domains, as well as scFv sequences, are depicted in SEQ ID NOs: 20885-21503 and SEQ ID NOs: 36707-36738. ABD sequences of particular interest in some embodiments are shown in FIG. 12 and also include those sequences in the sequence listing with the identifiers 9C6_H0L0; 9C6_H1.1_L1; and 9C6_H1.11_L1.

As will be appreciated by those in the art, suitable anti-BTLA ABDs can comprise a set of 6 CDRs as depicted in these sequences and Figures, either as they are underlined or, in the case where a different numbering scheme is used as described herein and as shown in Table 1, as the CDRs that are identified using other alignments within the vh and vl sequences SEQ ID NOs: 20885-21503 and SEQ ID NOs: 36707-36738. Suitable ABDs can also include the entire vh and vl sequences as depicted in these sequences and Figures, used as scFvs or as Fabs. In many of the embodiments herein that contain an Fv to BTLA, it is the Fab monomer that binds BTLA. As discussed herein, the other of the target pair when LAG-3 is one of the antigens is selected from PD-1 (suitable sequences are depicted in SEQ ID NOs: 6209-11464, SEQ ID NOs: 11465-17134, SEQ ID NOs: 33003-33072, SEQ ID NOs: 33073-35394 and SEQ ID NOs: 36127-36146 (which can be scFv sequences, CDR sequence sets or vh and vl sequences)), CTLA-4 (suitable sequences are depicted in SEQ ID NOs: 21-2918, SEQ ID NOs: 2919-6208, SEQ ID NOs: 36739-36818 and SEQ ID NOs: 35395-35416 (which can be scFv sequences, CDR sequence sets or vh and vl sequences)), TIM-3 (suitable sequences are depicted in SEQ ID NOs: 20765-20884, SEQ ID NOs: 37587-37698 and SEQ ID NOs: 36347-36706 (which can be scFv sequences, CDR sequence sets or vh and vl sequences)), LAG-3 (suitable sequences are depicted in SEQ ID NOs: 17135-20764, SEQ ID NOs: 36819-36962, SEQ ID NOs: 35417-35606, SEQ ID NOs: 25194-32793 and SEQ ID NOs: 32794-33002 (which can be scFv sequences, CDR sequence sets or vh and vl sequences)), and TIGIT (suitable sequences are depicted in SEQ ID NOs: 21504-21523 and SEQ ID NOs: 37435-37586 (which can be scFv sequences, CDR sequence sets or vh and vl sequences)).

In addition to the parental CDR sets disclosed in the sequence listing that form an ABD to BTLA, the invention provides variant CDR sets. In one embodiment, a set of 6 CDRs can have 1, 2, 3, 4 or 5 amino acid changes from the parental CDRs, as long as the ABD is still able to bind to the target antigen, as measured at least one of a BIACORE®, surface plasmon resonance (SPR) and/or BLI (biolayer interferometry, e.g. OCTET® assay) assay, with the latter finding particular use in many embodiments.

In addition to the parental variable heavy and variable light domains disclosed herein that form an ABD to BTLA, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured by at least one of a BIACORE®, surface plasmon resonance (SPR) and/or BLI (biolayer interferometry, e.g. OCTET® assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a BIACORE®, surface plasmon resonance (SPR) and/or BLI (biolayer interferometry, e.g. OCTET® assay) assay, with the latter finding particular use in many embodiments.

Specific preferred embodiments include the 9C6_H1.1_L1 anti-LAG-3 Fv, in a Fab format, included within any of the bottle opener format backbones of FIG. 37.

Specific preferred embodiments include the 7G8_H3.30_L1.34 anti-LAG-3 Fv, in a scFv format, included within any of the bottle opener format backbones of FIG. 37.

F. TIGIT Antigen Binding Domains

In some embodiments, one of the ABDs binds TIGIT. Suitable sets of 6 CDRs and/or vh and vl domains, as well as scFv sequences, are depicted in SEQ ID NOs: 21504-21523 and SEQ ID NOs: 37435-37586.

As will be appreciated by those in the art, suitable anti-TIGIT ABDs can comprise a set of 6 CDRs as depicted in these sequences and Figures, either as they are underlined or, in the case where a different numbering scheme is used as described herein and as shown in Table 1, as the CDRs that are identified using other alignments within the vh and vl sequences of SEQ ID NOs: 21504-21523 and SEQ ID NOs: 37435-37586. Suitable ABDs can also include the entire vh and vl sequences as depicted in these sequences and Figures, used as scFvs or as Fabs. In many of the embodiments herein that contain an Fv to TIGIT, it is the Fab monomer that binds TIGIT. As discussed herein, the other of the target pair when LAG-3 is one of the antigens is selected from PD-1 (suitable sequences are depicted in SEQ ID NOs: 6209-11464, SEQ ID NOs: 11465-17134, SEQ ID NOs: 33003-33072, SEQ ID NOs: 33073-35394 and SEQ ID NOs: 36127-36146 (which can be scFv sequences, CDR sequence sets or vh and vl sequences)), CTLA-4 (suitable sequences are depicted in SEQ ID NOs: 21-2918, SEQ ID NOs: 2919-6208, SEQ ID NOs: 36739-36818 and SEQ ID NOs: 35395-35416 (which can be scFv sequences, CDR sequence sets or vh and vl sequences)), TIM-3 (suitable sequences are depicted in SEQ ID NOs: 20765-20884, SEQ ID NOs: 37587-37698 and SEQ ID NOs: 36347-36706 (which can be scFv sequences, CDR sequence sets or vh and vl sequences)), LAG-3 (suitable sequences are depicted in SEQ ID NOs: 17135-20764, SEQ ID NOs: 36819-36962, SEQ ID NOs: 35417-35606, SEQ ID NOs: 25194-32793 and SEQ ID NOs: 32794-33002 (which can be scFv sequences, CDR sequence sets or vh and vl sequences)), and BTLA (suitable sequences are depicted in SEQ ID NOs: 20885-21503 and SEQ ID NOs: 36707-36738 (which can be scFv sequences, CDR sequence sets or vh and vl sequences)).

G. Specific Bispecific Embodiments

The invention provides a number of particular bispecific antibodies as outlined below.

1. LAG-3×CTLA-4

In some embodiments, the invention provides bispecific heterodimeric antibodies comprising a first ABD that binds human LAG-3 and a second ABD that binds human CTLA-4, and can be in any format shown in FIG. 1. Most of the disclosure refers to a bottle opener format with the Fab being the LAG-3 side and the CLTA-4 side being the scFv side, but this can be reversed for all of the embodiments herein.

In one embodiment, the LAG-3×CTLA-4 bispecific antibody is in the bottle opener format of FIG. 1A, wherein the CTLA-4 ABD is the scFv. In another embodiment, the LAG-3×CTLA-4 bispecific antibody is in the central-scFv format of FIG. 1F, with the LAG-3 ABD being the Fab components. In another embodiment, the LAG-3×CTLA-4 bispecific antibody is in the central-scFv format of FIG. 1F, with the CTLA-4 ABD being the scFv.

The LAG-3×CTLA-4 bispecific antibodies (in either the bottle opener format or the central-scFv format) generally include skew variants, pI variants and ablation variants as outlined herein. That is, in either format, the Fc domains of the two monomers can comprise skew variants (e.g. a set of amino acid substitutions as shown in FIG. 3 and FIG. 8), optionally ablation variants (including those shown in FIG. 5), and the monomer comprising the Fab side (e.g. the heavy chain constant domain) comprises pI variants (including those shown in FIG. 4).

In some embodiments, the LAG-3×CTLA-4 bispecific antibody comprises Fc domains with skew variants, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/Y349C:T366W/S354C.

In some embodiments, the LAG-3×CTLA-4 antibody includes skew variants, pI variants, and ablation variants. Accordingly, some embodiments include bottle opener formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/L235A/G236del/S267K, and an Fv that binds to a checkpoint inhibitor as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, and a variable heavy domain that, with the variable light domain, makes up an Fv that binds to a second checkpoint inhibitor as outlined herein; and c) a light chain. A specific example of this embodiment utilizes the LAG-3 Fab 7G8_H3.30_L1.34 and the CTLA-4 scFv [CTLA-4]_H3.23_L0.129, although any of the CTLA-4 or LAG-3 Fvs in the sequence listing can be paired in any combination and used.

In some embodiments, the LAG-3×CTLA-4 antibody includes skew variants, pI variants, ablation variants and FcRn variants. Accordingly, some embodiments include bottle opener formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/L235A/G236del/S267K, the FcRn variants M428L/N434S and an Fv that binds to a checkpoint inhibitor as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain, makes up an Fv that binds to a second checkpoint inhibitor as outlined herein; and c) a light chain. A specific example of this embodiment utilizes the LAG-3 Fab 7G8_H3.30_L1.34 and the CTLA-4 scFv [CTLA-4]_H3.23_L0.129, although any of the CTLA-4 or LAG-3 Fvs in the sequence listing can be paired in any combination and used.

Additional embodiments include any of the backbones from FIG. 37 with the LAG-3 Fab 7G8_H3.30_L1.34 and the CTLA-4 scFv [CTLA-4]_H3.23_L0.129.

Additional embodiments include any of the backbones from FIG. 38 with the LAG-3 Fab 7G8_H3.30_L1.34 and the CTLA-4 scFv [CTLA-4]_H3.23_L0.129.

In some embodiments, for LAG-3×CLTA-4 bispecific antibodies, the Fv for the LAG-3 Fab side is selected from those sequences in the sequence listing with the identifiers 2A11_H0L0; 2A11_H1.125_L2.113; 2A11_H1.144_L2.142; 2A11_H1_L2.122; 2A11_H1_L2.123; 2A11_H1_L2.124; 2A11_H1_L2.25; 2A11_H1_L2.47; 2A11_H1_L2.50; 2A11_H1_L2.91; 2A11_H1_L2.93; 2A11_H1_L2.97; 2A11_H1L1; 2A11_H1L2; 2A11_H2L2; 2A11_H3L1; 2A11_H3L2; 2A11_H4L1; 2A11_H4L2; 7G8_H0L0; 7G8_H1L1; 7G8_H3.18_L1.11; 7G8_H3.23_L1.11; 7G8_H3.28_L1; 7G8_H3.28_L1.11; 7G8_H3.28_L1.13; 7G8_H3.30_L1.34; 7G8_H3.30_L1.34; and 7G8_H3L1. The Fv for the CTLA-4 scFv side is selected from those sequences in the sequence listing with the identifiers [CTLA-4]_H0.25_L0; [CTLA-4]_H0.26_L0; [CTLA-4]_H0.27_L0; [CTLA-4]_H0.29_L0; [CTLA-4]_H0.38_L0; [CTLA-4]_H0.39_L0; 0[CTLA-4]_H0.40_L0; [CTLA-4]_H0.70_L0; [CTLA-4]_H0_L0.22; [CTLA-4]_H2_L0; [CTLA-4]_H3.21_L0.124; [CTLA-4]_H3.21_L0.129; [CTLA-4]_H3.21_L0.132; [CTLA-4]_H3.23_L0.124; [CTLA-4]_H3.23_L0.129; [CTLA-4]_H3.23_L0.132; [CTLA-4]_H3.25_L0.124; [CTLA-4]_H3.25_L0.129; [CTLA-4]_H3.25_L0.132; [CTLA-4]_H3.4_L0.118; [CTLA-4]_H3.4_L0.119; [CTLA-4]_H3.4_L0.12; [CTLA-4]_H3.4_L0.121; [CTLA-4]_H3.4_L0.122; [CTLA-4]_H3.4_L0.123; [CTLA-4]_H3.4_L0.124; [CTLA-4]_H3.4_L0.125; [CTLA-4]_H3.4_L0.126; [CTLA-4]_H3.4_L0.127; [CTLA-4]_H3.4_L0.128; [CTLA-4]_H3.4_L0.129; [CTLA-4]_H3.4_L0.130; [CTLA-4]_H3.4_L0.131; [CTLA-4]_H3.4_L0.132; [CTLA-4]_H3.5_L2.1; [CTLA-4]_H3.5_L2.2; [CTLA-4]_H3.5_L2.3; [CTLA-4]_H3_L0; [CTLA-4]_H3_L0.22; [CTLA-4]_H3_L0.44; [CTLA-4]_H3_L0.67; and [CTLA-4]_H3_L0.74.

In some embodiments, the LAG-3×CTLA-4 bispecific antibody is selected from those constructs listed in SEQ ID NOs: 35607-35866 and SEQ ID NOs: 21524-22620.

In some embodiments, the LAG-3×CTLA-4 bispecific antibody is selected from XENP20206, XENP21582, XENP21584, XENP21588, XENP22123, XENP22124, XENP22125, XENP22604, XENP22672, XENP22847, XENP22847, XENP22841 and XENP22849.

2. BTLA×PD-1

In some embodiments, the invention provides bispecific heterodimeric antibodies comprising a first ABD that binds human BTLA and a second ABD that binds human PD-1, and can be in any format shown in FIG. 1. Most of the disclosure refers to a bottle opener format with the Fab being the BTLA side and the PD-1 side being the scFv side, but this can be reversed for all of the embodiments herein.

In one embodiment, the BTLA×PD-1 bispecific antibody is in the bottle opener format of FIG. 1A, wherein the PD-1 ABD is the scFv. In another embodiment, the BTLA×PD-1 bispecific antibody is in the central-scFv format of FIG. 1F, with the BTLA ABD being the Fab components. In another embodiment, the BTLA×PD-1 bispecific antibody is in the central-scFv format of FIG. 1F, with the PD-1 ABD being the scFv.

The BTLA×PD-1 bispecific antibodies (in either the bottle opener format or the central-scFv format) generally include skew variants, pI variants and ablation variants as outlined herein. That is, in either format, the Fc domains of the two monomers can comprise skew variants (e.g. a set of amino acid substitutions as shown in FIG. 3 and FIG. 8), optionally ablation variants (including those shown in FIG. 5), and the monomer comprising the Fab side (e.g. the heavy chain constant domain) comprises pI variants (including those shown in FIG. 4).

In some embodiments, the BTLA×PD-1 bispecific antibody comprises Fc domains with skew variants, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/Y349C:T366W/S354C.

In some embodiments, the BTLA×PD-1 antibody includes skew variants, pI variants, and ablation variants. Accordingly, some embodiments include bottle opener formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/L235A/G236del/S267K, and an Fv that binds to a checkpoint inhibitor as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, and a variable heavy domain that, with the variable light domain, makes up an Fv that binds to a second checkpoint inhibitor as outlined herein; and c) a light chain. A specific example of this embodiment utilizes the BTLA Fab 9C6_H1.1_L1 and the PD-1 scFv 1G6_L1.194_H1.279 although any of the BTLA or PD-1 Fvs in the sequence listing can be paired in any combination and used.

In some embodiments, the BTLAxPD-1 antibody includes skew variants, pI variants, ablation variants and FcRn variants. Accordingly, some embodiments include bottle opener formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/L235A/G236del/S267K, the FcRn variants M428L/N434S and an Fv that binds to a checkpoint inhibitor as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain, makes up an Fv that binds to a second checkpoint inhibitor as outlined herein; and c) a light chain. A specific example of this embodiment utilizes the BTLA Fab 9C6_H1.1_L1 and the PD-1 scFv 1G6_L1.194_H1.279 although any of the BTLA or PD-1 Fvs in the sequence listing can be paired in any combination and used.

Additional embodiments include any of the backbones from FIG. 37 with the BTLA Fab 9C6_H1.1_L1 and the PD-1 scFv 1G6_L1.194_H1.279.

Additional embodiments include any of the backbones from FIG. 38 with the BTLA Fab 9C6_H1.1_L1 and the PD-1 scFv 1G6_L1.194_H1.279.

In some embodiments, for BTLAxPD-1 bispecific antibodies, the Fv for the BTLA Fab side is selected from those sequences in the sequence listing with the identifiers 9C6_H0L0, 9C6_H1.1_L1, 9C6_H1.11_L1. The Fv for the PD-1 scFv side is selected from those sequences in the sequence listing with the identifiers 1G6_H1.279_L1.194; 1G6_H1.280_L1.224; 1G6_L1.194_H1.279; 1G6_L1.210_H1.288; and 2E9_H1L1.

In some embodiments, the BTLAxPD-1 bispecific antibody is selected from constructs include those listed as SEQ ID NOs: 22724-23315 and SEQ ID NOs: 36147-36166.

In some embodiments, the BTLAxPD-1 bispecific antibody is selected from XENP20895, XENP21220, XENP21221 and XENP22858.

3. CTLA-4xPD-1

In some embodiments, the invention provides bispecific heterodimeric antibodies comprising a first ABD that binds human CTLA-4 and a second ABD that binds human PD-1, and can be in any format shown in FIG. 1. Most of the disclosure refers to a bottle opener format with the Fab being the CTLA-4 side and the PD-1 side being the scFv side, but this can be reversed for all of the embodiments herein.

In one embodiment, the CTLA-4xPD-1 bispecific antibody is in the bottle opener format of FIG. 1A, wherein the PD-1 ABD is the scFv. In another embodiment, the CTLA-4xPD-1 bispecific antibody is in the central-scFv format of FIG. 1F, with the CTLA-4 ABD being the Fab components. In another embodiment, the CTLA-4xPD-1 bispecific antibody is in the central-scFv format of FIG. 1F, with the PD-1 ABD being the scFv.

The CTLA-4xPD-1 bispecific antibodies (in either the bottle opener format or the central-scFv format) generally include skew variants, pI variants and ablation variants as outlined herein. That is, in either format, the Fc domains of the two monomers can comprise skew variants (e.g. a set of amino acid substitutions as shown in FIG. 3 and FIG. 8), optionally ablation variants (including those shown in FIG. 5), and the monomer comprising the Fab side (e.g. the heavy chain constant domain) comprises pI variants (including those shown in FIG. 4).

In some embodiments, the CTLA-4xPD-1 bispecific antibody comprises Fc domains with skew variants, with particularly useful skew variants being selected from the group consisting of S364K/E357Q:L368D/K370S; L368D/K370S: S364K; L368E/K370S:S364K; T411T/E360E/Q362E: D401K; L368D/K370S:S364K/E357L, K370S:S364K/ E357Q, T366S/L368A/Y407V:T366W and T366S/L368A/ Y407V/Y349C: T366W/S354C.

In some embodiments, the CTLA-4xPD-1 antibody includes skew variants, pI variants, and ablation variants. Accordingly, some embodiments include bottle opener formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/L235A/G236del/S267K, and an Fv that binds to a checkpoint inhibitor as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, and a variable heavy domain that, with the variable light domain, makes up an Fv that binds to a second checkpoint inhibitor as outlined herein; and c) a light chain. A specific example of this embodiment utilizes the CTLA-4 Fab [CTLA-4]_H3_L0.22 and the PD-1 scFv 1G6_L1.194_H1.279 although any of the CTLA-4 or PD-1 Fvs in the sequence listing can be paired in any combination and used.

In some embodiments, the CTLA-4xPD-1 antibody includes skew variants, pI variants, ablation variants and FcRn variants. Accordingly, some embodiments include bottle opener formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/L235A/G236del/S267K, the FcRn variants M428L/N434S and an Fv that binds to a checkpoint inhibitor as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain, makes up an Fv that binds to a second checkpoint inhibitor as outlined herein; and c) a light chain. A specific example of this embodiment utilizes the CTLA-4 Fab [CTLA-4]_H3_L0.22 and the PD-1 scFv 1G6_L1.194_H1.279 although any of the CTLA-4 or PD-1 Fvs in the sequence listing can be paired in any combination and used.

Additional embodiments include any of the backbones from FIG. 37 with the CTLA-4 Fab [CTLA-4]_H3_L0.22 and the PD-1 scFv 1G6_L1.194_H1.279.

Additional embodiments include any of the backbones from FIG. 38 with the CTLA-4 Fab [CTLA-4]_H3_L0.22 and the PD-1 scFv 1G6_L1.194_H1.279.

In some embodiments, for CTLA-4xPD-1 bispecific antibodies, the Fv for the CTLA-4 Fab side is selected from those sequences in the sequence listing with the identifiers with the identifiers [CTLA-4]_H0.25_L0; [CTLA-4]_H0.26_L0; [CTLA-4]_H0.27_L0; [CTLA-4]_H0.29_L0; [CTLA-4]_H0.38_L0; [CTLA-4]_H0.39_L0; 0[CTLA-4]_H0.40_L0; [CTLA-4]_H0.70_L0; [CTLA-4]_H0_L0.22; [CTLA-4]_H2_L0;

[CTLA-4]_H3.21_L0.124; [CTLA-4]_H3.21_L0.129; [CTLA-4]_H3.21_L0.132; [CTLA-4]_H3.23_L0.124; [CTLA-4]_H3.23_L0.129; [CTLA-4]_H3.23_L0.132; [CTLA-4]_H3.25_L0.124; [CTLA-4]_H3.25_L0.129; [CTLA-4]_H3.25_L0.132; [CTLA-4]_H3.4_L0.118; [CTLA-4]_H3.4_L0.119; [CTLA-4]_H3.4_L0.12; [CTLA-4]_H3.4_L0.121; [CTLA-4]_H3.4_L0.122; [CTLA-4]_H3.4_L0.123; [CTLA-4]_H3.4_L0.124; [CTLA-4]_H3.4_L0.125; [CTLA-4]_H3.4_L0.126; [CTLA-4]_H3.4_L0.127; [CTLA-4]_H3.4_L0.128; [CTLA-4]_H3.4_L0.129; [CTLA-4]_H3.4_L0.130; [CTLA-4]_H3.4_L0.131; [CTLA-4]_H3.4_L0.132; [CTLA-4]_H3.5_L2.1; [CTLA-4]_H3.5_L2.2; [CTLA-4]_H3.5_L2.3; [CTLA-4]_H3_L0; [CTLA-4]_H3_L0.22; [CTLA-4]_H3_L0.44; [CTLA-4]_H3_L0.67; and [CTLA-4]_H3_L0.74. The Fv for the PD-1 scFv side is selected from those sequences in the sequence listing with the identifiers identifiers 1G6_H1.279_L1.194; 1G6_H1.280_L1.224; 1G6_L1.194_H1.279; 1G6_L1.210_H1.288; and 2E9_H1L1.

In some embodiments, the CTLA-4×PD-1 bispecific antibody is selected from those listed as SEQ ID NOs: 36167-36346 and SEQ ID NOs: 23316-23735.

In some embodiments, the CTLA-4×PD-1 bispecific antibody is selected from XENP19738, XENP19739, XENP19741, XENP20053, XENP20066, XENP20130, XENP20146, XENP20717 and XENP22836.

4. LAG-3×PD-1

In some embodiments, the invention provides bispecific heterodimeric antibodies comprising a first ABD that binds human LAG-3 and a second ABD that binds human PD-1, and can be in any format shown in FIG. 1. Most of the disclosure refers to a bottle opener format with the Fab being the LAG-3 side and the PD-1 side being the scFv side, but this can be reversed for all of the embodiments herein.

In one embodiment, the LAG-3×PD-1 bispecific antibody is in the bottle opener format of FIG. 1A, wherein the PD-1 ABD is the scFv. In another embodiment, the LAG-3×PD-1 bispecific antibody is in the central-scFv format of FIG. 1F, with the LAG-3 ABD being the Fab components. In another embodiment, the LAG-3×PD-1 bispecific antibody is in the central-scFv format of FIG. 1F, with the PD-1 ABD being the scFv.

The LAG-3×PD-1 bispecific antibodies (in either the bottle opener format or the central-scFv format) generally include skew variants, pI variants and ablation variants as outlined herein. That is, in either format, the Fc domains of the two monomers can comprise skew variants (e.g. a set of amino acid substitutions as shown in FIG. 3 and FIG. 8), optionally ablation variants (including those shown in FIG. 5), and the monomer comprising the Fab side (e.g. the heavy chain constant domain) comprises pI variants (including those shown in FIG. 4).

In some embodiments, the LAG-3×PD-1 bispecific antibody comprises Fc domains with skew variants, with particularly useful skew variants being selected from the group consisting of S364K/E357Q:L368D/K370S; L368D/K370S: S364K; L368E/K370S:S364K; T411T/E360E/Q362E: D401K; L368D/K370S:S364K/E357L, K370S:S364K/ E357Q, T366S/L368A/Y407V:T366W and T366S/L368A/ Y407V/Y349C: T366W/S354C.

In some embodiments, the LAG-3×PD-1 antibody includes skew variants, pI variants, and ablation variants. Accordingly, some embodiments include bottle opener formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/L235A/G236del/S267K, and an Fv that binds to a checkpoint inhibitor as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, and a variable heavy domain that, with the variable light domain, makes up an Fv that binds to a second checkpoint inhibitor as outlined herein; and c) a light chain. A specific example of this embodiment utilizes the LAG-3 Fab 7G8_H3.30_L1.34 and the PD-1 scFv 1G6_L1.194_H1.279 although any of the LAG-3 or PD-1 Fvs in the sequence listing can be paired in any combination and used.

In some embodiments, the LAG-3×PD-1 antibody includes skew variants, pI variants, ablation variants and FcRn variants. Accordingly, some embodiments include bottle opener formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/L235A/G236del/S267K, the FcRn variants M428L/N434S and an Fv that binds to a checkpoint inhibitor as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain, makes up an Fv that binds to a second checkpoint inhibitor as outlined herein; and c) a light chain. A specific example of this embodiment utilizes the LAG-3 Fab 7G8_H3.30_L1.34 and the PD-1 scFv 1G6_L1.194_H1.279 although any of the LAG-3 or PD-1 Fvs in the sequence listing can be paired in any combination and used.

Additional embodiments include any of the backbones from FIG. 37 with the LAG-3 Fab 7G8_H3.30_L1.34 and the PD-1 scFv 1G6_L1.194_H1.279.

Additional embodiments include any of the backbones from FIG. 38 with the LAG-3 Fab 7G8_H3.30_L1.34 and the PD-1 scFv 1G6_L1.194_H1.279.

In some embodiments, for LAG-3×PD-1 bispecific antibodies, the Fv for the LAG-3 Fab side is selected from those sequences in the sequence listing with the identifiers 2A11_H0L0; 2A11_H1.125_L2.113; 2A11_H1.144_L2.142; 2A11_H1_L2.122; 2A11_H1_L2.123; 2A11_H1_L2.124; 2A11_H1_L2.25; 2A11_H1_L2.47; 2A11_H1_L2.50; 2A11_H1_L2.91; 2A11_H1_L2.93; 2A11_H1_L2.97; 2A11_H1L1; 2A11_H1L2; 2A11_H2L2; 2A11_H3L1; 2A11_H3L2; 2A11_H4L1; 2A11_H4L2; 7G8_H0L0; 7G8_H1L1; 7G8_H3.18_L1.11; 7G8_H3.23_L1.11; 7G8_H3.28_L1; 7G8_H3.28_L1.11; 7G8_H3.28_L1.13; 7G8_H3.30_L1.34; 7G8_H3.30_L1.34; and 7G8_H3L1. The Fv for the PD-1 scFv side is selected from those sequences in the sequence listing with the identifiers identifiers 1G6_H1.279_L1.194; 1G6_H1.280_L1.224; 1G6_L1.194_H1.279; 1G6_L1.210_H1.288; and 2E9_H1L1.

In some embodiments, the LAG-3×PD-1 bispecific antibody is selected from constructs include those listed as SEQ ID NOs: 35867-36126 and SEQ ID NOs: 23736-25133.

In some embodiments, the LAG-3×PD-1 bispecific antibody is selected from XENP20206, XENP21582, XENP21584, XENP21588, XENP22123, XENP22124, XENP22125, XENP22604, XENP22672, XENP22847, XENP22847 and XENP22849

5. TIGITxPD-1

In some embodiments, the TIGITxPD-1 bispecific antibody is selected from those constructs listed in SEQ ID NOs: 25134-25173.

6. TIM-3xPD-1

In some embodiments, the invention provides bispecific heterodimeric antibodies comprising a first ABD that binds human TIM-3 and a second ABD that binds human PD-1, and can be in any format shown in FIG. 1. Most of the disclosure refers to a bottle opener format with the Fab being the TIM-3 side and the PD-1 side being the scFv side, but this can be reversed for all of the embodiments herein.

In one embodiment, the TIM-3xPD-1 bispecific antibody is in the bottle opener format of FIG. 1A, wherein the PD-1 ABD is the scFv. In another embodiment, the TIM-3xPD-1 bispecific antibody is in the central-scFv format of FIG. 1F, with the TIM-3 ABD being the Fab components. In another embodiment, the TIM-3xPD-1 bispecific antibody is in the central-scFv format of FIG. 1F, with the PD-1 ABD being the scFv.

The TIM-3xPD-1 bispecific antibodies (in either the bottle opener format or the central-scFv format) generally include skew variants, pI variants and ablation variants as outlined herein. That is, in either format, the Fc domains of the two monomers can comprise skew variants (e.g. a set of amino acid substitutions as shown in FIG. 3 and FIG. 8), optionally ablation variants (including those shown in FIG. 5), and the monomer comprising the Fab side (e.g. the heavy chain constant domain) comprises pI variants (including those shown in FIG. 4).

In some embodiments, the TIM-3xPD-1 bispecific antibody comprises Fc domains with skew variants, with particularly useful skew variants being selected from the group consisting of S364K/E357Q:L368D/K370S; L368D/K370S: S364K; L368E/K370S:S364K; T411T/E360E/Q362E: D401K; L368D/K370S:S364K/E357L, K370S:S364K/ E357Q, T366S/L368A/Y407V:T366W and T366S/L368A/ Y407V/Y349C:T366W/S354C.

In some embodiments, the TIM-3xPD-1 antibody includes skew variants, pI variants, and ablation variants. Accordingly, some embodiments include bottle opener formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/L235A/G236del/S267K, and an Fv that binds to a checkpoint inhibitor as outlined herein; b) a second monomer (the "Fab monomer") that comprises the skew variants L368D/K370S, the pI variants N208D/ Q295E/N384D/Q418E/N421D, the ablation variants E233P/ L234V/L235A/G236del/S267K, and a variable heavy domain that, with the variable light domain, makes up an Fv that binds to a second checkpoint inhibitor as outlined herein; and c) a light chain. A specific example of this embodiment utilizes the PD-1 scFv 1G6_L1.194_H1.279 although any of the TIM-3 or PD-1 Fvs in the sequence listing can be paired in any combination and used.

In some embodiments, the TIM-3xPD-1 antibody includes skew variants, pI variants, ablation variants and FcRn variants. Accordingly, some embodiments include bottle opener formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/L235A/G236del/S267K, the FcRn variants M428L/N434S and an Fv that binds to a checkpoint inhibitor as outlined herein; b) a second monomer (the "Fab monomer") that comprises the skew variants L368D/K370S, the pI variants N208D/Q295E/N384D/ Q418E/N421D, the ablation variants E233P/L234V/L235A/ G236del/S267K, the FcRn variants M428L/N434S and a variable heavy domain that, with the variable light domain, makes up an Fv that binds to a second checkpoint inhibitor as outlined herein; and c) a light chain. A specific example of this embodiment utilizes the PD-1 scFv 1G6_L1.194_H1.279 although any of the TIM-3 or PD-1 Fvs in the sequence listing can be paired in any combination and used.

Additional embodiments include any of the backbones from FIG. 37 with a TIM-3 Fab side and the PD-1 scFv 1G6_L1.194_H1.279.

Additional embodiments include any of the backbones from FIG. 38 with TIM-3 Fab side and the PD-1 scFv 1G6_L1.194_H1.279.

In some embodiments, for TIM-3 Fab sidexPD-1 bispecific antibodies, the Fv for the TIM-3 Fab side Fab side is selected from those sequences in the sequence listing with the identifiers 1D10_H0L0; 1D12_H0L0; 3H3_H1_L2.1; 6C8_H0L0; 6D9_H0_1D12_L0; 7A9_H0L0; 7B11_H0L0; 7B11var_H0L0; and 7C2_H0L0. The Fv for the PD-1 scFv side is selected from those sequences in the sequence listing with the identifiers identifiers 1G6_H1.279_L1.194; 1G6_H1.280_L1.224; 1G6_L1.194_H1.279; 1G6_L1.210_H1.288; and 2E9_H1L1.

In addition, the antibodies of the invention include those that bind to either the same epitope as the antigen binding domains outlined herein, or compete for binding with the antigen binding domains outlined herein. In some embodiments, the bispecific checkpoint antibody can contain one of the ABDs outlined herein and a second ABD that competes for binding with one of the ABDs outlined herein. In some embodiments both ABDs compete for binding with the corresponding ABD outlined herein. Binding competition is generally determined using at least one of a BIACORE®, surface plasmon resonance (SPR) and/or BLI (biolayer interferometry, e.g. OCTET® assay) assay, with the latter finding particular use in many embodiments.

VII. USEFUL EMBODIMENTS

In one embodiment, a particular combination of skew and pI variants that finds use in the present invention is T366S/ L368A/Y407V:T366W (optionally including a bridging disulfide, T366S/L368A/Y407V/Y349C:T366W/S354C) with one monomer comprises Q295E/N384D/Q418E/N481D and the other a positively charged scFv linker (when the format includes an scFv domain). As will be appreciated in the art, the "knobs in holes" variants do not change pI, and thus can be used on either monomer.

VIII. NUCLEIC ACIDS OF THE INVENTION

The invention further provides nucleic acid compositions encoding the bispecific antibodies of the invention (or, in the case of "monospecific" antibodies, nucleic acids encoding those as well).

As will be appreciated by those in the art, the nucleic acid compositions will depend on the format and scaffold of the heterodimeric protein. Thus, for example, when the format requires three amino acid sequences, such as for all the formats depicted in FIG. 1 except for the dual scFv format, three nucleic acid sequences can be incorporated into one or more expression vectors for expression. Similarly, some formats (e.g. dual scFv formats such as disclosed in FIG. 1)

only two nucleic acids are needed; again, they can be put into one or two expression vectors.

As is known in the art, the nucleic acids encoding the components of the invention can be incorporated into expression vectors as is known in the art, and depending on the host cells used to produce the heterodimeric antibodies of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g. CHO cells), finding use in many embodiments.

In some embodiments, nucleic acids encoding each monomer and the optional nucleic acid encoding a light chain, as applicable depending on the format, are each contained within a single expression vector, generally under different or the same promoter controls. In embodiments of particular use in the present invention, each of these two or three nucleic acids are contained on a different expression vector. As shown herein and in 62/025,931, hereby incorporated by reference, different vector ratios can be used to drive heterodimer formation. That is, surprisingly, while the proteins comprise first monomer:second monomer:light chains (in the case of many of the embodiments herein that have three polypeptides comprising the heterodimeric antibody) in a 1:1:2 ratio, these are not the ratios that give the best results.

The heterodimeric antibodies of the invention are made by culturing host cells comprising the expression vector(s) as is well known in the art. Once produced, traditional antibody purification steps are done, including an ion exchange chromotography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that such that each monomer has a different pI and the heterodimer also has a distinct pI, thus facilitating isoelectric purification of the "triple F" heterodimer (e.g., anionic exchange columns, cationic exchange columns). These substitutions also aid in the determination and monitoring of any contaminating dual scFv-Fc and mAb homodimers post-purification (e.g., IEF gels, cIEF, and analytical IEX columns).

IX. BIOLOGICAL AND BIOCHEMICAL FUNCTIONALITY OF THE HETERODIMERIC CHECKPOINT ANTIBODIES

Generally the bispecific checkpoint antibodies of the invention are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. For example, evaluation of changes in immune status (e.g. presence of ICOS+CD4+ T cells following ipi treatment) along with "old fashioned" measurements such as tumor burden, size, invasiveness, LN involvement, metastasis, etc. can be done. Thus, any or all of the following can be evaluated: the inhibitory effects of the checkpoints on CD4+ T cell activation or proliferation, CD8+T (CTL) cell activation or proliferation, CD8+ T cell-mediated cytotoxic activity and/or CTL mediated cell depletion, NK cell activity and NK mediated cell depletion, the potentiating effects of the checkpoints on Treg cell differentiation and proliferation and Treg- or myeloid derived suppressor cell (MDSC)-mediated immunosuppression or immune tolerance, and/or the effects of the checkpoints on proinflammatory cytokine production by immune cells, e.g., IL-2, IFN-γ or TNF-α production by T or other immune cells.

In some embodiments, assessment of treatment is done by evaluating immune cell proliferation, using for example, CFSE dilution method, Ki67 intracellular staining of immune effector cells, and 3H-Thymidine incorporation method, In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In general, gene expression assays are done as is known in the art.

In general, protein expression measurements are also similarly done as is known in the art.

In some embodiments, assessment of treatment is done by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, 51Cr or 35S release method, LDH activity, MTT and/or WST assays, Calcein-AM assay, Luminescent based assay, and others.

In some embodiments, assessment of treatment is done by assessing T cell activity measured by cytokine production, measure either intracellularly in culture supernatant using cytokines including, but not limited to, IFNγ, TNFα, GM-CSF, IL2, IL6, IL4, IL5, IL10, IL13 using well known techniques.

Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells (Tregs.

Assays to Measure Efficacy

In some embodiments, T cell activation is assessed using a Mixed Lymphocyte Reaction (MLR) assay as is known in the art. An increase in activity indicates immunostimulatory activity. Appropriate increases in activity are outlined below.

In one embodiment, the signaling pathway assay measures increases or decreases in immune response as measured for an example by phosphorylation or de-phosphorylation of different factors, or by measuring other post translational modifications. An increase in activity indicates immunostimulatory activity. Appropriate increases in activity are outlined below.

In one embodiment, the signaling pathway assay measures increases or decreases in activation of αβ and/or γδ T cells as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in cytotoxic T cell activity as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in NK and/or NKT cell activity as measured for an example by direct killing of target cells like for an example cancer cells or by cytokine secretion or by changes in expression of activation markers like for an example CD107a, etc. An increase in activity indicates immunostimulatory activity. Appropriate increases in activity are outlined below.

In one embodiment, the signaling pathway assay measures increases or decreases in αβ and/or γδ T-cell suppression, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in pro-inflammatory cytokine secretion as measured for example by ELISA or by LUMINEX®® or by multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in IL-2 secretion as measured for example by ELISA or by LUMINEX® or by multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in interferon-γ production as measured for example by ELISA or by LUMINEX® or by multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in Th1 response as measured for an example by cytokine secretion or by changes in expression of activation markers. An increase in activity indicates immunostimulatory activity. Appropriate increases in activity are outlined below.

In one embodiment, the signaling pathway assay measures increases or decreases in Th2 response as measured for an example by cytokine secretion or by changes in expression of activation markers. An increase in activity indicates immunostimulatory activity. Appropriate increases in activity are outlined below.

In one embodiment, the signaling pathway assay measures increases or decreases cell number and/or activity of at least one of regulatory T cells (Tregs), as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophages cell numbers, as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophage pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in N2 neutrophils increase, as measured for example by flow cytometry or by IHC. A decrease in response indicates immunostimulatory activity. Appropriate decreases are the same as for increases, outlined below.

In one embodiment, the signaling pathway assay measures increases or decreases in N2 neutrophils pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in inhibition of T cell activation, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in inhibition of CTL activation as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in αβ and/or γδ T cell exhaustion as measured for an example by changes in expression of activation markers. A decrease in response indicates immunostimulatory activity. Appropriate decreases are the same as for increases, outlined below.

In one embodiment, the signaling pathway assay measures increases or decreases αβ and/or γδ T cell response as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in stimulation of antigen-specific memory responses as measured for an example by cytokine secretion or by proliferation or by changes in expression of activation markers like for an example CD45RA, CCR7 etc. An increase in activity indicates immunostimulatory activity. Appropriate increases in activity are outlined below.

In one embodiment, the signaling pathway assay measures increases or decreases in apoptosis or lysis of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases in stimulation of cytotoxic or cytostatic effect on cancer cells. as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases direct killing of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases Th17 activity as measured for an example by cytokine secretion or by proliferation or by changes in expression of activation markers. An increase in activity indicates immunostimulatory activity. Appropriate increases in activity are outlined below.

In one embodiment, the signaling pathway assay measures increases or decreases in induction of complement dependent cytotoxicity and/or antibody dependent cell-mediated cytotoxicity, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, T cell activation is measured for an example by direct killing of target cells like for an example cancer cells or by cytokine secretion or by proliferation or by changes in expression of activation markers like for an example CD137, CD107a, PD1, etc. For T-cells, increases in proliferation, cell surface markers of activation (e.g. CD25, CD69, CD137, PD1), cytotoxicity (ability to kill target cells), and cytokine production (e.g. IL-2, IL-4, IL-6, IFNγ, TNF-α, IL-10, IL-17A) would be indicative of immune modulation that would be consistent with enhanced killing of cancer cells.

In one embodiment, NK cell activation is measured for example by direct killing of target cells like for an example cancer cells or by cytokine secretion or by changes in expression of activation markers like for an example CD107a, etc. For NK cells, increases in proliferation, cytotoxicity (ability to kill target cells and increases CD107a, granzyme, and perforin expression), cytokine production (e.g. IFNγ and TNF), and cell surface receptor expression (e.g. CD25) would be indicative of immune modulation that would be consistent with enhanced killing of cancer cells.

In one embodiment, γδ T cell activation is measured for example by cytokine secretion or by proliferation or by changes in expression of activation markers.

In one embodiment, Th1 cell activation is measured for example by cytokine secretion or by changes in expression of activation markers.

Appropriate increases in activity or response (or decreases, as appropriate as outlined above), are increases of 10%, 20%, 30%, 40%, 50%, 60%, 70%, 80%, 90%, 95% or 98 to 99% percent over the signal in either a reference sample or in control samples, for example test samples that do not contain an antibody of the invention. Similarly, increases of at least one-, two-, three-, four- or five-fold as compared to reference or control samples show efficacy.

X. TREATMENTS

Once made, the compositions of the invention find use in a number of oncology applications, by treating cancer, generally by inhibiting the suppression of T cell activation (e.g. T cells are no longer suppressed) with the binding of the bispecific checkpoint antibodies of the invention.

Accordingly, the heterodimeric compositions of the invention find use in the treatment of these cancers.

XI. COMBINATION THERAPIES

In some embodiments, when the bispecific checkpoint does not include an anti-PD-1 antigen binding domain, the bispecific antibody can be co-administered with a separate anti-PD-1 antibody such as pembrolizumab (Keytruda®) or nivolumab (Opdivo®). Co-administration can be done simultaneously or sequentially, as will be appreciated by those in the art.

That is, a CTLA-4×LAG-3 bispecific checkpoint antibody disclosed herein, or such as any of those that incorporate anti-LAG-3 sequences and anti-CTLA-4 sequences from the sequence listing, and in particular XENP22602, XENP 22675, XENP22841 or XENP 22843, can be co-administered with an anti-PD-1 antibody.

Similarly, a BTLA×CTLA-4 bispecific checkpoint disclosed herein, or such as any of those that incorporate anti-BTLA sequences and anti-CTLA-4 sequences from the sequence listing, can be co-administered with an anti-PD-1 antibody.

A CTLA-4×TIM-3 bispecific checkpoint antibody such as any of those that incorporate anti-TIM-3 sequences and anti-CTLA-4 sequences from the sequence listing, can be co-administered with an anti-PD-1 antibody.

A CTLA-4 and TIGIT bispecific checkpoint antibody such as any of those that incorporate anti-CTLA-4 and anti-TIGIT sequences from the sequence listing, can be co-administered with an anti-PD-1 antibody.

A TIM-3 and LAG-3 bispecific checkpoint antibody such as any of those that incorporate anti-TIM-3 sequences and anti-LAG-3 sequences from the sequence listing, can be co-administered with an anti-PD-1 antibody.

A TIM-3 and TIGIT bispecific checkpoint antibody such as any of those that incorporate anti-TIM-3 sequences and anti-TIGIT sequences from the sequence listing, can be co-administered with an anti-PD-1 antibody.

A TIM-3 and BTLA bispecific checkpoint antibody such as any of those that incorporate anti-TIM-3 and anti-BTLA sequences from the sequence listing, can be co-administered with an anti-PD-1 antibody.

A LAG-3 and TIGIT bispecific checkpoint antibody such as any of those that incorporate anti-LAG-3 sequences and anti-TIGIT sequences from the sequence listing, can be co-administered with an anti-PD-1 antibody.

A LAG-3 and BTLA bispecific checkpoint antibody such as any of those that incorporate anti-LAG-3 sequences and anti-BTLA sequences from the sequence listing, can be co-administered with an anti-PD-1 antibody.

A TIGIT and BTLA bispecific checkpoint antibody such as any of those that incorporate anti-TIGIT sequences and anti-BTLA sequences from the sequence listing, can be co-administered with an anti-PD-1 antibody.

XII. ANTIBODY COMPOSITIONS FOR IN VIVO ADMINISTRATION

Formulations of the antibodies used in accordance with the present invention are prepared for storage by mixing an antibody having the desired degree of purity with optional pharmaceutically acceptable carriers, excipients or stabilizers (as generally outlined in Remington's Pharmaceutical Sciences 16th edition, Osol, A. Ed. [1980]), in the form of lyophilized formulations or aqueous solutions. Acceptable carriers, buffers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

Administrative Modalities

The antibodies and chemotherapeutic agents of the invention are administered to a subject, in accord with known methods, such as intravenous administration as a bolus or by continuous infusion over a period of time.

Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the bispecific antibodies used in the present invention depend on the disease or condition to be treated and may be determined by the persons skilled in the art.

An exemplary, non-limiting range for a therapeutically effective amount of an bispecific antibody used in the present invention is about 0.1-100 mg/kg.

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in US Publications 2015/0307629, 2014/0288275 and WO2014/145806, all of which are expressly incorporated by reference in their entirety and particularly for the techniques outlined therein.

A. Example 1: TILs from Multiple Cancer Types Co-Express Immune Checkpoint Receptors To investigate potential associations between PD-1, CTLA-4, LAG-3, and BTLA, RNA sequencing data from The Cancer Genome Atlas project (TCGA) were used for analysis. V2 RSEM data were downloaded from FireBrowse (http://firebrowse.org/). Analysis was performed using R with custom routines. The correlation between PD-1 and CTLA-4 expression is depicted in FIG. 66, along with calculated R2 values (FIG. 1; square of the Pearson correlation coefficient). FIG. 66 further shows the correlation between PD-1 and LAG-3 expression, PD-1 and BTLA expression, and LAG-3 and CTLA-4 expression.

FIG. 44 shows that PD-1 and CTLA-4 were co-expressed in cancers including bladder, breast, colon, prostate, melanoma, ovarian and lung cancer. shows that the sets PD-1 and CTLA-4, PD-1 and LAG-3, PD-1 and BTLA, and LAG-3 and CTLA-4 were co-expressed in cancers including bladder, breast, colon, head & neck, kidney, lung-adeno, lung squamous, ovarian, pancreatic, prostate, and melanoma cancer.

B. Example 2: Bispecific Immune Checkpoint Antibodies are Superior to Monospecific Immune Checkpoint Antibodies Prototype immune checkpoint antibodies (e.g. nivolumab and ipilimumab) and bispecific immune checkpoint antibodies based on the prototype antibodies were produced to demonstrate the effect of dual checkpoint blockades. Unless otherwise stated, bispecifics are named herein using the Fab variable region first and the scFv variable region second. Amino acid sequences for the prototype antibodies are listed in the sequence listing. DNA encoding the heavy and light chains were generated by gene synthesis (BLUE HERON BIOTECHNOLOGY, Bothell, Wash.), subcloned using standard molecular biology techniques into the expression vector pTT5 containing bivalent or bispecific constant regions and transiently transfected in HEK293E cells. Antibodies were purified by Protein A chromatography (and cation exchange chromatography for bispecific antibodies). Purity was assessed by size exclusion chromatography, analytical cation exchange chromatography and capillary isoelectric focusing.

1. Double-Positive Cells are Selectively Occupied by Bispecific Immune Checkpoint Antibodies Selective targeting of tumor-reactive TILs expressing multiple immune checkpoint receptors (as shown in Example 1) over non-tumor reactive T cells expressing single immune checkpoint receptors could enhance anti-tumor activity while avoiding peripheral toxicity (as depicted in FIG. 42).

An SEB-stimulated PBMC assay was used to investigate binding of bispecific immune checkpoint antibodies to T cells. The SEB-stimulated PBMC assay is an in vitro method for assaying T helper (TH) cell proliferation and for generating a population of cytotoxic T lymphocytes (CTLs). When PBMCs are stimulated with staphylococcal enterotoxin B (SEB), TH cell populations expand, followed by expansion of a CTL population. PBMCs were stimulated with 100 ng/mL SEB for 3 days and then treated with a prototype anti-LAG-3×anti-PD-1 bispecific antibody and a negative control (NUMAX® bivalent) for 30 minutes at 4° C. Following treatment, cells were incubated with APC-labelled one-arm anti-LAG-3 antibody, FITC-labelled one-arm anti-PD-1 antibody and BV605-labelled anti-CD3 antibody for 30 minutes at 4° C. Scatter plots of the CD3$^+$ T cells are depicted in FIG. 67. The data show that double-positive cells expressing both PD-1 and LAG-3 are selectively occupied by the anti-LAG-3×anti-PD-1 bispecific demonstrating that bispecific immune checkpoint antibodies selectively target T cells expressing multiple checkpoint receptors.

2. Anti-CTLA-4× Anti-PD-1 Bispecific Enhances IL-2 Response in a Mixed Lymphocyte Reaction Prototype immune checkpoint antibodies XENP16432 (nivolumab) and XENP16433 (ipilimumab), bispecific immune checkpoint antibody XENP16004 based on nivolumab and ipilimumab, and a one-arm (monospecific, monovalent) combination control were tested in a mixed-lymphocyte reaction (also known as a mixed-leukocyte reaction or MLR). The MLR is another in vitro method for assaying T helper (TH) cell proliferation and for generating a population of cytotoxic T lymphocytes (CTLs). When allogeneic (different MHC haplotype) lymphocytes are cultured together, TH cell populations expand, followed by expansion of a CTL population. Interleukin-2 (IL-2) secretion was used to monitor T cell activation.

Different sets of human PBMCs were purified from leukapheresis of different anonymous healthy volunteers (HemaCare, VanNuys, Calif.) using Ficoll-Paque™ Plus density gradients. PBMCs from two donors were mixed and then treated with 20 μg/mL of the indicated test articles. Supernatant was collected and concentration of IL-2 was measured using an IL-2 ELISA and data are shown in depicts the results of some anti-CTLA-4 Fab screening. This depicts the XENP code for the Fab and scFv embodiments, the designation of the vh and vl engineered domains, the KD binding constant against human and cyno CTLA-4 as measured by OCTET®, and the Tm of the scFv and Fab. Additionally, the number of sequence 9-mers that were an exact match to at least one human VH or VL germline are depicted as a measure of humanness for the variable regions of both Fabs and scFvs.

FIG. 25A. For each column, each data point is a separate reaction with a different donor-donor combination.

The data show that the prototype anti-PD-1×anti-CTLA-4 bispecific antibody enhanced IL-2 response to a greater extent than nivolumab and ipilimumab alone. Notably, the one-arm combination (each monovalent arm of the bispecific added separately) is inferior to the anti-PD-1×anti-CTLA-4 bispecific, suggesting more avid binding of the bispecific to double-positive PD-1+CTLA-4+ cells which is consistent with the finding depicted in FIG. 67 for an anti-LAG-3×anti-PD-1 bispecific antibody.

3. Additional Bispecific Immune Checkpoint Antibodies Enhance IL-2 Response in a Mixed Lymphocyte Reaction Additional prototype immune checkpoint antibodies and bispecific immune checkpoint antibodies directed towards additional immune checkpoint receptors were tested in a MLR assay as described above. Two sets of MLRs were created where 20 donors were targeting 1 recipient donor and another set of 20 donors targeting another 1 recipient donor totaling 40 MLR reactions. Reactions were incubated with 20 µg/mL of indicated test articles for 6 days. Data depicting fold increase of IL-2 and IFNγ (as assayed by ELISA) following treatment with the indicated test articles over treatment with anti-PD-1 bivalent (XENP16432) are shown in FIG. 32. The data show that additional bispecific immune checkpoint antibodies were also superior to nivolumab alone in activating T cells.

4. Triple Immune Checkpoint Blockade—Anti-PD-1 Bivalent and Anti-LAG-3× Anti-CTLA-4 Bispecific Antibodies are Synergistic in Enhancing IL-2 Response in an SEB-Stimulated PBMC Assay It was hypothesized that a triple immune checkpoint blockade such as with an anti-PD-1 bivalent and an anti-LAG-3×anti-CTLA-4 bispecific as depicted in FIG. 43 would provide additional benefit in enhancing T cell activation. To test the hypothesis, prototype immune checkpoint antibodies XENP16432 (nivolumab), prototype bispecific anti-LAG-3×anti-CTLA-4 immune checkpoint antibody XENP16430 based on 25F7 and ipilimumab, and a combination of XENP16432 and XENP16430 were tested in a SEB-stimulated PBMC assay.

Human PBMCs from multiple donors were stimulated with 10 ng/ml of SEB for 72 h with 20 µg/mL of indicated test articles. Following treatment, cell supernatants were assayed for IL-2 by ELISA. Data are shown in FIG. 33 for fold increase in IL-2 over NUMAX® ® bivalent. Each point indicates a donor represented in technical singlet.

The data show that the anti-LAG-3×anti-CTLA-4 bispecific checkpoint antibody (XENP16430) alone enhanced the IL-2 response relative to control (NUMAX® ® bivalent), although enhancement is lower than nivolumab (XENP16432) alone. However, the anti-CTLA-4×anti-LAG-3 bispecific in combination with nivolumab leads to significantly higher IL-2 response than either alone.

5. Blocking of Checkpoint Receptor/Ligand Interaction is Necessary for T Cell Activation Prototype anti-BTLA antibodies 4A7, E8D9 and 8D5 were screened for their ability to block BTLA interaction with its ligand HVEM using OCTET®, a BioLayer Interferometry (BLI)-based method. Experimental steps for OCTET® generally included the following: Immobilization (capture of ligand or test article onto a biosensor); Association (dipping of ligand- or test article-coated biosensors into wells containing serial dilutions of the corresponding test article or ligand); and Dissociation (returning of biosensors to well containing buffer) in order to determine the monovalent affinity of the test articles. A reference well containing buffer alone was also included in the method for background correction during data processing. 500 nM of each anti-BTLA antibody and 100 nM BTLA-Fc were incubated for over an hour. Anti-Penta-HIS (HIS1K) biosensors were used to capture HVEM-Fc-His and then dipped into antibody/BTLA mixture to measure residual BTLA/HVEM binding. As depicted in FIG. 35B, 8D5 did not block BTLA/HVEM interaction while 4A7 and E8D9 blocked BTLA/HVEM interaction.

The prototype anti-BTLA antibodies and anti-BTLA× anti-PD-1 bispecific antibodies with anti-BTLA Fab arms based on the prototype antibodies were tested in an SEB-stimulated PBMC assay. Specifically, human PBMCs were stimulated with 20 ng/mL of SEB for 72 hours with 20 µg/mL of indicated test articles. Following treatment, cell supernatant were assayed for IL-2 by ELISA. Data are shown in FIG. 35A for fold increase of IL-2 over NUMAX® bivalent (each point represents an individual PBMC donor tested in singlet). The data show that bispecific antibody with the non-blocking 8D5 anti-BTLA Fab arm induced IL-2 significantly less than nivolumab indicating that blocking the BTLA/HVEM interaction is necessary for enhancing T cell activation.

6. Bispecific Immune Checkpoint Antibodies Enhance Engraftment and Disease Activity in Human PBMC-Engrafted NSG Mice Bispecific checkpoint antibodies were evaluated in a Graft-versus-Host Disease (GVHD) model conducted in NSG (NOD-SCID-gamma) immunodeficient mice. When the NSG mice were injected with human PBMCs, the human PBMCs developed an autoimmune response against mouse cells. Treatment of NSG mice injected with human PBMCs followed by treatment with immune checkpoint inhibitors de-repress the engrafted T cells and enhances engraftment.

10 million human PBMCs were engrafted into NSG mice via IV-OSP on Day 0 followed by dosing with the indicated test articles (5 mg/kg or as indicated) on Day 1. CD45+ events were measured on Day 14 (FIG. 34). While the GVHD can be measured directly, increased CD45+ cell levels correlate with decreased body weight (depict a mixed lymphocyte reaction looking enhancement of IL-2 release by nivolumab (anti-PD-1 monoclonal antibody, marketed as Opdivo®) alone, ipilimumab alone (anti-CTLA-4 monoclonal antibody, marketed as Yervoy®), a prototype anti-CTLA-4×anti-PD-1 bispecific based on the nivolumab and ipilimumab arms, and a "one-armed" combination control. FIG. 26B) and are Predictive of Disease.

The data show that the bispecific checkpoint antibodies of the invention enhance proliferation of CD45+ cells in human PBMC-engrafted NSG mice as compared to control (PBS+PBMC). Further, enhancement is greater using antibodies of the invention than that seen with nivolumab (XENP16432) alone. Furthermore, the anti-CTLA-4×anti-LAG-3 bispecific (XENP16430) in combination with nivolumab yielded the highest engraftment levels consistent with the data in Example 2D.

C. Example 3: Hybridomas

1. Hybridoma Generation

To develop PD-1, LAG-3 and BTLA targeting arms for bispecific immune checkpoint antibodies of the invention, monoclonal antibodies were first generated by hybridoma technology through IMMUNOPRECISE®, either through their STANDARD METHOD or RAPID PRIME® METHOD.

For the Standard Method, antigen(s) was injected into 3 BALB/c mice. 7-10 days before being sacrificed for hybridoma generation, the immunized mice received an antigen boost. Antibody titre is evaluated by ELISA on the antigen and the best responding mice are chosen for fusion. A final antigen boost is given 4 days prior to fusion. Lymphocytes from the mice are pooled, purified then fused with SP2/0 myeloma cells. Fused cells are grown on HAT selective Single-Step cloning media for 10-12 days at which point the hybridomas were ready for screening.

For the RAPID PRIME® method, antigen(s) was injected into 3 BALB/c mice. After 19 days, lymphocytes from all the mice are pooled, purified then fused with SP2/0 myeloma cells. Fused cells are grown on HAT selective Single-Step cloning media for 10-12 days at which point the hybridomas were ready for screening.

For generation of anti-PD-1 hybridomas, the STANDARD and RAPID PRIME® methods were used and the antigen(s) used were mouse Fc fusion of human PD-1 (huPD-1-mFc), mouse Fc fusion of cyno PD-1 (cynoPD-1-mFc), His-tagged human PD-1 (huPD-1-His), His-tagged cyno PD-1 (cynoPD-1-His) or mixtures thereof For generation of anti-BTLA hybridomas, the Standard and RAPID PRIME® methods were used and antigen used were mouse Fc fusion of human BTLA (huBTLA-mFc), mouse Fc fusion of cyno BTLA (cynoBTLA-mFc), His-tagged human BTLA (huBTLA-His), or mixture of huBTLA-mFc and cynoBTLA-mFc.

For generation of anti-LAG-3 hybridomas, the RAPID PRIME® method was used and antigen used were mouse Fc fusion of human LAG-3 (huLAG-3-mFc), mouse Fc fusion of cyno LAG-3 (cynoLAG-3-mFc), His-tagged human LAG-3 (huLAG-3-His), mixture of huLAG-3-mFc and cynoLAG-3-mFc, or mixture huLAG-3-His and cynoLAG-3-His.

For generation of anti-TIM-3 hybridomas, the Standard and RAPID PRIME® methods were used and antigen(s) used were mouse Fc fusion of human TIM-3 (huTIM-3-mFc), mouse Fc fusion of cyno TIM-3 (cynoTIM-3-mFc), His-tagged human TIM-3 (huTIM-3-His), His-tagged cyno TIM-3 (cynoTIM-3-His) or mixtures thereof.

2. Screening Anti-PD-1 Hybridoma Clones

Anti-PD-1 hybridoma clones generated as described above were subject to two rounds of screening using OCTET®®. For the first round, anti-mouse Fc (AMC) biosensors were used to capture the clones with dips into 500 nM of bivalent human and cyno PD-1-Fc-His. For the second round, clones identified in the first round that were positive for both human and cyno PD-1 were captured onto AMC biosensors and dipped into 500 nM monovalent human and cyno PD-1-His. Sequences for exemplary anti-PD-1 antibodies are in the sequence listing.

3. Screening Anti-BTLA Hybridoma Clones

Anti-BTLA hybridoma clones generated as described above were subject to two rounds of screening using OCTET®. For the first round, AMC biosensors were used to capture the clones with dips into multiple concentrations of human and cyno BTLA-His to determine KD. For the second round, a blocking assay was used to identify clones which blocked BTLA/HVEM interaction. Anti-Penta-HIS (HIS1K) biosensors were used to capture HVEM-Fc-His and dipped into 25 nM BTLA-Fc alone or 25 nM BTLA-Fc+1:1 dilution of hybridoma samples to measure residual BTLA/HVEM binding. Sequences for exemplary anti-BTLA antibodies are in the sequence listing.

4. Screening Anti-LAG-3 Hybridoma Clones

Anti-LAG-3 hybridoma clones generated as described above were subject to several rounds of screening to identify clones with high affinity, which block LAG-3 binding to Ramos cells endogenously expressing MHC-II, and which bind a different epitope than 25F7 mAb.

Affinity was determined using OCTET®. AMC biosensors were used to capture clones with dips into single concentration of human LAG-3-Fc and cyno LAG-3-Fc. To identify clones which block LAG-3/MHC-II interaction, 1 μg of human LAG-3-hIg in 10 μL was mixed with 50 μL of hybridoma supernatant (diluted 2-fold, 8 times in RPMI media with 10% FBS) for 20 minutes at room temperature. 40 μL of Daudi or Ramos cells (which endogenously express MHC-II) were added and incubated at 4° C. for 30 minutes. The cells were then washed and incubated with anti-human-Fc-Alexa647 secondary antibody for 30 minutes. Cells were then washed and analyzed by FACS for Alexa647. The data is depicted in FIG. 62. To identify clones which bind a different epitope than 25F7 mAb, AMC biosensors were used to capture clones with dips into 100 nM human LAG-3-hFc or 100 nM LAG-3-hFc with 500 nM 25F7 to measure residual binding. Sequences for exemplary anti-LAG-3 antibodies are in the sequence listing.

5. Screening Anti-TIM-3 Hybridoma Clones

Anti-TIM-3 hybridoma clones generated as described above were subject to two rounds of screening. The first round was divided into screens for IgG samples and IgM clones. For IgG clones, AMC biosensors were used to capture the clones and were dipped into multiple concentrations of human and cyno TIM-3-His. For IgM clones, anti-IgM mAbs were coupled using AR2G onto biosensors which were dipped into multiple concentrations of human and cyno TIM-3-His. None of the IgM samples produced binding signals higher than baseline. Following the first round of screening, IgG clones which bound both human and cyno TIM-3 were rescreened with bivalent versions of bivalent human and cyno TIM-3-Fc. Sequences for exemplary anti-TIM-3 antibodies are in the sequence listing.

Several of the clones were chimerized and assessed for T cell binding in an SEB-stimulated PBMC assay. Human PBMCs were stimulated with 100 ng/mL SEB for 3 days. Following stimulation, cells were treated with indicated test articles for 30 minutes at 4 degrees. Binding on $CD3^+$ cells was detected with an anti-human-Fc secondary antibody and depicted in FIG. 21.

6. Component Antibody Domains Derived from Hybridomas Block Checkpoint Receptor/Ligand Interactions As described in Example 2E, blocking of checkpoint receptor/ligand interaction is necessary for T cell activation. The blocking ability of exemplary antibodies comprising domains derived from hybridomas were investigated using either cell binding assays or OCTET® as depicted in are graphs showing that component antibody domains of the subject antibodies provided herein are capable of blocking checkpoint receptor/ligand interactions. In particular, a bispecific antibody comprising a 1G6 anti-PD-1 scFv arm is capable of blocking PD-1/PD-L1 and PD-1/PD-L2 interactions; 7G8 anti-LAG-3 one arm is capable of blocking LAG-3/MHC II interaction; a bispecific antibody comprising an exemplary anti-PD-1 Fab arm is capable of blocking CTLA-4/CD80 and CTLA-4/CD86 interactions; and a bispecific antibody comprising a 9C6 anti-BTLA Fab arm is capable of blocking BTLA/HVEM interaction.

FIG. 68.

Incubation of HEK293T exogenously expressing PD-1 with XENP20717 prevented binding by PD-L1 and PD-L2 to PD-1 in a dose dependent manner. Incubation of LAG-3 with XENP22606 prevented its binding to Daudi cells endogenously expressing MHC-II. Incubation of CTLA-4 with XENP20066 prevented residual binding to CD80 and CD86. Incubation of BTLA with XENP20895 prevented residual binding to HVEM.

D. Example 4: Affinity and Stability Optimization

1. Anti-PD-1 mAbs 1G6 and 2E9

The anti-PD-1 hybridoma clones 1G6 and 2E9 generated in Example 3 were engineered to have optimal affinity and stability in the context of scFv or Fab for use in a bispecific immune checkpoint inhibitor. The clones were first humanized using string content optimization (see, e.g., U.S. Pat. No. 7,657,380, issued Feb. 2, 2010). DNA encoding the heavy and light chains were generated by gene synthesis (Blue Heron Biotechnology, Bothell, Wash.) and subcloned using standard molecular biology techniques into the expression vector pTT5. The C-terminus of the scFv included a polyhistidine tag. A library of Fv variants was constructed by standard mutagenesis (QUIKCHANGE®, STRATAGENE®, Cedar Creek, Tx®) in the full-length bivalent, Fab-His and/or scFv-His formats. Bivalent mAbs were purified by standard protein A chromatography and Fab-His and scFv-His were purified by Ni-NTA chromatography. Sequences for exemplary 1G6 and 2E9 bivalent antibodies, Fabs and scFvs of the invention are listed in the sequence listing (although the polyhistidine tags have been removed for Fabs and scFvs). After the initial screen, combinations were made of variants of interest, and these were expressed, purified, and re-examined for affinity and stability.

Affinity screens of bivalent antibodies were performed using OCTET®. Anti-human Fc (AHC) biosensors were used to capture the test articles and dipped in multiple concentrations of PD-1-His for KD determination. Stability of scFv-His were evaluated using Differential Scanning Fluorimetry (DSF). DSF experiments were performed using a BIO-RAD® CFX® CONNECT REAL-TIME PCR DETECTION SYSTEM. Proteins were mixed with SYPRO® Orange fluorescent dye and diluted to 0.2 mg/mL in PBS. The final concentration of SYPRO® Orange was 10×. After an initial 10 minute incubation period of 25° C., proteins were heated from 25 to 95° C. using a heating rate of 1° C./min. A fluorescence measurement was taken every 30 sec. Melting temperatures (Tm) were calculated using the instrument software. The affinity and stability results are shown in FIG. 23.

2. Anti-CTLA-4 mAb

The parental variable region of an anti-CTLA-4 antibody was engineered for use as a component of various bispecifics. Two approaches were taken to attempt to identify variants with improved properties: (1) single, double, and triple amino acids substitutions were made via QUIKCHANGE® (STRATAGENE®, Cedar Creek, Tx®) mutagenesis, and (2) re-grafted sequences with their framework exchanged with alternative human germlines (IGHV3-7, IGHV3-13, IGHV3-21, IGHV3-64, IGKV3D-20, IGKV3-15) were constructed by DNA synthesis and subcloning. Variant Fabs and scFvs were designed, expressed, and purified. Affinities for human and cyno CTLA-4 were measured for Fabs using OCTET®. AHC biosensors were used to capture Fc fusions of human or cyno CTLA-4 and dipped into multiple concentrations of Fab test articles for KD determination. Thermal stabilities were measured for both Fabs and scFvs using DSF. Additionally, the number of sequence 9-mers that were an exact match to at least one human VH or VL germline were counted as a measure of humanness (see, e.g., U.S. Pat. No. 7,657,380, issued Feb. 2, 2010) for the variable regions of both Fabs and scFvs. After the initial screen, combinations were made of variants of interest, and these were expressed, purified, and re-examined for affinity and stability. Results are summarized in FIG. 24. Several variants possessed increased thermal stability over that of the parental variable region while retaining a similar affinity for both human and cyno CTLA-4. Additionally, increases in sequence humanness as measured by the number of human germline matching sequence 9-mers were identified for several variants. Preferred variants include: H0.25_L0, H0.26_L0, H0.27_L0, H0.29_L0, H0.38_L0, H0.39_L0, H0.40_L0, H0.70_L0, H0_L0.22, H2_L0, H3_L0, H3_L0.22, H3_L0.67, H3_L0.74, H3_L0.44, H3.4_L0.118, H3.4_L0.119, H3.4_L0.120, H3.4_L0.121, H3.4_L0.122, H3.4_L0.123, H3.4_L0.124, H3.4_L0.125, H3.4_L0.126, H3.4_L0.127, H3.4_L0.128, H3.4_L0.129, H3.4_L0.130, H3.4_L0.131, H3.4_L0.132, H3.5_L2.1, H3.5_L2.2, H3.5_L2.3, H3.21_L0.124, H3.21_L0.129, H3.21_L0.132, H3.23_L0.124, H3.23_L0.129, H3.23_L0.132, H3.25_L0.124, H3.25_L0.129, and H3.25_L0.132.

3. Anti-BTLA mAb 9C6

The anti-BTLA hybridoma clone 9C6 generated in Example 3 was humanized and engineered to have optimal affinity and stability in bivalent antibody format as generally described above in Example 4A. Sequences for exemplary anti-BTLA bivalent antibodies of the invention are listed in the sequence listing.

Affinity screens for the variant bivalent antibodies were performed using OCTET®. AHC biosensors were used to capture the test articles and dipped into wells with multiple concentrations of BTLA-His for KD determination (shown in A and B show that anti-BTLA×anti-PD-1 chimeric bispecific promotes IFNγ secretion from SEB stimulated PBMCs. PBMCs were stimulated with 10 ng/mL SEB for 3 days with indicated test articles. Cell supernatants were collected and assayed with MSD for indicated analyte. A: 20 µg/mL test article; B 5 µg/mL test article.

FIG. 52).

4. Anti-LAG-3 mAbs 7G8 and 2A11

The anti-LAG-3 hybridoma clones 7G8 and 2A11 generated in Example 3 were humanized and engineered to have optimal affinity and stability in the context of a Fab for use in a bispecific immune checkpoint inhibitor as generally described above in Example 4A. Sequences for exemplary anti-LAG-3 bivalent antibodies and Fabs of the invention are listed in the sequence listing.

Affinity and stability for variant anti-LAG-3 Fabs were determined as generally described above in Example 4A. AMC biosensors were used to capture mouse Fc fusions of human LAG-3 and dipped into wells containing multiple concentrations of the test articles to determine KD. The results are shown in FIG. 53 for 2A11 variants and FIG. 54 for 7G8 variants.

Exemplary variant 2A11 and 7G8 anti-LAG-3 bivalent antibodies were further screened for their ability to block LAG-3 binding to Daudi cells endogenously expressing MHC-II. 1 µg of LAG-3-mFc was mixed with indicated concentrations of mAb for 30 minutes at room temperature. Daudi cells were then added and incubated for 30 minutes at 4° C. LAG-3-mFc binding was detected with an anti-murine-Fc secondary antibody. The data is depicted in FIG. 63.

5. Anti-TIM-3 mAbs

Anti-TIM-3 hybridoma clones generated in Example 3 were humanized and engineered to have optimal affinity and stability in bivalent antibody format as generally described above in Example 4A. Sequences for exemplary anti-TIM-3 bivalent antibodies of the invention are listed in the sequence listing.

Affinity screens for the variant bivalent antibodies were performed using OCTET®. AHC biosensors were used to capture the test articles and dipped into wells with multiple concentrations of TIM-3-His for KD determination (shown in FIG. 22).

Optimized variants were also tested for T cell binding in an SEB-stimulated PBMC assay. Human PBMCs were stimulated with 100 ng/mL SEB for 72 hours. Following stimulation, cells were treated with the indicated test articles. Binding of 3H3_H1_L2.1 (XENP21189) on CD3+ cells was detected with an anti-human-Fc secondary antibody and depicted in FIG. 21. Binding of 7B11_HJ1_L1.1 (XENP21196) on CD3+ cells was detected with an anti-human-IgG-APC secondary antibody and depicted in FIG. 21.

6. Affinity Screens of Variant Anti-LAG-3× Anti-CTLA-4 Fab-scFv Bispecific Antibodies Bispecific antibodies comprising anti-LAG-3 Fabs derived from the optimized anti-LAG-3 bivalent antibodies described in Example 4D and an exemplary anti-CTLA-4 scFv described in Example 4B were screened for affinity using OCTET® as generally described above. Specifically, AMC or HIS1K biosensors were used to capture mouse Fc fusion of human LAG-3 or His-Avi tagged TEV-Fc fusion of human LAG-3 and dipped into well containing the test articles to determine KD. Results are shown in FIG. 55.

7. Affinity Screens of Variant Anti-LAG-3× Anti-PD-1 Fab-scFv Bispecific Antibodies.

Bispecific antibodies comprising anti-LAG-3 Fabs derived from the optimized anti-LAG-3 bivalent antibodies described in Example 4D and an exemplary anti-PD-1 scFv described in Example 4A were screened for affinity using OCTET® as generally described above. Specifically, AMC or HIS1K biosensors were used to capture mouse Fc fusion of human LAG-3 or His-Avi tagged TEV-Fc fusion of human LAG-3 and dipped into well containing the test articles to determine KD. Results are shown in FIG. 61.

E. Example 5: In Vitro Assessment of Bispecific Immune Checkpoint Antibodies with Affinity and Stability Optimized Arms 1. Anti-PD-1× Anti-CTLA-4 Bispecific Antibodies a. Bispecific Anti-PD-1× Anti-CTLA-4 Bispecific Antibody Blocks PD-1 Interaction with PD-L1 and PD-L2

HEK293T cells expressing PD-1 were incubated with incubated with XENP20717 (anti-PD-1×anti-CTLA-4) and one-arm anti-PD-1 and anti-CTLA-4 controls (respectively XENP20111 and XENP20059) for 30 minutes at 4° C. Following incubation, PD-L1-mFc or PD-L2-mFc was added and allowed to further incubate for 30 minutes at 4° C. PD-L1-mFc and PD-L2-mFc were detected with anti-murine-IgG secondary antibody.

FIG. 45 show that XENP20717 was able to block the binding of PD-1 to ligands PD-L1 and PD-L2 in a dose dependent manner. XENP20111 was also able to block the binding of PD-1 to ligands PD-L1 and PD-L2, while XENP20559 did not block PD-1 binding to its ligands.

b. T Cell Binding of Bispecific Anti-CTLA-4× Anti-PD-1 Bispecific Antibody on CD3$^+$ Cells Human PBMCs were stimulated with 500 ng/mL SEB for 3 days, washed twice in culture medium and then re-stimulated with 500 ng/mL SEB for an additional 24 hours. The PBMCs were then treated with XENP20717 (anti-CTLA-4×anti-PD-1) for 30 minutes at 4° C. Following treatment, PBMCs were washed and incubated with anti-human-Fc-(Fab fragment specific)-APC secondary antibody (Jackson Labs) on CD3$^+$ cells with an anti-CD3-FITC (UCHT1) mAb. PBMCs were then washed twice and analyzed by flow cytometry. FIG. 45 depicts the average MFI of 7 unique PBMC donors and shows binding of XENP20717 on CD3+ T cells and that binding was in a dose-dependent manner.

c. Assessment of Variant Anti-CTLA-4× Anti-PD-1 Bispecifics on T Cell Activation Anti-CTLA-4×anti-PD-1 bispecific antibodies with variant anti-CTLA-4 Fab arms were tested in an MLR assay. Mixed PBMCs were treated with 69.5 nM of bivalent antibodies (e.g. nivolumab) or 139 nM of bispecific antibodies (e.g. XENP16004) for equimolar PD-1 binding concentrations. The data depicted in depicts the results of some anti-CTLA-4 Fab screening. This depicts the XENP code for the Fab and scFv embodiments, the designation of the vh and vl engineered domains, the KD binding constant against human and cyno CTLA-4 as measured by OCTET®, and the Tm of the scFv and Fab. Additionally, the number of sequence 9-mers that were an exact match to at least one human VH or VL germline are depicted as a measure of humanness for the variable regions of both Fabs and scFvs.

FIG. 25B show that a number of the bispecific antibodies enable IL-2 induction superior to nivolumab alone.

In an SEB-stimulated PBMC assay, PBMCs were treated with 500 ng/mL SEB for 2 days. Cells were then washed and treated with 20 µg/mL of XENP16432 (nivolumab) or XENP20717 and 500 ng/mL SEB. Supernatant was assayed for IL-2 as an indicator of T cell activation. The data depicted in FIG. 69 show that the anti-CTLA-4×anti-PD-1 bispecific induces significantly more IL-2 release than nivolumab alone.

In another study, XENP16432, XENP20717 and one-arm combination control were tested in an SEB-stimulated PBMC assay. PBMCs were stimulated with 500 ng/mL SEB for 2 days. Cells were then washed once with PBS and then culture medium with 20 µg/mL of indicated test articles and 500 ng/mL SEB was added. Supernatants were collected after 24 hours and assayed for IL-2. In a control experiment without SEB stimulation, PBMCs were treated with indicated test articles for 3 days before supernatant was assayed for IL-2. The fold-change in IL-2 concentration is depicted in FIG. 45A-C. As shown in FIG. 45B, XENP20717 enhanced IL-2 secretion significantly more than nivolumab did. The data show that XENP20717 activates T cells more potently than both anti-PD-1 bivalent alone as well as a combination of one-arm anti-PD-1 and one-arm anti-CTLA-4 demonstrating the advantage of selectively activating T cells expressing multiple immune checkpoint receptors. Notably, and consistent with the findings described in Example 2B, the bispecific XENP20717 enhanced IL-2 secretion to a greater extent than did the combination of one-arm antibodies derived from XENP20717.

An additional bispecific antibody targeting CTLA-4 and PD-1 with an anti-CTLA-4 scFv arm and a variant 2E9 anti-PD-1 Fab arm and control test articles were tested in an SEB-stimulated PBMC assay. Human PBMCs were stimulated with 100 ng/mL SEB for 2 days. Cells were washed and restimulated with 100 ng/mL SEB in combination with 20 µg/mL of the indicated test articles. Supernatants were assayed for IL-2 and IFNγ 24 hours after treatment (depicted respectively in FIGS. 19A and B).

2. In Vitro Assessment of Anti-LAG-3× Anti-PD-1 Bispecific Checkpoint Antibodies a. Assessment of Variant Anti-LAG-3× Anti-PD-1 Bispecifics on T Cell Activation In an SEB-stimulated PBMC assay, PBMCs were treated with 500 ng/mL SEB for 2 days. Cells were then washed and treated with 20 µg/mL of XENP16432 (nivolumab) or XENP22604 and 500 ng/mL SEB. Supernatant was assayed for IL-2 as an indicator of T cell activation (depicted in FIG. 69).

Additional anti-LAG-3×anti-PD-1 bispecific antibodies with optimized 2A11 anti-LAG-3 Fab arms (derived from variant mAbs generated as described in Example 4) were also assessed for T cell activation in an SEB-stimulated PBMC assay. Human PBMCs from multiple donors were stimulated with 500 ng/ml of SEB for 2 days. Cells were then washed twice in culture medium and stimulated with 500 ng/mL SEB in combination with 10 µg/mL of indicated test articles. 24 hours after treatment, cell supernatants were assayed for IL-2 and IFNγ. Data are shown in FIG. 64 for fold increase in IL-2 and IFNγ over NUMAX® bivalent. Each point indicates a donor represented in technical singlet.

The data shows that a number of the anti-LAG-3×anti-PD-1 bispecific antibodies activate T cells more potently than either nivolumab alone or anti-LAG-3 bivalent alone.

3. In Vitro Assessment of Anti-BTLA× Anti-PD-1 Bispecific Checkpoint Antibodies a. T Cell Binding of Bispecific Anti-BTLA× Anti-PD-1 Bispecific Antibodies on CD3+ Cells Anti-BTLA×anti-PD-1 bispecific antibodies with optimized anti-BTLA Fab arms (derived from variants mAbs generated as described in Example 4) were assessed for binding on T cells. Human PBMCs were stimulated with 100 ng/mL SEB for 3 days, after which the PBMCs were treated with the indicated test articles for 30 minutes at 4° C. PBMCs were then incubated with anti-human-Fc secondary antibody for 30 minutes at 4° C. FIG. 47 shows the binding of the indicated test articles on CD3+ cells.

The data show that the anti-PD-1×anti-BTLA bispecific checkpoint antibodies of the invention (e.g. XENP20895, XENP21220 and XENP21221) bind more avidly to T-cells compared to one-armed controls (e.g. XENP21446 and XENP16011). This demonstrates that binding to human T cells is generally better with bispecific antibodies, each arm monovalently binding a different antigen, than monovalent, monospecific antibodies such as the one-armed controls.

b. Assessment of Variant Anti-BTLA× Anti-PD-1 Bispecifics on T Cell Activation

Anti-BTLA×anti-PD-1 bispecific antibodies with prototype anti-BTLA (e.g. 4C7, 8D5 and E8D9) and 9C6 Fab arms were assessed for T cell activation in an SEB-stimulated PBMC assay. Human PBMCs from multiple donors were stimulated with 10 ng/ml of SEB for 72 h with 5 µg/mL or 20 µg/mL as indicated of test articles. Following treatment, cell supernatants were assayed for IL-2 and IFNγ by ELISA, depicted respectively in FIGS. 1J and 1K. The data show that bispecific antibodies comprising the 9C6 hybridoma derived arm enhanced T cell activation not only greater than anti-PD-1 bivalent alone did but also greater than did the bispecifics with the prototype anti-BTLA Fab arms.

An exemplary anti-BTLA×anti-PD-1 XENP21220 and XENP16432 (nivolumab) were assessed in an SEB-stimulated PBMC assay. PBMCs were treated with 500 ng/mL SEB for 2 days. Cells were then washed and treated with 20 µg/mL of XENP16432 or XENP21220 and 500 ng/mL SEB. Supernatant was assayed for IL-2 as an indicator of T cell activation (depicted in FIG. 69).

Additional anti-BTLA×anti-PD-1 bispecifics with variant 9C6 anti-BTLA Fab arms and one-arm variant 9C6 antibodies (alone and in combination with one-arm anti-PD-1 antibody) were assessed for T cell activation in an SEB-stimulated PBMC assay as described above. Data are shown in FIG. 1L for fold increase in IL-2 and IFNγ secretion over treatment with PBS.

4. In Vitro Assessment of Anti-LAG-3× Anti-CTLA-4 Bispecific Checkpoint Antibodies a. T Cell Binding of Bispecific Anti-BTLA× Anti-PD-1 Bispecific Antibodies on CD3+ Cells Anti-LAG-3×anti-CTLA-4 bispecifics with variant anti-LAG-3 Fab arms and one-arm variant anti-LAG-3 antibodies were assessed for binding on T cells. Human PBMCs were stimulated with 100 ng/mL SEB for 3 days, after which the PBMCs were treated with the indicated test articles for 30 minutes at 4° C. Following treatment, PBMCs were incubated with anti-CD3-FITC and anti-human-Fc-APC antibodies for 30 minutes at 4° C. PBMCs were then washed twice and analyzed by flow cytometry. FIG. 56 shows the binding of the indicated test articles on CD3+ T cells.

The data show that a number of the anti-LAG-3×anti-CTLA-4 bispecific checkpoint antibodies of the invention (e.g. XENP22505 and XENP21896) bind more avidly to T-cells compared to one-armed controls (e.g. XENP22516). This demonstrates that binding to human T cells can be better with bispecific antibodies, each arm monovalently binding a different antigen, than monovalent, monospecific antibodies such as the one-armed controls.

b. T Cell Activation by Anti-LAG-3× Anti-CTLA-4 Bispecific Antibodies

Anti-LAG-3×anti-CTLA-4 bispecific antibodies were assessed for T cell activation in MLR and SEB-stimulated PBMC assays.

40 MLR reactions were made in the presence of 20 µg/mL of the indicated test articles, and cell supernatant were assayed 6 days after treatment for IL-2 and IFNγ. FIG. 59 depicts fold induction in IL-2 and IFNγ over anti-RSV bivalent (XENP15074).

In an SEB-stimulated PBMC assay, PBMCs were treated with 500 ng/mL SEB for 2 days. Cells were then washed and treated with 20 µg/mL of XENP16432 (nivolumab), XENP22602 or a combination of XENP16432 and XENP22602 and 500 ng/mL SEB. Supernatant was assayed for IL-2 as an indicator of T cell activation (depicted in FIG. 69).

In another SEB-stimulated PBMC assays, additional anti-LAG-3×anti-CTLA-4 bispecific were assessed. Human PBMCs from multiple donors were stimulated with 500 ng/ml of SEB for 2 days. Cells were then washed twice in culture medium and stimulated with 500 ng/mL SEB in combination with 20 µg/mL of indicated test articles. 24 hours after treatment, cell supernatants were assayed for IL-2 and IFNγ. Data are shown in FIG. 57 and FIG. 58 and FIG. 60 for fold increase in IL-2 and IFNγ over NUMAX® bivalent. Each point indicates a donor represented in technical singlet.

The data is consistent with Example 2D in showing that a combination of anti-PD-1 bivalent and anti-LAG-3× anti-CTLA-4 bispecific exerts synergistic effect in T cell activation. Further, the data show that 7G8 based anti-LAG-3×anti-CTLA-4 bispecific antibodies exhibit more selective function on PBMCs than 2A11 based anti-LAG-3×anti-CTLA-4 bispecific antibodies F. Example 6: In Vivo Assessment of Bispecific Immune Checkpoint Antibodies 1. Anti-CTLA-4× Anti-PD-1 Bispecifics Enhance Engraftment and Disease Activity in Human PBMC-Engrafted NSG Mice In several GVHD studies, exemplary anti-CTLA-4×anti-PD-1 bispecific antibodies of the invention were shown to enhance engraftment and disease activity in human PBMC-engrafted NSG mice.

In a first study, 10 million human PBMCs were engrafted into NSG mice via IV-OSP on Day 0. On day 1, the mice were dosed with XENP16432 (2.89 mg/kg), XENP20053 (2 mg/kg) and a combination of XENP16432 and XENP16433 (2.89+2.92 mg/kg). CD45+ cell counts were measured on Day 14 (depicted in FIG. 70).

Additional anti-CTLA-4×anti-PD-1 bispecifics with variant anti-CTLA-4 Fab and anti-PD-1 scFv arms were assessed. 10 million human PBMCs were engrafted into NSG mice via IV-OSP on Day 0 followed by dosing with the indicated test articles (5 mg/kg or as indicated) on Day 1. CD45+ cell counts were measured on Day 14 (FIG. 1QA, FIG. 1RA and FIG. 1S). IFNγ levels were also measured as an additional indicator of GVHD and plotted against CD45+ cell levels (depicts mixed lymphocyte reaction looking at enhancement of IL-2 release by anti-CTLA-4×anti-PD-1 bispecific antibodies with variant anti-CTLA-4 Fab arms and variant anti-PD-1 scFv arms, as well as nivolumab alone, ipilimumab alone, and a prototype anti-CTLA-4× anti-PD-1 bispecific based on the nivolumab and ipilimumab arms as controls.

FIG. 27 and FIG. 30).

The data show that the anti-PD-1×anti-CTLA-4 bispecific checkpoint antibodies of the invention enhance proliferation of CD45+ cells in human PBMC-engrafted NSG mice as compared to control (PBS+PBMC). Further, enhancement is greater using antibodies of the invention than that seen with nivolumab (XENP16432) alone. FIG. 31 shows the comparison of test article effect on CD45+ cell proliferation between studies 160314 (presented in FIG. 26) and 160331 (presented in FIG. 29). Both studies consistently demonstrate superiority of anti-PD-1×anti-CTLA-4 bispecific checkpoint antibodies over nivolumab alone.

In another study, an anti-CTLA-4×anti-PD-1 bispecific antibody with Xtend Fc was assessed. PBMC-engrafted mice were dosed with indicated test articles at indicated concentrations and CD45+, CD4+ and CD8+ events were measured on Day 14 (depicted in FIG. 20).

2. Anti-BTLA× Anti-PD-1 Bispecifics Enhance Engraftment and Disease Activity in Human PBMC-Engrafted NSG Mice In a first study, 10 million human PBMCs were engrafted into NSG mice via IV-OSP on Day 0. On day 1, the mice were dosed with XENP16432 (2.89 mg/kg) and XENP20895 (5 mg/kg). CD45+ cell counts were measured on Day 14 (depicted in FIG. 70).

Anti-BTLA×anti-PD-1 bispecific XENP20895 was assessed in a second GVHD study. 10 million human PBMCs were engrafted into NSG mice via IV-OSP on Day 0 followed by dosing with the indicated test articles (at concentrations as indicated) on Day 1. CD45+ cell counts and IFNγ were measured on Days 10, 14 and 22 (depicted respectively in FIG. 51).

3. Anti-LAG-3× Anti-PD-1 Bispecifics Enhance Engraftment and Disease Activity in Human PBMC-Engrafted NSG Mice In a GVHD, 10 million human PBMCs were engrafted into NSG mice via IV-OSP on Day 0. On day 1, the mice were dosed with XENP16432 (2.89 mg/kg) and XENP22672 (5 mg/kg). CD45+ cell counts were measured on Day 14 (depicted in FIG. 70).

In the second study described in Example 6A, another exemplary anti-LAG-3×anti-PD-1 (XENP22847) was also assessed (FIG. 20C).

4. Anti-LAG-3× Anti-CTLA-4 Bispecifics Enhance Engraftment and Disease Activity in Human PBMC-Engrafted NSG Mice In a GVHD, 10 million human PBMCs were engrafted into NSG mice via IV-OSP on Day 0. On day 1, the mice were dosed with XENP16432 (2.89 mg/kg), XENP22675 (5 mg/kg) and a combination of XENP16432 and XENP22675 (5+5 mg/kg). CD45+ cell counts were measured on Day 14 (depicted in FIG. 70).

The data shows that XENP22675 enhances engraftment and disease activity over dosing with nivolumab alone. Notably, XENP22675 in combination with nivolumab acts synergistically to further enhance engraftment.

G. Example 7: Anti-PD-1× Anti-CTLA-4 Bispecific Antibodies Exhibit Anti-Tumor Activity in NSG Mice Engrafted with KG1A-Luc Cancer Cells and Human PBMCs NOD SCID gamma (NSG) mice were engrafted with KG1A-luc cancer cells on Day 0. On Day 21, human PBMCs were engrafted into the intraperitoneally into the mice. After PBMC engraftment, indicated test articles were dosed weekly by intraperitoneal injection (control mice were dosed with PBS). Tumor growth was monitored by measuring total flux per mouse using an in vivo imaging system (IVIS® Lumina III) and data are shown (days post 1st dose) in FIG. 71.

XIII. INCORPORATION BY REFERENCE

The claim sets from "Anti-CTLA-4", claim set A1 to A30, "Anti-PD-1", claim set B1 to B30, "Anti-LAG-3", claim set C1 to C28, "Anti-TIM-3", claim set D1 to D28, "Anti-TIGIT", claim set E1 to E28, "Anti-BTLA" claim set F1 to F28, "Backbone plus Fvs", claim set Y1 to Y5, and "Specific molecules", claim set X1 to X16, from U.S. Ser. No. 62/420,500 are expressly incorporated by reference in their entirety.

SEQUENCE LISTING (39181 sequences)

SEQ ID NO: 1 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 2 - protein, 150 aa, Homo sapiens [sequence omitted]

SEQ ID NO: 3 - protein, 288 aa, Macaca fascicularis
MQIPQAPWPVVWAVLQLGWRPGWFLESPDRPWNAPTFSPALLLVTEGDNATFTCSFSNASESFVLNWYRMSPSNQTDKLAAFPEDRSQPGQDCRFRVTRLPNGRDFHMSVVRARRNDSGTYLCGAISLAPKAQIKESLRAELRVTERRAEVPTAHPSPSPRPAGQFQALVVGVVGGLLGSLVLLVWVLAVICSRAAQGTIEARRTGQPLKEDPSAVPVFSVDYGELDFQWREKTPEPPAPCVPEQTEYATIVFPSGLGTSSPARRGSADGPRSPRPLRPEDGHCSWPL

SEQ ID NO: 4 - protein, 150 aa, Macaca fascicularis
PGWFLESPDRPWNAPTFSPALLLVTEGDNATFTCSFSNASESFVLNWYRMSPSNQTDKLAAFPEDRSQPGQDCRFRVTRLPNGRDFHMSVVRARRNDSGTYLCGAISLAPKAQIKESLRAELRVTERRAEVPTAHPSPSPRPAGQFQALV

SEQ ID NO: 5 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 6 - protein, 126 aa, Homo sapiens [sequence omitted]

SEQ ID NO: 7 - protein, 223 aa, Macaca fascicularis
MACLGFQRHKARLNLATRTRPYTLLFSLLFIPVFSKAMHVAQPAVVLANSRGIASFVCEYASPGKATEVRVTVLRQADSQVTEVCAATYMMGNELTFLDDSICTGTSSGNQVNLTIQGLRAMDTGLYICKVELMYPPPYYMGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 8 - protein, 126 aa, Macaca fascicularis
KAMHVAQPAVVLANSRGIASFVCEYASPGKATEVRVTVLRQADSQVTEVCAATYMMGNELTFLDDSICTGTSSGNQVNLTIQGLRAMDTGLYICKVELMYPPPYYMGIGNGTQIYVIDPEPCPDSD

SEQ ID NO: 9 - protein, 525 aa, Homo sapiens
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 10 - protein, 422 aa, Homo sapiens
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHL

SEQ ID NO: 11 - protein, 533 aa, Macaca fascicularis
  MOD_RES (74)..(74): Any amino acid
MWEAQFLGLLFLQPLWVAPVKPPQPGAEISVVWAQEGAPAQLPCSPTIPLQDLSLLRRAGVTWQHQPDSGPPAXAPGHPPVPGHRPAAPYSWGPRPRRYTVLSVGPGGLRSGRLPLQPRVQLDERGRQRGDFSLWLRPARRADAGEYRATVHLRDRALSCRLRLRVGQASMTASPPGSLRTSDWVILNCSFSRPDRPASVHWFRSRGQGRVPVQGSPHHHLAESFLFLPHVGPMDSGLWGCILTYRDGFNVSIMYNLTVLGLEPATPLTVYAGAGSRVELPCRLPPAVGTQSFLTAKWAPPGGGPDLLVAGDNGDFTLRLEDVSQAQAGTYICHIRLQGQQLNATVTLAIITVTPKSFGSPGSLGKLLCEVTPASGQEHFVWSPLNTPSQRSFSGPWLEAQEAQLLSQPWQCQLHQGERLLGAAVYFTELSSPGAQRSGRAPGALRAGHLPLFLILGVLFLLLLVTGAFGFHLWRRQWRPRRFSALEQGIHPPQAQSKIEELEQEPELEPEPELERELGPEPEPGPEPEPEQL

SEQ ID NO: 12 - protein, 422 aa, Macaca fascicularis
  MOD_RES (46)..(46): Any amino acid
ISVVWAQEGAPAQLPCSPTIPLQDLSLLRRAGVTWQHQPDSGPPAXAPGHPPVPGHRPAAPYSWGPRPRRYTVLSVGPGGLRSGRLPLQPRVQLDERGRQRGDFSLWLRPARRADAGEYRATVHLRDRALSCRLRLRVGQASMTASPPGSLRTSDWVILNCSFSRPDRPASVHWFRSRGQGRVPVQGSPHHHLAESFLFLPHVGPMDSGLWGCILTYRDGFNVSIMYNLTVLGLEPATPLTVYAGAGSRVELPCRLPPAVGTQSFLTAKWAPPGGGPDLLVAGDNGDFTLRLEDVSQAQAGTYICHIRLQGQQLNATVTLAIITVTPKSFGSPGSLGKLLCEVTPASGQEHFVWSPLNTPSQRSFSGPWLEAQEAQLLSQPWQCQLHQGERLLGAAVYFTELSSPGAQRSGRAPGALRAGHL

SEQ ID NO: 13 - protein, 289 aa, Homo sapiens
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 14 - protein, 127 aa, Homo sapiens
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYR

SEQ ID NO: 15 - protein, 289 aa, Macaca fascicularis
MKTLPAMLGSGRLFWVVFLIPYLDIWNIHGKESCDVQLYIKRQSYHSIFAGDRFKLECPVKYCAHRPQVTWCKLNGTTCVKLEGRHTSWKQEKNLSFFILHFEPVLPSDNGSYRCSANFLSAIIESHSTTLYVTDVKSASERPSKDEMASRPWLLYSLLPLGGLPLLITTCFCLFCFLRRHQGKQNELSDTTRREITLVDVPFKSEQTEASTRQNSQVLLSETGIYDNEPDFCFRMQEGSEVYSNPCLEENKPGIIYASLNHSIIGLNARQARNVKEAPTEYASICVRS

SEQ ID NO: 16 - protein, 127 aa, Macaca fascicularis
KESCDVQLYIKRQSYHSIFAGDRFKLECPVKYCAHRPQVTWCKLNGTTCVKLEGRHTSWKQEKNLSFFILHFEPVLPSDNGSYRCSANFLSAIIESHSTTLYVTDVKSASERPSKDEMASRPWLLYS

SEQ ID NO: 17 - protein, 300 aa, Homo sapiens
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAM

SEQ ID NO: 18 - protein, 181 aa, Homo sapiens
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIG

SEQ ID NO: 19 - protein, 302 aa, Macaca fascicularis
MFSHLPFDCVLLLLLLLLTRSSEVEYIAEVGQNAYLPCSYTPAPPGNLVPVCWGKGACPVFDCSNVVLRTDNRDVNDRTSGRYWLKGDFHKGDVSLTIENVTLADSGVYCCRIQIPGIMNDEKHNVKLVVIKPAKVTPAPTLQRDLTSAFPRMLTTGEHGPAETQTPGSLPDVNLTVSNFFCELQIFTLTNELRDSGATIRTAIYIAAGISAGLALALIFGALIFKWYSHSKEKTQNLSLISLANIPPSGLANAVAEGIRSEENIYTIEEDVYEVEEPNEYYCYVSSGQQPSQPLGCRVAMP

SEQ ID NO: 20 - protein, 182 aa, Macaca fascicularis
SEVEYIAEVGQNAYLPCSYTPAPPGNLVPVCWGKGACPVFDCSNVVLRTDNRDVNDRTSGRYWLKGDFHKGDVSLTIENVTLADSGVYCCRIQIPGIMNDEKHNVKLVVIKPAKVTPAPTLQRDLTSAFPRMLTTGEHGPAETQTPGSLPDVNLTVSNFFCELQIFTLTNELRDSGATIRTA

SEQ ID NO: 21 - protein, 246 aa, Artificial Sequence
  Description of Artificial Sequence: Synthetic polypeptide
  XENP019533 [CTLA-4]_H0_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 22 - protein, 118 aa, Artificial Sequence
  Description of Artificial Sequence: Synthetic polypeptide
  VH of XENP019533
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 23 - protein, 108 aa, Artificial Sequence
  Description of Artificial Sequence: Synthetic polypeptide
  VL of XENP019533
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 24 - protein, 5 aa, Artificial Sequence
  Description of Artificial Sequence: Synthetic peptide
  XENP019533 vhCDR1
SYTMH

SEQ ID NO: 25 - protein, 17 aa, Artificial Sequence
  Description of Artificial Sequence: Synthetic peptide
  XENP019533 vhCDR2
FISYDGNNKYYADSVKG

SEQ ID NO: 26 - protein, 9 aa, Artificial Sequence
  Description of Artificial Sequence: Synthetic peptide
  XENP019533 vhCDR3
TGWLGPFDY

SEQ ID NO: 27 - protein, 12 aa, Artificial Sequence
  Description of Artificial Sequence: Synthetic peptide
  XENP019533 vlCDR1
RASQSVGSSYLA

SEQ ID NO: 28 - protein, 7 aa, Artificial Sequence
  Description of Artificial Sequence: Synthetic peptide
  XENP019533 vlCDR2
GAFSRAT

SEQ ID NO: 29 - protein, 9 aa, Artificial Sequence
  Description of Artificial Sequence: Synthetic peptide
  XENP019533 vlCDR3
QQYGSSPWT

SEQ ID NO: 30 - protein, 246 aa, Artificial Sequence
  Description of Artificial Sequence: Synthetic polypeptide
  XENP019534 [CTLA-4]_H0.36_L0.50_scFv(GKPGS)4
QVQLVESGGGVVQPGRSLRLSCAASGFTFSSYTMHWVRKAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIK

SEQ ID NO: 31 - protein, 118 aa, Artificial Sequence
  Description of Artificial Sequence: Synthetic polypeptide
  VH of XENP019534
QVQLVESGGGVVQPGRSLRLSCAASGFTFSSYTMHWVRKAPGKGLEWVTFISYDGNNKYYADSVKGRFTISRDNSKNTLYLQMNSLRAEDTAIYYCARTGWLGPFDYWGQGTLVTVSS

SEQ ID NO: 32 - protein, 108 aa, Artificial Sequence
  Description of Artificial Sequence: Synthetic polypeptide
  VL of XENP019534
EIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIK

SEQ ID NO: 33 - protein, 5 aa, Artificial Sequence
  Description of Artificial Sequence: Synthetic peptide
  XENP019534 vhCDR1
SYTMH

SEQ ID NO: 34 - protein, 17 aa, Artificial Sequence
  Description of Artificial Sequence: Synthetic peptide
  XENP019534 vhCDR2
FISYDGNNKYYADSVKG

SEQ ID NO: 35 - protein, 9 aa, Artificial Sequence
  Description of Artificial Sequence: Synthetic peptide
  XENP019534 vhCDR3
TGWLGPFDY

SEQ ID NO: 36 - protein, 12 aa, Artificial Sequence
  Description of Artificial Sequence: Synthetic peptide
  XENP019534 vlCDR1
RASQSVGSSYLA

SEQ ID NO: 37 - protein, 7 aa, Artificial Sequence
  Description of Artificial Sequence: Synthetic peptide
  XENP019534 vlCDR2
GAFSRAT

SEQ ID NO: 38 - protein, 9 aa, Artificial Sequence
  Description of Artificial Sequence: Synthetic peptide
  XENP019534 vlCDR3
QQYGSSPWT

SEQ ID NO: 39 - protein, 246 aa, Artificial Sequence
  Description of Artificial Sequence: Synthetic polypeptide
  XENP019535 [CTLA-4]_H0.36_L0.51_scFv(GKPGS)4
QVQLVESGGGVVQPGRSLRLSCAASGFTFSSYTMHWVRKAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPDQAPRLLIYGAFSRATGIPDRFSGSGSGTDFTLTISRLEPEDFAVYYCQQYGSSPWTFGQGTKVEIK

SEQ ID NO: 40 - protein, 118 aa, Artificial Sequence; identical to SEQ ID NO: 31
  Description of Artificial Sequence: Synthetic polypeptide
  VH of XENP019535

SEQ ID NO: 41 - protein, 108 aa, Artificial Sequence
  Description of Artificial Sequence: Synthetic polypeptide
  VL of XENP019535
EIVLTQSPGTLSLSPGERATLSCRASQSVGSSYLAWYQQKPDQAPRLLIYGAFSRATGIPDRFSGSGSGTDFTLTISRLEPEDFAVYYCQQYGSSPWTFGQGTKVEIK

SEQ ID NO: 42 - protein, 5 aa, Artificial Sequence
  Description of Artificial Sequence: Synthetic peptide
  XENP019535 vhCDR1
SYTMH

SEQ ID NO: 43 - protein, 17 aa, Artificial Sequence
  Description of Artificial Sequence: Synthetic peptide
  XENP019535 vhCDR2
FISYDGNNKYYADSVKG

SEQ ID NO: 44 - protein, 9 aa, Artificial Sequence
  Description of Artificial Sequence: Synthetic peptide
  XENP019535 vhCDR3
TGWLGPFDY

SEQ ID NO: 45 - protein, 12 aa, Artificial Sequence
  Description of Artificial Sequence: Synthetic peptide
  XENP019535 vlCDR1
RASQSVGSSYLA

SEQ ID NO: 46 - protein, 7 aa, Artificial Sequence
  Description of Artificial Sequence: Synthetic peptide
  XENP019535 vlCDR2
GAFSRAT

SEQ ID NO: 47 - protein, 9 aa, Artificial Sequence
  Description of Artificial Sequence: Synthetic peptide
  XENP019535 vlCDR3
QQYGSSPWT

SEQ ID NO: 48 - protein, 246 aa, Artificial Sequence
  Description of Artificial Sequence: Synthetic polypeptide
  XENP019536 [CTLA-4]_H0.37_L0.50_scFv(GKPGS)4
QVQLVESGGGVVQPGRSLRLSCAASGFTFSSYTMHWVRQAPGKRLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIK

SEQ ID NO: 49 - protein, 118 aa, Artificial Sequence
  Description of Artificial Sequence: Synthetic polypeptide
  VH of XENP019536
QVQLVESGGGVVQPGRSLRLSCAASGFTFSSYTMHWVRQAPGKRLEWVTFISYDGNNKYYADSVKGRFTISRDNSKNTLYLQMNSLRAEDTAIYYCARTGWLGPFDYWGQGTLVTVSS

SEQ ID NO: 50 - protein, 108 aa, Artificial Sequence; identical to SEQ ID NO: 32
  Description of Artificial Sequence: Synthetic polypeptide
  VL of XENP019536

SEQ ID NO: 51 - protein, 5 aa, Artificial Sequence
  Description of Artificial Sequence: Synthetic peptide
  XENP019536 vhCDR1
SYTMH

SEQ ID NO: 52 - protein, 17 aa, Artificial Sequence
  Description of Artificial Sequence: Synthetic peptide
  XENP019536 vhCDR2
FISYDGNNKYYADSVKG

SEQ ID NO: 53 - protein, 9 aa, Artificial Sequence
  Description of Artificial Sequence: Synthetic peptide
  XENP019536 vhCDR3
TGWLGPFDY

SEQ ID NO: 54 - protein, 12 aa, Artificial Sequence
  Description of Artificial Sequence: Synthetic peptide
  XENP019536 vlCDR1
RASQSVGSSYLA

SEQ ID NO: 55 - protein, 7 aa, Artificial Sequence
  Description of Artificial Sequence: Synthetic peptide
  XENP019536 vlCDR2
GAFSRAT

SEQ ID NO: 56 - protein, 9 aa, Artificial Sequence
  Description of Artificial Sequence: Synthetic peptide
  XENP019536 vlCDR3
QQYGSSPWT

SEQ ID NO: 57 - protein, 246 aa, Artificial Sequence
  Description of Artificial Sequence: Synthetic polypeptide
  XENP019537 [CTLA-4]_H0.37_L0.113_scFv(GKPGS)4
QVQLVESGGGVVQPGRSLRLSCAASGFTFSSYTMHWVRQAPGKRLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIK

SEQ ID NO: 58 - protein, 118 aa, Artificial Sequence; identical to SEQ ID NO: 49
  Description of Artificial Sequence: Synthetic polypeptide
  VH of XENP019537

SEQ ID NO: 59 - protein, 108 aa, Artificial Sequence
  Description of Artificial Sequence: Synthetic polypeptide
  VL of XENP019537
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIK

SEQ ID NO: 60 - protein, 5 aa, Artificial Sequence
  Description of Artificial Sequence: Synthetic peptide
  XENP019537 vhCDR1
SYTMH

SEQ ID NO: 61 - protein, 17 aa, Artificial Sequence
  Description of Artificial Sequence: Synthetic peptide
  XENP019537 vhCDR2
FISYDGNNKYYADSVKG

SEQ ID NO: 62 - protein, 9 aa, Artificial Sequence
  Description of Artificial Sequence: Synthetic peptide
  XENP019537 vhCDR3
TGWLGPFDY

SEQ ID NO: 63 - protein, 12 aa, Artificial Sequence
  Description of Artificial Sequence: Synthetic peptide
  XENP019537 vlCDR1
RASQSVGSSYLA

SEQ ID NO: 64 - protein, 7 aa, Artificial Sequence
  Description of Artificial Sequence: Synthetic peptide
  XENP019537 vlCDR2
GAFSRAT

SEQ ID NO: 65 - protein, 9 aa, Artificial Sequence
  Description of Artificial Sequence: Synthetic peptide
  XENP019537 vlCDR3
QQYGSSPWT

SEQ ID NO: 66 - protein, 246 aa, Artificial Sequence
  Description of Artificial Sequence: Synthetic polypeptide
  XENP019538 [CTLA-4]_H0.134_L0.51_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSSGKPGSGKPGSGKPGSGKPGSEIVLTQSPGTLSLSPGERATLSCRASQSVGSSYLAWYQQKPDQAPRLLIYGAFSRATGIPDRFSGSGSGTDFTLTISRLEPEDFAVYYCQQYGSSPWTFGQGTKVEIK

SEQ ID NO: 67 - protein, 118 aa, Artificial Sequence
  Description of Artificial Sequence: Synthetic polypeptide
  VH of XENP019538
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSS

SEQ ID NO: 68 - protein, 108 aa, Artificial Sequence; identical to SEQ ID NO: 41
  Description of Artificial Sequence: Synthetic polypeptide
  VL of XENP019538

SEQ ID NO: 69 - protein, 5 aa, Artificial Sequence
  Description of Artificial Sequence: Synthetic peptide
  XENP019538 vhCDR1
SYTMH

SEQ ID NO: 70 - protein, 17 aa, Artificial Sequence
  Description of Artificial Sequence: Synthetic peptide
  XENP019538 vhCDR2
FISYDGNNKYYADSVKG

SEQ ID NO: 71 - protein, 9 aa, Artificial Sequence
  Description of Artificial Sequence: Synthetic peptide
  XENP019538 vhCDR3
TGWLGPFDY

SEQ ID NO: 72 - protein, 12 aa, Artificial Sequence
  Description of Artificial Sequence: Synthetic peptide
  XENP019538 vlCDR1
RASQSVGSSYLA

SEQ ID NO: 73 - protein, 7 aa, Artificial Sequence
  Description of Artificial Sequence: Synthetic peptide
  XENP019538 vlCDR2
GAFSRAT

SEQ ID NO: 74 - protein, 9 aa, Artificial Sequence
  Description of Artificial Sequence: Synthetic peptide
  XENP019538 vlCDR3
QQYGSSPWT

SEQ ID NO: 75 - protein, 246 aa, Artificial Sequence
  Description of Artificial Sequence: Synthetic polypeptide
  XENP019539 [CTLA-4]_H0.134_L0.53_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSSGKPGSGKPGSGKPGSGKPGSEIVLTQSPGTLSLSPGERATLSCRASQSVGSSYLAWYQQKPGEAPRLLIYGAFSRATGIPDRFSGSGSGTDFTLTISRLEPEDFAVYYCQQYGSSPWTFGQGTKVEIK

SEQ ID NO: 76 - protein, 118 aa, Artificial Sequence; identical to SEQ ID NO: 67
  Description of Artificial Sequence: Synthetic polypeptide
  VH of XENP019539

SEQ ID NO: 77 - protein, 108 aa, Artificial Sequence
  Description of Artificial Sequence: Synthetic polypeptide
  VL of XENP019539
EIVLTQSPGTLSLSPGERATLSCRASQSVGSSYLAWYQQKPGEAPRLLIYGAFSRATGIPDRFSGSGSGTDFTLTISRLEPEDFAVYYCQQYGSSPWTFGQGTKVEIK

SEQ ID NO: 78 - protein, 5 aa, Artificial Sequence
  Description of Artificial Sequence: Synthetic peptide
  XENP019539 vhCDR1
SYTMH

SEQ ID NO: 79 - protein, 17 aa, Artificial Sequence
  Description of Artificial Sequence: Synthetic peptide
  XENP019539 vhCDR2
FISYDGNNKYYADSVKG

SEQ ID NO: 80 - protein, 9 aa, Artificial Sequence
  Description of Artificial Sequence: Synthetic peptide
  XENP019539 vhCDR3
TGWLGPFDY

SEQ ID NO: 81 - protein, 12 aa, Artificial Sequence
  Description of Artificial Sequence: Synthetic peptide
  XENP019539 vlCDR1
RASQSVGSSYLA

SEQ ID NO: 82 - protein, 7 aa, Artificial Sequence
  Description of Artificial Sequence: Synthetic peptide
  XENP019539 vlCDR2
GAFSRAT

SEQ ID NO: 83 - protein, 9 aa, Artificial Sequence
  Description of Artificial Sequence: Synthetic peptide
  XENP019539 vlCDR3
QQYGSSPWT

SEQ ID NO: 84 - protein, 246 aa, Artificial Sequence
  Description of Artificial Sequence: Synthetic polypeptide
  XENP019540 [CTLA-4]_H0.134_L0.57_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSSGKPGSGKPGSGKPGSGKPGSEIVLTQSPGTLSLSPGERATLSCRASQSVGSSYLAWYQQKPGQAPELLIYGAFSRATGIPDRFSGSGSGTDFTLTISRLEPEDFAVYYCQQYGSSPWTFGQGTKVEIK

SEQ ID NO: 85 - protein, 118 aa, Artificial Sequence; identical to SEQ ID NO: 67
  Description of Artificial Sequence: Synthetic polypeptide
  VH of XENP019540

SEQ ID NO: 86 - protein, 108 aa, Artificial Sequence
  Description of Artificial Sequence: Synthetic polypeptide
  VL of XENP019540
EIVLTQSPGTLSLSPGERATLSCRASQSVGSSYLAWYQQKPGQAPELLIYGAFSRATGIPDRFSGSGSGTDFTLTISRLEPEDFAVYYCQQYGSSPWTFGQGTKVEIK

SEQ ID NO: 87 - protein, 5 aa, Artificial Sequence
  Description of Artificial Sequence: Synthetic peptide
  XENP019540 vhCDR1
SYTMH

SEQ ID NO: 88 - protein, 17 aa, Artificial Sequence
  Description of Artificial Sequence: Synthetic peptide
  XENP019540 vhCDR2
FISYDGNNKYYADSVKG

SEQ ID NO: 89 - protein, 9 aa, Artificial Sequence
  Description of Artificial Sequence: Synthetic peptide
  XENP019540 vhCDR3
TGWLGPFDY

SEQ ID NO: 90 - protein, 12 aa, Artificial Sequence
  Description of Artificial Sequence: Synthetic peptide
  XENP019540 vlCDR1
RASQSVGSSYLA

SEQ ID NO: 91 - protein, 7 aa, Artificial Sequence
  Description of Artificial Sequence: Synthetic peptide
  XENP019540 vlCDR2
GAFSRAT

SEQ ID NO: 92 - protein, 9 aa, Artificial Sequence
  Description of Artificial Sequence: Synthetic peptide
  XENP019540 vlCDR3
QQYGSSPWT

SEQ ID NO: 93 - protein, 246 aa, Artificial Sequence
  Description of Artificial Sequence: Synthetic polypeptide
  XENP019541 [CTLA-4]_H0.137_L0.114_scFv(GKPGS)4
QVQLVESGGGVVQPGRSLRLSCAASGFTFSSYTMHWVRQAPGKCLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGCGTKVEIK

SEQ ID NO: 94 - protein, 118 aa, Artificial Sequence
  Description of Artificial Sequence: Synthetic polypeptide
  VH of XENP019541
QVQLVESGGGVVQPGRSLRLSCAASGFTFSSYTMHWVRQAPGKCLEWVTFISYDGNNKYYADSVKGRFTISRDNSKNTLYLQMNSLRAEDTAIYYCARTGWLGPFDYWGQGTLVTVSS

SEQ ID NO: 95 - protein, 108 aa, Artificial Sequence
  Description of Artificial Sequence: Synthetic polypeptide
  VL of XENP019541
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGCGTKVEIK

SEQ ID NO: 96 - protein, 5 aa, Artificial Sequence
  Description of Artificial Sequence: Synthetic peptide
  XENP019541 vhCDR1
SYTMH

SEQ ID NO: 97 - protein, 17 aa, Artificial Sequence
  Description of Artificial Sequence: Synthetic peptide
  XENP019541 vhCDR2
FISYDGNNKYYADSVKG

SEQ ID NO: 98 - protein, 9 aa, Artificial Sequence
  Description of Artificial Sequence: Synthetic peptide
  XENP019541 vhCDR3
TGWLGPFDY

SEQ ID NO: 99 - protein, 12 aa, Artificial Sequence
  Description of Artificial Sequence: Synthetic peptide
  XENP019541 vlCDR1
RASQSVGSSYLA

SEQ ID NO: 100 - protein, 7 aa, Artificial Sequence
  Description of Artificial Sequence: Synthetic peptide
  XENP019541 vlCDR2
GAFSRAT

SEQ ID NO: 101 - protein, 9 aa, Artificial Sequence
  Description of Artificial Sequence: Synthetic peptide
  XENP019541 vlCDR3
QQYGSSPWT

SEQ ID NO: 102 - protein, 246 aa, Artificial Sequence
  Description of Artificial Sequence: Synthetic polypeptide
  XENP019542 [CTLA-4]_H0.138_L0.115_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGCGTLVTVSSGKPGSGKPGSGKPGSGKPGSEIVLTQSPGTLSLSPGERATLSCRASQSVGSSYLAWYQQKPCQAPRLLIYGAFSRATGIPDRFSGSGSGTDFTLTISRLEPEDFAVYYCQQYGSSPWTFGQGTKVEIK

SEQ ID NO: 103 - protein, 118 aa, Artificial Sequence
  Description of Artificial Sequence: Synthetic polypeptide
  VH of XENP019542
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGCGTLVTVSS

SEQ ID NO: 104 - protein, 108 aa, Artificial Sequence
  Description of Artificial Sequence: Synthetic polypeptide
  VL of XENP019542
EIVLTQSPGTLSLSPGERATLSCRASQSVGSSYLAWYQQKPCQAPRLLIYGAFSRATGIPDRFSGSGSGTDFTLTISRLEPEDFAVYYCQQYGSSPWTFGQGTKVEIK

SEQ ID NO: 105 - protein, 5 aa, Artificial Sequence
  Description of Artificial Sequence: Synthetic peptide
  XENP019542 vhCDR1
SYTMH

SEQ ID NO: 106 - protein, 17 aa, Artificial Sequence
  Description of Artificial Sequence: Synthetic peptide
  XENP019542 vhCDR2
FISYDGNNKYYADSVKG

SEQ ID NO: 107 - protein, 9 aa, Artificial Sequence
  Description of Artificial Sequence: Synthetic peptide
  XENP019542 vhCDR3
TGWLGPFDY

SEQ ID NO: 108 - protein, 12 aa, Artificial Sequence
  Description of Artificial Sequence: Synthetic peptide
  XENP019542 vlCDR1
RASQSVGSSYLA

SEQ ID NO: 109 - protein, 7 aa, Artificial Sequence
  Description of Artificial Sequence: Synthetic peptide
  XENP019542 vlCDR2
GAFSRAT

SEQ ID NO: 110 - protein, 9 aa, Artificial Sequence
  Description of Artificial Sequence: Synthetic peptide
  XENP019542 vlCDR3
QQYGSSPWT

SEQ ID NO: 111 - protein, 246 aa, Artificial Sequence
  Description of Artificial Sequence: Synthetic polypeptide
  XENP019543 [CTLA-4]_H0.139_L0.116_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGCGTLVTVSSGKPGSGKPGSGKPGSGKPGSEIVLTQSPGTLSLSPGERATLSCRASQSVGSSYLAWYQQKPGCAPRLLIYGAFSRATGIPDRFSGSGSGTDFTLTISRLEPEDFAVYYCQQYGSSPWTFGQGTKVEIK

SEQ ID NO: 112 - protein, 118 aa, Artificial Sequence; identical to SEQ ID NO: 103
  Description of Artificial Sequence: Synthetic polypeptide
  VH of XENP019543

SEQ ID NO: 113 - protein, 108 aa, Artificial Sequence
  Description of Artificial Sequence: Synthetic polypeptide
  VL of XENP019543
EIVLTQSPGTLSLSPGERATLSCRASQSVGSSYLAWYQQKPGCAPRLLIYGAFSRATGIPDRFSGSGSGTDFTLTISRLEPEDFAVYYCQQYGSSPWTFGQGTKVEIK

SEQ ID NO: 114 - protein, 5 aa, Artificial Sequence
  Description of Artificial Sequence: Synthetic peptide
  XENP019543 vhCDR1
SYTMH

SEQ ID NO: 115 - protein, 17 aa, Artificial Sequence
  Description of Artificial Sequence: Synthetic peptide
  XENP019543 vhCDR2
FISYDGNNKYYADSVKG

SEQ ID NO: 116 - protein, 9 aa, Artificial Sequence
  Description of Artificial Sequence: Synthetic peptide
  XENP019543 vhCDR3
TGWLGPFDY

SEQ ID NO: 117 - protein, 12 aa, Artificial Sequence
  Description of Artificial Sequence: Synthetic peptide
  XENP019543 vlCDR1
RASQSVGSSYLA

SEQ ID NO: 118 - protein, 7 aa, Artificial Sequence
  Description of Artificial Sequence: Synthetic peptide
  XENP019543 vlCDR2
GAFSRAT

SEQ ID NO: 119 - protein, 9 aa, Artificial Sequence
  Description of Artificial Sequence: Synthetic peptide
  XENP019543 vlCDR3
QQYGSSPWT

SEQ ID NO: 120 - protein, 246 aa, Artificial Sequence
  Description of Artificial Sequence: Synthetic polypeptide
  XENP019551 [CTLA-4]_H1_L0_scFv(GKPGS)4
EVQLVESGGGLVQPGGSLRLSCAASGFTFSSYTMHWVRQAPGKGLEWVTFISYDGNNKYYVDSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 121 - protein, 118 aa, Artificial Sequence
  Description of Artificial Sequence: Synthetic polypeptide
  VH of XENP019551
EVQLVESGGGLVQPGGSLRLSCAASGFTFSSYTMHWVRQAPGKGLEWVTFISYDGNNKYYVDSVKGRFTISRDNAKNSLYLQMNSLRAEDTAVYYCARTGWLGPFDYWGQGTLVTVSS

SEQ ID NO: 122 - protein, 108 aa, Artificial Sequence; identical to SEQ ID NO: 23
  Description of Artificial Sequence: Synthetic polypeptide
  VL of XENP019551

SEQ ID NO: 123 - protein, 5 aa, Artificial Sequence
  Description of Artificial Sequence: Synthetic peptide
  XENP019551 vhCDR1
SYTMH

SEQ ID NO: 124 - protein, 17 aa, Artificial Sequence
  Description of Artificial Sequence: Synthetic peptide
  XENP019551 vhCDR2
FISYDGNNKYYVDSVKG

SEQ ID NO: 125 - protein, 9 aa, Artificial Sequence
  Description of Artificial Sequence: Synthetic peptide
  XENP019551 vhCDR3
TGWLGPFDY

SEQ ID NO: 126 - protein, 12 aa, Artificial Sequence
  Description of Artificial Sequence: Synthetic peptide
  XENP019551 vlCDR1
RASQSVGSSYLA

SEQ ID NO: 127 - protein, 7 aa, Artificial Sequence
  Description of Artificial Sequence: Synthetic peptide
  XENP019551 vlCDR2
GAFSRAT

SEQ ID NO: 128 - protein, 9 aa, Artificial Sequence
  Description of Artificial Sequence: Synthetic peptide
  XENP019551 vlCDR3
QQYGSSPWT

SEQ ID NO: 129 - protein, 246 aa, Artificial Sequence
  Description of Artificial Sequence: Synthetic polypeptide
  XENP019552 [CTLA-4]_H2_L0_scFv(GKPGS)4
EVQLVESGGGLVQPGGSLRLSCAASGFTFSSYTMHWVRQAPGKGLEWVTFISYDGNNKYYPGSVKGRFTISRENAKNSLYLQMNSLRAGDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 130 - protein, 118 aa, Artificial Sequence
  Description of Artificial Sequence: Synthetic polypeptide
  VH of XENP019552
EVQLVESGGGLVQPGGSLRLSCAASGFTFSSYTMHWVRQAPGKGLEWVTFISYDGNNKYYPGSVKGRFTISRENAKNSLYLQMNSLRAGDTAVYYCARTGWLGPFDYWGQGTLVTVSS

SEQ ID NO: 131 - protein, 108 aa, Artificial Sequence; identical to SEQ ID NO: 23
  Description of Artificial Sequence: Synthetic polypeptide
  VL of XENP019552

SEQ ID NO: 132 - protein, 5 aa, Artificial Sequence
  Description of Artificial Sequence: Synthetic peptide
  XENP019552 vhCDR1
SYTMH

SEQ ID NO: 133 - protein, 17 aa, Artificial Sequence
  Description of Artificial Sequence: Synthetic peptide
  XENP019552 vhCDR2
FISYDGNNKYYPGSVKG

SEQ ID NO: 134 - protein, 9 aa, Artificial Sequence
  Description of Artificial Sequence: Synthetic peptide
  XENP019552 vhCDR3
TGWLGPFDY

SEQ ID NO: 135 - protein, 12 aa, Artificial Sequence
  Description of Artificial Sequence: Synthetic peptide
  XENP019552 vlCDR1
RASQSVGSSYLA

SEQ ID NO: 136 - protein, 7 aa, Artificial Sequence
  Description of Artificial Sequence: Synthetic peptide
  XENP019552 vlCDR2
GAFSRAT

SEQ ID NO: 137 - protein, 9 aa, Artificial Sequence
  Description of Artificial Sequence: Synthetic peptide
  XENP019552 vlCDR3
QQYGSSPWT

SEQ ID NO: 138 - protein, 246 aa, Artificial Sequence
  Description of Artificial Sequence: Synthetic polypeptide
  XENP019553 [CTLA-4]_H3_L0_scFv(GKPGS)4
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 139 - protein, 118 aa, Artificial Sequence
  Description of Artificial Sequence: Synthetic polypeptide
  VH of XENP019553
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS

SEQ ID NO: 140 - protein, 108 aa, Artificial Sequence; identical to SEQ ID NO: 23
  Description of Artificial Sequence: Synthetic polypeptide
  VL of XENP019553

SEQ ID NO: 141 - protein, 5 aa, Artificial Sequence
  Description of Artificial Sequence: Synthetic peptide
  XENP019553 vhCDR1
SYTMH

SEQ ID NO: 142 - protein, 17 aa, Artificial Sequence
  Description of Artificial Sequence: Synthetic peptide
  XENP019553 vhCDR2
FISYDGNNKYYADSVKG

SEQ ID NO: 143 - protein, 9 aa, Artificial Sequence
  Description of Artificial Sequence: Synthetic peptide
  XENP019553 vhCDR3
TGWLGPFDY

SEQ ID NO: 144 - protein, 12 aa, Artificial Sequence
  Description of Artificial Sequence: Synthetic peptide
  XENP019553 vlCDR1
RASQSVGSSYLA

SEQ ID NO: 145 - protein, 7 aa, Artificial Sequence
  Description of Artificial Sequence: Synthetic peptide
  XENP019553 vlCDR2
GAFSRAT

SEQ ID NO: 146 - protein, 9 aa, Artificial Sequence
  Description of Artificial Sequence: Synthetic peptide
  XENP019553 vlCDR3
QQYGSSPWT

SEQ ID NO: 147 - protein, 246 aa, Artificial Sequence
  Description of Artificial Sequence: Synthetic polypeptide
  XENP019554 [CTLA-4]_H4_L0_scFv(GKPGS)4
EVQLVESGGGLVQPGGSLRLSCAASGFTFSSYTMHWVRQAPGKGLEYVTFISYDGNNKYYADSVKGRFTISRDNSKNTLYLQMGSLRAEDMAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 148 - protein, 118 aa, Artificial Sequence
  Description of Artificial Sequence: Synthetic polypeptide
  VH of XENP019554
EVQLVESGGGLVQPGGSLRLSCAASGFTFSSYTMHWVRQAPGKGLEYVTFISYDGNNKYYADSVKGRFTISRDNSKNTLYLQMGSLRAEDMAVYYCARTGWLGPFDYWGQGTLVTVSS

SEQ ID NO: 149 - protein, 108 aa, Artificial Sequence; identical to SEQ ID NO: 23
  Description of Artificial Sequence: Synthetic polypeptide
  VL of XENP019554

SEQ ID NO: 150 - protein, 5 aa, Artificial Sequence
  Description of Artificial Sequence: Synthetic peptide
  XENP019554 vhCDR1
SYTMH

SEQ ID NO: 151 - protein, 17 aa, Artificial Sequence
  Description of Artificial Sequence: Synthetic peptide
  XENP019554 vhCDR2
FISYDGNNKYYADSVKG

SEQ ID NO: 152 - protein, 9 aa, Artificial Sequence
  Description of Artificial Sequence: Synthetic peptide
  XENP019554 vhCDR3
TGWLGPFDY

SEQ ID NO: 153 - protein, 12 aa, Artificial Sequence
  Description of Artificial Sequence: Synthetic peptide
  XENP019554 vlCDR1
RASQSVGSSYLA

SEQ ID NO: 154 - protein, 7 aa, Artificial Sequence
  Description of Artificial Sequence: Synthetic peptide
  XENP019554 vlCDR2
GAFSRAT

SEQ ID NO: 155 - protein, 9 aa, Artificial Sequence
  Description of Artificial Sequence: Synthetic peptide
  XENP019554 vlCDR3
QQYGSSPWT

SEQ ID NO: 156 - protein, 246 aa, Artificial Sequence
  Description of Artificial Sequence: Synthetic polypeptide
  XENP019555 [CTLA-4]_H0_L1_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPATLSLSPGERATLSCGASQSVGSSYLAWYQQKPGLAPRLLIYGAFSRATGIPDRFSGSGSGTDFTLTISRLEPEDFAVYYCQQYGSSPWTFGQGTKVEIK

SEQ ID NO: 157 - protein, 118 aa, Artificial Sequence; identical to SEQ ID NO: 22
  Description of Artificial Sequence: Synthetic polypeptide
  VH of XENP019555

SEQ ID NO: 158 - protein, 108 aa, Artificial Sequence
  Description of Artificial Sequence: Synthetic polypeptide
  VL of XENP019555
EIVLTQSPATLSLSPGERATLSCGASQSVGSSYLAWYQQKPGLAPRLLIYGAFSRATGIPDRFSGSGSGTDFTLTISRLEPEDFAVYYCQQYGSSPWTFGQGTKVEIK

SEQ ID NO: 159 - protein, 5 aa, Artificial Sequence
  Description of Artificial Sequence: Synthetic peptide
  XENP019555 vhCDR1
SYTMH

SEQ ID NO: 160 - protein, 17 aa, Artificial Sequence
  Description of Artificial Sequence: Synthetic peptide
  XENP019555 vhCDR2
FISYDGNNKYYADSVKG

SEQ ID NO: 161 - protein, 9 aa, Artificial Sequence
  Description of Artificial Sequence: Synthetic peptide
  XENP019555 vhCDR3
TGWLGPFDY

SEQ ID NO: 162 - protein, 12 aa, Artificial Sequence
  Description of Artificial Sequence: Synthetic peptide
  XENP019555 vlCDR1
GASQSVGSSYLA

SEQ ID NO: 163 - protein, 7 aa, Artificial Sequence
  Description of Artificial Sequence: Synthetic peptide
  XENP019555 vlCDR2
GAFSRAT

SEQ ID NO: 164 - protein, 9 aa, Artificial Sequence
  Description of Artificial Sequence: Synthetic peptide
  XENP019555 vlCDR3
QQYGSSPWT

SEQ ID NO: 165 - protein, 246 aa, Artificial Sequence
  Description of Artificial Sequence: Synthetic polypeptide
  XENP019556 [CTLA-4]_H0_L2_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVMTQSPATLSVSPGERATLSCRASQSVGSSYLAWYQQKPGQAPRLLIYGAFSRATGIPARFSGSGSGTEFTLTISSLQSEDFAVYYCQQYGSSPWTFGQGTKVEIK

SEQ ID NO: 166 - protein, 118 aa, Artificial Sequence; identical to SEQ ID NO: 22
  Description of Artificial Sequence: Synthetic polypeptide
  VH of XENP019556

SEQ ID NO: 167 - protein, 108 aa, Artificial Sequence
  Description of Artificial Sequence: Synthetic polypeptide
  VL of XENP019556
EIVMTQSPATLSVSPGERATLSCRASQSVGSSYLAWYQQKPGQAPRLLIYGAFSRATGIPARFSGSGSGTEFTLTISSLQSEDFAVYYCQQYGSSPWTFGQGTKVEIK

SEQ ID NO: 168 - protein, 5 aa, Artificial Sequence
  Description of Artificial Sequence: Synthetic peptide
  XENP019556 vhCDR1
SYTMH

SEQ ID NO: 169 - protein, 17 aa, Artificial Sequence
  Description of Artificial Sequence: Synthetic peptide
  XENP019556 vhCDR2
FISYDGNNKYYADSVKG

SEQ ID NO: 170 - protein, 9 aa, Artificial Sequence
  Description of Artificial Sequence: Synthetic peptide
  XENP019556 vhCDR3
TGWLGPFDY

SEQ ID NO: 171 - protein, 12 aa, Artificial Sequence
  Description of Artificial Sequence: Synthetic peptide
  XENP019556 vlCDR1
RASQSVGSSYLA

SEQ ID NO: 172 - protein, 7 aa, Artificial Sequence
  Description of Artificial Sequence: Synthetic peptide
  XENP019556 vlCDR2
GAFSRAT

SEQ ID NO: 173 - protein, 9 aa, Artificial Sequence
  Description of Artificial Sequence: Synthetic peptide
  XENP019556 vlCDR3
QQYGSSPWT

SEQ ID NO: 174 - protein, 246 aa, Artificial Sequence
  Description of Artificial Sequence: Synthetic polypeptide
  XENP019587 [CTLA-4]_H0.140_L0_scFv(GKPGS)4
QVQLVESGGGVVQPGRSLRLSCAASGFTFSSYTMHWVRQAPGKGLEWVCFISYDGNNKYYADSVKGRFTCSRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 175 - protein, 118 aa, Artificial Sequence
  Description of Artificial Sequence: Synthetic polypeptide
  VH of XENP019587
QVQLVESGGGVVQPGRSLRLSCAASGFTFSSYTMHWVRQAPGKGLEWVCFISYDGNNKYYADSVKGRFTCSRDNSKNTLYLQMNSLRAEDTAIYYCARTGWLGPFDYWGQGTLVTVSS

SEQ ID NO: 176 - protein, 108 aa, Artificial Sequence; identical to SEQ ID NO: 23
  Description of Artificial Sequence: Synthetic polypeptide
  VL of XENP019587

SEQ ID NO: 177 - protein, 5 aa, Artificial Sequence
  Description of Artificial Sequence: Synthetic peptide
  XENP019587 vhCDR1
SYTMH

SEQ ID NO: 178 - protein, 17 aa, Artificial Sequence
  Description of Artificial Sequence: Synthetic peptide
  XENP019587 vhCDR2
FISYDGNNKYYADSVKG

SEQ ID NO: 179 - protein, 9 aa, Artificial Sequence
  Description of Artificial Sequence: Synthetic peptide
  XENP019587 vhCDR3
TGWLGPFDY

SEQ ID NO: 180 - protein, 12 aa, Artificial Sequence
  Description of Artificial Sequence: Synthetic peptide
  XENP019587 vlCDR1
RASQSVGSSYLA

SEQ ID NO: 181 - protein, 7 aa, Artificial Sequence
  Description of Artificial Sequence: Synthetic peptide
  XENP019587 vlCDR2
GAFSRAT

SEQ ID NO: 182 - protein, 9 aa, Artificial Sequence
  Description of Artificial Sequence: Synthetic peptide
  XENP019587 vlCDR3
QQYGSSPWT

SEQ ID NO: 183 - protein, 246 aa, Artificial Sequence
  Description of Artificial Sequence: Synthetic polypeptide
  XENP019588 [CTLA-4]_H0_L0.117_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLCYGAFSRATGIPDRFSCSGSGTDFTLTISRLEPEDFAVYYCQQYGSSPWTFGQGTKVEIK

SEQ ID NO: 184 - protein, 118 aa, Artificial Sequence; identical to SEQ ID NO: 22
  Description of Artificial Sequence: Synthetic polypeptide
  VH of XENP019588

SEQ ID NO: 185 - protein, 108 aa, Artificial Sequence
  Description of Artificial Sequence: Synthetic polypeptide
  VL of XENP019588
EIVLTQSPGTLSLSPGERATLSCRASQSVGSSYLAWYQQKPGQAPRLLCYGAFSRATGIPDRFSCSGSGTDFTLTISRLEPEDFAVYYCQQYGSSPWTFGQGTKVEIK

SEQ ID NO: 186 - protein, 5 aa, Artificial Sequence
  Description of Artificial Sequence: Synthetic peptide
  XENP019588 vhCDR1
SYTMH

SEQ ID NO: 187 - protein, 17 aa, Artificial Sequence
  Description of Artificial Sequence: Synthetic peptide
  XENP019588 vhCDR2
FISYDGNNKYYADSVKG

SEQ ID NO: 188 - protein, 9 aa, Artificial Sequence
  Description of Artificial Sequence: Synthetic peptide
  XENP019588 vhCDR3
TGWLGPFDY

SEQ ID NO: 189 - protein, 12 aa, Artificial Sequence
  Description of Artificial Sequence: Synthetic peptide
  XENP019588 vlCDR1
RASQSVGSSYLA

SEQ ID NO: 190 - protein, 7 aa, Artificial Sequence
  Description of Artificial Sequence: Synthetic peptide
  XENP019588 vlCDR2
GAFSRAT

SEQ ID NO: 191 - protein, 9 aa, Artificial Sequence
  Description of Artificial Sequence: Synthetic peptide
  XENP019588 vlCDR3
QQYGSSPWT

SEQ ID NO: 192 - protein, 246 aa, Artificial Sequence
  Description of Artificial Sequence: Synthetic polypeptide
  XENP019745 [CTLA-4]_H0.1_L0_scFv(GKPGS)4
EVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 193 - protein, 118 aa, Artificial Sequence
  Description of Artificial Sequence: Synthetic polypeptide
  VH of XENP019745
EVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 194 - protein, 108 aa, Artificial Sequence; identical to SEQ ID NO: 23
  Description of Artificial Sequence: Synthetic polypeptide
  VL of XENP019745

SEQ ID NO: 195 - protein, 5 aa, Artificial Sequence
  Description of Artificial Sequence: Synthetic peptide
  XENP019745 vhCDR1
SYTMH

SEQ ID NO: 196 - protein, 17 aa, Artificial Sequence
  Description of Artificial Sequence: Synthetic peptide
  XENP019745 vhCDR2
FISYDGNNKYYADSVKG

SEQ ID NO: 197 - protein, 9 aa, Artificial Sequence
  Description of Artificial Sequence: Synthetic peptide
  XENP019745 vhCDR3
TGWLGPFDY

SEQ ID NO: 198 - protein, 12 aa, Artificial Sequence
  Description of Artificial Sequence: Synthetic peptide
  XENP019745 vlCDR1
RASQSVGSSYLA

SEQ ID NO: 199 - protein, 7 aa, Artificial Sequence
  Description of Artificial Sequence: Synthetic peptide
  XENP019745 vlCDR2
GAFSRAT

SEQ ID NO: 200 - protein, 9 aa, Artificial Sequence
  Description of Artificial Sequence: Synthetic peptide
  XENP019745 vlCDR3
QQYGSSPWT

SEQ ID NO: 201 - protein, 246 aa, Artificial Sequence
  Description of Artificial Sequence: Synthetic polypeptide
  XENP019746 [CTLA-4]_H0.2_L0_scFv(GKPGS)4
QVQLLESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 202 - protein, 118 aa, Artificial Sequence
  Description of Artificial Sequence: Synthetic polypeptide
  VH of XENP019746
QVQLLESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 203 - protein, 108 aa, Artificial Sequence; identical to SEQ ID NO: 23
  Description of Artificial Sequence: Synthetic polypeptide
  VL of XENP019746

SEQ ID NO: 204 - protein, 5 aa, Artificial Sequence
  Description of Artificial Sequence: Synthetic peptide
  XENP019746 vhCDR1
SYTMH

SEQ ID NO: 205 - protein, 17 aa, Artificial Sequence
  Description of Artificial Sequence: Synthetic peptide
  XENP019746 vhCDR2
FISYDGNNKYYADSVKG

SEQ ID NO: 206 - protein, 9 aa, Artificial Sequence
  Description of Artificial Sequence: Synthetic peptide
  XENP019746 vhCDR3
TGWLGPFDY

SEQ ID NO: 207 - protein, 12 aa, Artificial Sequence
  Description of Artificial Sequence: Synthetic peptide
  XENP019746 vlCDR1
RASQSVGSSYLA

SEQ ID NO: 208 - protein, 7 aa, Artificial Sequence
  Description of Artificial Sequence: Synthetic peptide
  XENP019746 vlCDR2
GAFSRAT

SEQ ID NO: 209 - protein, 9 aa, Artificial Sequence
  Description of Artificial Sequence: Synthetic peptide
  XENP019746 vlCDR3
QQYGSSPWT

SEQ ID NO: 210 - protein, 246 aa, Artificial Sequence
  Description of Artificial Sequence: Synthetic polypeptide
  XENP019747 [CTLA-4]_H0.3_L0_scFv(GKPGS)4
QVQLVESGGGLVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 211 - protein, 118 aa, Artificial Sequence
  Description of Artificial Sequence: Synthetic polypeptide
  VH of XENP019747
QVQLVESGGGLVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 212 - protein, 108 aa, Artificial Sequence; identical to SEQ ID NO: 23
  Description of Artificial Sequence: Synthetic polypeptide
  VL of XENP019747

SEQ ID NO: 213 - protein, 5 aa, Artificial Sequence
  Description of Artificial Sequence: Synthetic peptide
  XENP019747 vhCDR1
SYTMH

SEQ ID NO: 214 - protein, 17 aa, Artificial Sequence
  Description of Artificial Sequence: Synthetic peptide
  XENP019747 vhCDR2
FISYDGNNKYYADSVKG

SEQ ID NO: 215 - protein, 9 aa, Artificial Sequence
  Description of Artificial Sequence: Synthetic peptide
  XENP019747 vhCDR3
TGWLGPFDY

SEQ ID NO: 216 - protein, 12 aa, Artificial Sequence
  Description of Artificial Sequence: Synthetic peptide
  XENP019747 vlCDR1
RASQSVGSSYLA

SEQ ID NO: 217 - protein, 7 aa, Artificial Sequence
  Description of Artificial Sequence: Synthetic peptide
  XENP019747 vlCDR2
GAFSRAT

SEQ ID NO: 218 - protein, 9 aa, Artificial Sequence
  Description of Artificial Sequence: Synthetic peptide
  XENP019747 vlCDR3
QQYGSSPWT

SEQ ID NO: 219 - protein, 246 aa, Artificial Sequence
  Description of Artificial Sequence: Synthetic polypeptide
  XENP019748 [CTLA-4]_H0.4_L0_scFv(GKPGS)4
QVQLVESGGGVKQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 220 - protein, 118 aa, Artificial Sequence
  Description of Artificial Sequence: Synthetic polypeptide
  VH of XENP019748
QVQLVESGGGVKQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 221 - protein, 108 aa, Artificial Sequence; identical to SEQ ID NO: 23
  Description of Artificial Sequence: Synthetic polypeptide
  VL of XENP019748

SEQ ID NO: 222 - protein, 5 aa, Artificial Sequence
  Description of Artificial Sequence: Synthetic peptide
  XENP019748 vhCDR1
SYTMH

SEQ ID NO: 223 - protein, 17 aa, Artificial Sequence
  Description of Artificial Sequence: Synthetic peptide
  XENP019748 vhCDR2
FISYDGNNKYYADSVKG

SEQ ID NO: 224 - protein, 9 aa, Artificial Sequence
  Description of Artificial Sequence: Synthetic peptide
  XENP019748 vhCDR3
TGWLGPFDY

SEQ ID NO: 225 - protein, 12 aa, Artificial Sequence
  Description of Artificial Sequence: Synthetic peptide
  XENP019748 vlCDR1
RASQSVGSSYLA

SEQ ID NO: 226 - protein, 7 aa, Artificial Sequence
  Description of Artificial Sequence: Synthetic peptide
  XENP019748 vlCDR2
GAFSRAT

SEQ ID NO: 227 - protein, 9 aa, Artificial Sequence
  Description of Artificial Sequence: Synthetic peptide
  XENP019748 vlCDR3
QQYGSSPWT

SEQ ID NO: 228 - protein, 246 aa, Artificial Sequence
  Description of Artificial Sequence: Synthetic polypeptide
  XENP019749 [CTLA-4]_H0.5_L0_scFv(GKPGS)4
QVQLVESGGGVKQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 229 - protein, 118 aa, Artificial Sequence
  Description of Artificial Sequence: Synthetic polypeptide
  VH of XENP019749
QVQLVESGGGVKQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 230 - protein, 108 aa, Artificial Sequence; identical to SEQ ID NO: 23
  Description of Artificial Sequence: Synthetic polypeptide
  VL of XENP019749

SEQ ID NO: 231 - protein, 5 aa, Artificial Sequence
  Description of Artificial Sequence: Synthetic peptide
  XENP019749 vhCDR1
SYTMH

SEQ ID NO: 232 - protein, 17 aa, Artificial Sequence
  Description of Artificial Sequence: Synthetic peptide
  XENP019749 vhCDR2
FISYDGNNKYYADSVKG

SEQ ID NO: 233 - protein, 9 aa, Artificial Sequence
  Description of Artificial Sequence: Synthetic peptide
  XENP019749 vhCDR3
TGWLGPFDY

SEQ ID NO: 234 - protein, 12 aa, Artificial Sequence
  Description of Artificial Sequence: Synthetic peptide
  XENP019749 vlCDR1
RASQSVGSSYLA

SEQ ID NO: 235 - protein, 7 aa, Artificial Sequence
  Description of Artificial Sequence: Synthetic peptide
  XENP019749 vlCDR2
GAFSRAT

SEQ ID NO: 236 - protein, 9 aa, Artificial Sequence
  Description of Artificial Sequence: Synthetic peptide
  XENP019749 vlCDR3
QQYGSSPWT

SEQ ID NO: 237 - protein, 246 aa, Artificial Sequence
  Description of Artificial Sequence: Synthetic polypeptide
  XENP019750 [CTLA-4]_H0.6_L0_scFv(GKPGS)4
QVQLVESGGGVVKPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 238 - protein, 118 aa, Artificial Sequence
  Description of Artificial Sequence: Synthetic polypeptide
  VH of XENP019750
QVQLVESGGGVVKPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 239 - protein, 108 aa, Artificial Sequence; identical to SEQ ID NO: 23
  Description of Artificial Sequence: Synthetic polypeptide
  VL of XENP019750

SEQ ID NO: 240 - protein, 5 aa, Artificial Sequence
  Description of Artificial Sequence: Synthetic peptide
  XENP019750 vhCDR1
SYTMH

SEQ ID NO: 241 - protein, 17 aa, Artificial Sequence
  Description of Artificial Sequence: Synthetic peptide
  XENP019750 vhCDR2
FISYDGNNKYYADSVKG

SEQ ID NO: 242 - protein, 9 aa, Artificial Sequence
  Description of Artificial Sequence: Synthetic peptide
  XENP019750 vhCDR3
TGWLGPFDY

SEQ ID NO: 243 - protein, 12 aa, Artificial Sequence
  Description of Artificial Sequence: Synthetic peptide
  XENP019750 vlCDR1
RASQSVGSSYLA

SEQ ID NO: 244 - protein, 7 aa, Artificial Sequence
  Description of Artificial Sequence: Synthetic peptide
  XENP019750 vlCDR2
GAFSRAT

SEQ ID NO: 245 - protein, 9 aa, Artificial Sequence
  Description of Artificial Sequence: Synthetic peptide
  XENP019750 vlCDR3
QQYGSSPWT

SEQ ID NO: 246 - protein, 246 aa, Artificial Sequence
  Description of Artificial Sequence: Synthetic polypeptide
  XENP019751 [CTLA-4]_H0.7_L0_scFv(GKPGS)4
QVQLVESGGGVVEPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 247 - protein, 118 aa, Artificial Sequence
  Description of Artificial Sequence: Synthetic polypeptide
  VH of XENP019751
QVQLVESGGGVVEPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 248 - protein, 108 aa, Artificial Sequence; identical to SEQ ID NO: 23
  Description of Artificial Sequence: Synthetic polypeptide
  VL of XENP019751

SEQ ID NO: 249 - protein, 5 aa, Artificial Sequence
  Description of Artificial Sequence: Synthetic peptide
  XENP019751 vhCDR1
SYTMH

SEQ ID NO: 250 - protein, 17 aa, Artificial Sequence
  Description of Artificial Sequence: Synthetic peptide
  XENP019751 vhCDR2
FISYDGNNKYYADSVKG

SEQ ID NO: 251 - protein, 9 aa, Artificial Sequence
  Description of Artificial Sequence: Synthetic peptide
  XENP019751 vhCDR3
TGWLGPFDY

SEQ ID NO: 252 - protein, 12 aa, Artificial Sequence
  Description of Artificial Sequence: Synthetic peptide
  XENP019751 vlCDR1
RASQSVGSSYLA

SEQ ID NO: 253 - protein, 7 aa, Artificial Sequence
  Description of Artificial Sequence: Synthetic peptide
  XENP019751 vlCDR2
GAFSRAT

SEQ ID NO: 254 - protein, 9 aa, Artificial Sequence
  Description of Artificial Sequence: Synthetic peptide
  XENP019751 vlCDR3
QQYGSSPWT

SEQ ID NO: 255 - protein, 246 aa, Artificial Sequence
  Description of Artificial Sequence: Synthetic polypeptide
  XENP019752 [CTLA-4]_H0.8_L0_scFv(GKPGS)4
QVQLVESGGGVVQPGGSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 256 - protein, 118 aa, Artificial Sequence
  Description of Artificial Sequence: Synthetic polypeptide
  VH of XENP019752
QVQLVESGGGVVQPGGSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 257 - protein, 108 aa, Artificial Sequence; identical to SEQ ID NO: 23
  Description of Artificial Sequence: Synthetic polypeptide
  VL of XENP019752

SEQ ID NO: 258 - protein, 5 aa, Artificial Sequence
  Description of Artificial Sequence: Synthetic peptide
  XENP019752 vhCDR1
SYTMH

SEQ ID NO: 259 - protein, 17 aa, Artificial Sequence
  Description of Artificial Sequence: Synthetic peptide
  XENP019752 vhCDR2
FISYDGNNKYYADSVKG

SEQ ID NO: 260 - protein, 9 aa, Artificial Sequence
  Description of Artificial Sequence: Synthetic peptide
  XENP019752 vhCDR3
TGWLGPFDY

SEQ ID NO: 261 - protein, 12 aa, Artificial Sequence
  Description of Artificial Sequence: Synthetic peptide
  XENP019752 vlCDR1
RASQSVGSSYLA

SEQ ID NO: 262 - protein, 7 aa, Artificial Sequence
  Description of Artificial Sequence: Synthetic peptide
  XENP019752 vlCDR2
GAFSRAT

SEQ ID NO: 263 - protein, 9 aa, Artificial Sequence
  Description of Artificial Sequence: Synthetic peptide
  XENP019752 vlCDR3
QQYGSSPWT

SEQ ID NO: 264 - protein, 246 aa, Artificial Sequence
  Description of Artificial Sequence: Synthetic polypeptide
  XENP019753 [CTLA-4]_H0.9_L0_scFv(GKPGS)4
QVQLVESGGGVVQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 265 - protein, 118 aa, Artificial Sequence
  Description of Artificial Sequence: Synthetic polypeptide
  VH of XENP019753
QVQLVESGGGVVQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 266 - protein, 108 aa, Artificial Sequence; identical to SEQ ID NO: 23
  Description of Artificial Sequence: Synthetic polypeptide
  VL of XENP019753

SEQ ID NO: 267 - protein, 5 aa, Artificial Sequence
  Description of Artificial Sequence: Synthetic peptide
  XENP019753 vhCDR1
SYTMH

SEQ ID NO: 268 - protein, 17 aa, Artificial Sequence
  Description of Artificial Sequence: Synthetic peptide
  XENP019753 vhCDR2
FISYDGNNKYYADSVKG

SEQ ID NO: 269 - protein, 9 aa, Artificial Sequence
  Description of Artificial Sequence: Synthetic peptide
  XENP019753 vhCDR3
TGWLGPFDY

SEQ ID NO: 270 - protein, 12 aa, Artificial Sequence
  Description of Artificial Sequence: Synthetic peptide
  XENP019753 vlCDR1
RASQSVGSSYLA

SEQ ID NO: 271 - protein, 7 aa, Artificial Sequence
  Description of Artificial Sequence: Synthetic peptide
  XENP019753 vlCDR2
GAFSRAT

SEQ ID NO: 272 - protein, 9 aa, Artificial Sequence
  Description of Artificial Sequence: Synthetic peptide
  XENP019753 vlCDR3
QQYGSSPWT

SEQ ID NO: 273 - protein, 246 aa, Artificial Sequence
  Description of Artificial Sequence: Synthetic polypeptide
  XENP019754 [CTLA-4]_H0.10_L0_scFv(GKPGS)4
QVQLVESGGGVVQPGRSLKLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 274 - protein, 118 aa, Artificial Sequence
  Description of Artificial Sequence: Synthetic polypeptide
  VH of XENP019754
QVQLVESGGGVVQPGRSLKLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 275 - protein, 108 aa, Artificial Sequence; identical to SEQ ID NO: 23
  Description of Artificial Sequence: Synthetic polypeptide
  VL of XENP019754

SEQ ID NO: 276 - protein, 5 aa, Artificial Sequence
  Description of Artificial Sequence: Synthetic peptide
  XENP019754 vhCDR1
SYTMH

SEQ ID NO: 277 - protein, 17 aa, Artificial Sequence
  Description of Artificial Sequence: Synthetic peptide
  XENP019754 vhCDR2
FISYDGNNKYYADSVKG

SEQ ID NO: 278 - protein, 9 aa, Artificial Sequence
  Description of Artificial Sequence: Synthetic peptide
  XENP019754 vhCDR3
TGWLGPFDY

SEQ ID NO: 279 - protein, 12 aa, Artificial Sequence
  Description of Artificial Sequence: Synthetic peptide
  XENP019754 vlCDR1
RASQSVGSSYLA

SEQ ID NO: 280 - protein, 7 aa, Artificial Sequence
  Description of Artificial Sequence: Synthetic peptide
  XENP019754 vlCDR2
GAFSRAT

SEQ ID NO: 281 - protein, 9 aa, Artificial Sequence
  Description of Artificial Sequence: Synthetic peptide
  XENP019754 vlCDR3
QQYGSSPWT

SEQ ID NO: 282 - protein, 246 aa, Artificial Sequence
  Description of Artificial Sequence: Synthetic polypeptide
  XENP019755 [CTLA-4]_H0.11_L0_scFv(GKPGS)4
QVQLVESGGGVVQPGRSLRLSCAASGFTVSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 283 - protein, 118 aa, Artificial Sequence
  Description of Artificial Sequence: Synthetic polypeptide
  VH of XENP019755
QVQLVESGGGVVQPGRSLRLSCAASGFTVSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 284 - protein, 108 aa, Artificial Sequence; identical to SEQ ID NO: 23
  Description of Artificial Sequence: Synthetic polypeptide
  VL of XENP019755

SEQ ID NO: 285 - protein, 5 aa, Artificial Sequence
  Description of Artificial Sequence: Synthetic peptide
  XENP019755 vhCDR1
SYTMH

SEQ ID NO: 286 - protein, 17 aa, Artificial Sequence
  Description of Artificial Sequence: Synthetic peptide
  XENP019755 vhCDR2
FISYDGNNKYYADSVKG

SEQ ID NO: 287 - protein, 9 aa, Artificial Sequence
  Description of Artificial Sequence: Synthetic peptide
  XENP019755 vhCDR3
TGWLGPFDY

SEQ ID NO: 288 - protein, 12 aa, Artificial Sequence
  Description of Artificial Sequence: Synthetic peptide
  XENP019755 vlCDR1
RASQSVGSSYLA

SEQ ID NO: 289 - protein, 7 aa, Artificial Sequence
  Description of Artificial Sequence: Synthetic peptide
  XENP019755 vlCDR2
GAFSRAT

SEQ ID NO: 290 - protein, 9 aa, Artificial Sequence
  Description of Artificial Sequence: Synthetic peptide
  XENP019755 vlCDR3
QQYGSSPWT

SEQ ID NO: 291 - protein, 246 aa, Artificial Sequence
  Description of Artificial Sequence: Synthetic polypeptide
  XENP019756 [CTLA-4]_H0.12_L0_scFv(GKPGS)4
QVQLVESGGGVVQPGRSLRLSCAASGFTFSAYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 292 - protein, 118 aa, Artificial Sequence
  Description of Artificial Sequence: Synthetic polypeptide
  VH of XENP019756
QVQLVESGGGVVQPGRSLRLSCAASGFTFSAYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 293 - protein, 108 aa, Artificial Sequence; identical to SEQ ID NO: 23
  Description of Artificial Sequence: Synthetic polypeptide
  VL of XENP019756

SEQ ID NO: 294 - protein, 5 aa, Artificial Sequence
  Description of Artificial Sequence: Synthetic peptide
  XENP019756 vhCDR1
AYTMH

SEQ ID NO: 295 - protein, 17 aa, Artificial Sequence
  Description of Artificial Sequence: Synthetic peptide
  XENP019756 vhCDR2
FISYDGNNKYYADSVKG

SEQ ID NO: 296 - protein, 9 aa, Artificial Sequence
  Description of Artificial Sequence: Synthetic peptide
  XENP019756 vhCDR3
TGWLGPFDY

SEQ ID NO: 297 - protein, 12 aa, Artificial Sequence
  Description of Artificial Sequence: Synthetic peptide
  XENP019756 vlCDR1
RASQSVGSSYLA

SEQ ID NO: 298 - protein, 7 aa, Artificial Sequence
  Description of Artificial Sequence: Synthetic peptide
  XENP019756 vlCDR2
GAFSRAT

SEQ ID NO: 299 - protein, 9 aa, Artificial Sequence
  Description of Artificial Sequence: Synthetic peptide
  XENP019756 vlCDR3
QQYGSSPWT

SEQ ID NO: 300 - protein, 246 aa, Artificial Sequence
  Description of Artificial Sequence: Synthetic polypeptide
  XENP019757 [CTLA-4]_H0.13_L0_scFv(GKPGS)4
QVQLVESGGGVVQPGRSLRLSCAASGFTFSDYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 301 - protein, 118 aa, Artificial Sequence
  Description of Artificial Sequence: Synthetic polypeptide
  VH of XENP019757
QVQLVESGGGVVQPGRSLRLSCAASGFTFSDYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 302 - protein, 108 aa, Artificial Sequence; identical to SEQ ID NO: 23
  Description of Artificial Sequence: Synthetic polypeptide
  VL of XENP019757

SEQ ID NO: 303 - protein, 5 aa, Artificial Sequence
  Description of Artificial Sequence: Synthetic peptide
  XENP019757 vhCDR1
DYTMH

SEQ ID NO: 304 - protein, 17 aa, Artificial Sequence
  Description of Artificial Sequence: Synthetic peptide
  XENP019757 vhCDR2
FISYDGNNKYYADSVKG

SEQ ID NO: 305 - protein, 9 aa, Artificial Sequence
  Description of Artificial Sequence: Synthetic peptide
  XENP019757 vhCDR3
TGWLGPFDY

SEQ ID NO: 306 - protein, 12 aa, Artificial Sequence
  Description of Artificial Sequence: Synthetic peptide
  XENP019757 vlCDR1
RASQSVGSSYLA

SEQ ID NO: 307 - protein, 7 aa, Artificial Sequence
  Description of Artificial Sequence: Synthetic peptide
  XENP019757 vlCDR2
GAFSRAT

SEQ ID NO: 308 - protein, 9 aa, Artificial Sequence
  Description of Artificial Sequence: Synthetic peptide
  XENP019757 vlCDR3
QQYGSSPWT

SEQ ID NO: 309 - protein, 246 aa, Artificial Sequence
  Description of Artificial Sequence: Synthetic polypeptide
  XENP019758 [CTLA-4]_H0.14_L0_scFv(GKPGS)4
QVQLVESGGGVVQPGRSLRLSCAASGFTFSGYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 310 - protein, 118 aa, Artificial Sequence
  Description of Artificial Sequence: Synthetic polypeptide
  VH of XENP019758
QVQLVESGGGVVQPGRSLRLSCAASGFTFSGYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 311 - protein, 108 aa, Artificial Sequence; identical to SEQ ID NO: 23
  Description of Artificial Sequence: Synthetic polypeptide
  VL of XENP019758

SEQ ID NO: 312 - protein, 5 aa, Artificial Sequence
  Description of Artificial Sequence: Synthetic peptide
  XENP019758 vhCDR1
GYTMH

SEQ ID NO: 313 - protein, 17 aa, Artificial Sequence
  Description of Artificial Sequence: Synthetic peptide
  XENP019758 vhCDR2
FISYDGNNKYYADSVKG

SEQ ID NO: 314 - protein, 9 aa, Artificial Sequence
  Description of Artificial Sequence: Synthetic peptide
  XENP019758 vhCDR3
TGWLGPFDY

SEQ ID NO: 315 - protein, 12 aa, Artificial Sequence
  Description of Artificial Sequence: Synthetic peptide
  XENP019758 vlCDR1
RASQSVGSSYLA

SEQ ID NO: 316 - protein, 7 aa, Artificial Sequence
  Description of Artificial Sequence: Synthetic peptide
  XENP019758 vlCDR2
GAFSRAT

SEQ ID NO: 317 - protein, 9 aa, Artificial Sequence
  Description of Artificial Sequence: Synthetic peptide
  XENP019758 vlCDR3
QQYGSSPWT

SEQ ID NO: 318 - protein, 246 aa, Artificial Sequence
  Description of Artificial Sequence: Synthetic polypeptide
  XENP019759 [CTLA-4]_H0.15_L0_scFv(GKPGS)4
QVQLVESGGGVVQPGRSLRLSCAASGFTFSNYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 319 - protein, 118 aa, Artificial Sequence
  Description of Artificial Sequence: Synthetic polypeptide
  VH of XENP019759
QVQLVESGGGVVQPGRSLRLSCAASGFTFSNYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 320 - protein, 108 aa, Artificial Sequence; identical to SEQ ID NO: 23
  Description of Artificial Sequence: Synthetic polypeptide
  VL of XENP019759

SEQ ID NO: 321 - protein, 5 aa, Artificial Sequence
  Description of Artificial Sequence: Synthetic peptide
  XENP019759 vhCDR1
NYTMH

SEQ ID NO: 322 - protein, 17 aa, Artificial Sequence
  Description of Artificial Sequence: Synthetic peptide
  XENP019759 vhCDR2
FISYDGNNKYYADSVKG

SEQ ID NO: 323 - protein, 9 aa, Artificial Sequence
  Description of Artificial Sequence: Synthetic peptide
  XENP019759 vhCDR3
TGWLGPFDY

SEQ ID NO: 324 - protein, 12 aa, Artificial Sequence
  Description of Artificial Sequence: Synthetic peptide
  XENP019759 vlCDR1
RASQSVGSSYLA

SEQ ID NO: 325 - protein, 7 aa, Artificial Sequence
  Description of Artificial Sequence: Synthetic peptide
  XENP019759 vlCDR2
GAFSRAT

SEQ ID NO: 326 - protein, 9 aa, Artificial Sequence
  Description of Artificial Sequence: Synthetic peptide
  XENP019759 vlCDR3
QQYGSSPWT

SEQ ID NO: 327 - protein, 246 aa, Artificial Sequence
  Description of Artificial Sequence: Synthetic polypeptide
  XENP019760 [CTLA-4]_H0.16_L0_scFv(GKPGS)4
QVQLVESGGGVVQPGRSLRLSCAASGFTFSQYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 328 - protein, 118 aa, Artificial Sequence
  Description of Artificial Sequence: Synthetic polypeptide
  VH of XENP019760
QVQLVESGGGVVQPGRSLRLSCAASGFTFSQYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 329 - protein, 108 aa, Artificial Sequence; identical to SEQ ID NO: 23
  Description of Artificial Sequence: Synthetic polypeptide
  VL of XENP019760

SEQ ID NO: 330 - protein, 5 aa, Artificial Sequence
  Description of Artificial Sequence: Synthetic peptide
  XENP019760 vhCDR1
QYTMH

SEQ ID NO: 331 - protein, 17 aa, Artificial Sequence
  Description of Artificial Sequence: Synthetic peptide
  XENP019760 vhCDR2
FISYDGNNKYYADSVKG

SEQ ID NO: 332 - protein, 9 aa, Artificial Sequence
  Description of Artificial Sequence: Synthetic peptide
  XENP019760 vhCDR3
TGWLGPFDY

SEQ ID NO: 333 - protein, 12 aa, Artificial Sequence
  Description of Artificial Sequence: Synthetic peptide
  XENP019760 vlCDR1
RASQSVGSSYLA

SEQ ID NO: 334 - protein, 7 aa, Artificial Sequence
  Description of Artificial Sequence: Synthetic peptide
  XENP019760 vlCDR2
GAFSRAT

SEQ ID NO: 335 - protein, 9 aa, Artificial Sequence
  Description of Artificial Sequence: Synthetic peptide
  XENP019760 vlCDR3
QQYGSSPWT

SEQ ID NO: 336 - protein, 246 aa, Artificial Sequence
  Description of Artificial Sequence: Synthetic polypeptide
  XENP019761 [CTLA-4]_H0.17_L0_scFv(GKPGS)4
QVQLVESGGGVVQPGRSLRLSCAASGFTFSTYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 337 - protein, 118 aa, Artificial Sequence
  Description of Artificial Sequence: Synthetic polypeptide
  VH of XENP019761
QVQLVESGGGVVQPGRSLRLSCAASGFTFSTYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 338 - protein, 108 aa, Artificial Sequence; identical to SEQ ID NO: 23
  Description of Artificial Sequence: Synthetic polypeptide
  VL of XENP019761

SEQ ID NO: 339 - protein, 5 aa, Artificial Sequence
  Description of Artificial Sequence: Synthetic peptide
  XENP019761 vhCDR1
TYTMH

SEQ ID NO: 340 - protein, 17 aa, Artificial Sequence
  Description of Artificial Sequence: Synthetic peptide
  XENP019761 vhCDR2
FISYDGNNKYYADSVKG

SEQ ID NO: 341 - protein, 9 aa, Artificial Sequence
  Description of Artificial Sequence: Synthetic peptide
  XENP019761 vhCDR3
TGWLGPFDY

SEQ ID NO: 342 - protein, 12 aa, Artificial Sequence
  Description of Artificial Sequence: Synthetic peptide
  XENP019761 vlCDR1
RASQSVGSSYLA

SEQ ID NO: 343 - protein, 7 aa, Artificial Sequence
  Description of Artificial Sequence: Synthetic peptide
  XENP019761 vlCDR2
GAFSRAT

SEQ ID NO: 344 - protein, 9 aa, Artificial Sequence
  Description of Artificial Sequence: Synthetic peptide
  XENP019761 vlCDR3
QQYGSSPWT

SEQ ID NO: 345 - protein, 246 aa, Artificial Sequence
  Description of Artificial Sequence: Synthetic polypeptide
  XENP019762 [CTLA-4]_H0.18_L0_scFv(GKPGS)4
QVQLVESGGGVVQPGRSLRLSCAASGFTFSSATMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 346 - protein, 118 aa, Artificial Sequence
  Description of Artificial Sequence: Synthetic polypeptide
  VH of XENP019762
QVQLVESGGGVVQPGRSLRLSCAASGFTFSSATMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 347 - protein, 108 aa, Artificial Sequence; identical to SEQ ID NO: 23
  Description of Artificial Sequence: Synthetic polypeptide
  VL of XENP019762

SEQ ID NO: 348 - protein, 5 aa, Artificial Sequence
  Description of Artificial Sequence: Synthetic peptide
  XENP019762 vhCDR1
SATMH

SEQ ID NO: 349 - protein, 17 aa, Artificial Sequence
  Description of Artificial Sequence: Synthetic peptide
  XENP019762 vhCDR2
FISYDGNNKYYADSVKG

SEQ ID NO: 350 - protein, 9 aa, Artificial Sequence
  Description of Artificial Sequence: Synthetic peptide
  XENP019762 vhCDR3
TGWLGPFDY

SEQ ID NO: 351 - protein, 12 aa, Artificial Sequence
  Description of Artificial Sequence: Synthetic peptide
  XENP019762 vlCDR1
RASQSVGSSYLA

SEQ ID NO: 352 - protein, 7 aa, Artificial Sequence
  Description of Artificial Sequence: Synthetic peptide
  XENP019762 vlCDR2
GAFSRAT

SEQ ID NO: 353 - protein, 9 aa, Artificial Sequence
  Description of Artificial Sequence: Synthetic peptide
  XENP019762 vlCDR3
QQYGSSPWT

SEQ ID NO: 354 - protein, 246 aa, Artificial Sequence
  Description of Artificial Sequence: Synthetic polypeptide
  XENP019763 [CTLA-4]_H0.19_L0_scFv(GKPGS)4
QVQLVESGGGVVQPGRSLRLSCAASGFTFSSHTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 355 - protein, 118 aa, Artificial Sequence
  Description of Artificial Sequence: Synthetic polypeptide
  VH of XENP019763
QVQLVESGGGVVQPGRSLRLSCAASGFTFSSHTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 356 - protein, 108 aa, Artificial Sequence; identical to SEQ ID NO: 23
  Description of Artificial Sequence: Synthetic polypeptide
  VL of XENP019763

SEQ ID NO: 357 - protein, 5 aa, Artificial Sequence
  Description of Artificial Sequence: Synthetic peptide
  XENP019763 vhCDR1
SHTMH

SEQ ID NO: 358 - protein, 17 aa, Artificial Sequence
  Description of Artificial Sequence: Synthetic peptide
  XENP019763 vhCDR2
FISYDGNNKYYADSVKG

SEQ ID NO: 359 - protein, 9 aa, Artificial Sequence
  Description of Artificial Sequence: Synthetic peptide
  XENP019763 vhCDR3
TGWLGPFDY

SEQ ID NO: 360 - protein, 12 aa, Artificial Sequence
  Description of Artificial Sequence: Synthetic peptide
  XENP019763 vlCDR1
RASQSVGSSYLA

SEQ ID NO: 361 - protein, 7 aa, Artificial Sequence
  Description of Artificial Sequence: Synthetic peptide
  XENP019763 vlCDR2
GAFSRAT

SEQ ID NO: 362 - protein, 9 aa, Artificial Sequence
  Description of Artificial Sequence: Synthetic peptide
  XENP019763 vlCDR3
QQYGSSPWT

SEQ ID NO: 363 - protein, 246 aa, Artificial Sequence
  Description of Artificial Sequence: Synthetic polypeptide
  XENP019764 [CTLA-4]_H0.20_L0_scFv(GKPGS)4
QVQLVESGGGVVQPGRSLRLSCAASGFTFSSFTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 364 - protein, 118 aa, Artificial Sequence
  Description of Artificial Sequence: Synthetic polypeptide
  VH of XENP019764
QVQLVESGGGVVQPGRSLRLSCAASGFTFSSFTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 365 - protein, 108 aa, Artificial Sequence; identical to SEQ ID NO: 23
  Description of Artificial Sequence: Synthetic polypeptide
  VL of XENP019764

SEQ ID NO: 366 - protein, 5 aa, Artificial Sequence
  Description of Artificial Sequence: Synthetic peptide
  XENP019764 vhCDR1
SFTMH

SEQ ID NO: 367 - protein, 17 aa, Artificial Sequence
  Description of Artificial Sequence: Synthetic peptide
  XENP019764 vhCDR2
FISYDGNNKYYADSVKG

SEQ ID NO: 368 - protein, 9 aa, Artificial Sequence
  Description of Artificial Sequence: Synthetic peptide
  XENP019764 vhCDR3
TGWLGPFDY

SEQ ID NO: 369 - protein, 12 aa, Artificial Sequence
  Description of Artificial Sequence: Synthetic peptide
  XENP019764 vlCDR1
RASQSVGSSYLA

SEQ ID NO: 370 - protein, 7 aa, Artificial Sequence
  Description of Artificial Sequence: Synthetic peptide
  XENP019764 vlCDR2
GAFSRAT

SEQ ID NO: 371 - protein, 9 aa, Artificial Sequence
  Description of Artificial Sequence: Synthetic peptide
  XENP019764 vlCDR3
QQYGSSPWT

SEQ ID NO: 372 - protein, 246 aa, Artificial Sequence
  Description of Artificial Sequence: Synthetic polypeptide
  XENP019765 [CTLA-4]_H0.21_L0_scFv(GKPGS)4
QVQLVESGGGVVQPGRSLRLSCAASGFTFSSLTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 373 - protein, 118 aa, Artificial Sequence
  Description of Artificial Sequence: Synthetic polypeptide
  VH of XENP019765
QVQLVESGGGVVQPGRSLRLSCAASGFTFSSLTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 374 - protein, 108 aa, Artificial Sequence; identical to SEQ ID NO: 23
  Description of Artificial Sequence: Synthetic polypeptide
  VL of XENP019765

SEQ ID NO: 375 - protein, 5 aa, Artificial Sequence
  Description of Artificial Sequence: Synthetic peptide
  XENP019765 vhCDR1
SLTMH

SEQ ID NO: 376 - protein, 17 aa, Artificial Sequence
  Description of Artificial Sequence: Synthetic peptide
  XENP019765 vhCDR2
FISYDGNNKYYADSVKG

SEQ ID NO: 377 - protein, 9 aa, Artificial Sequence
  Description of Artificial Sequence: Synthetic peptide
  XENP019765 vhCDR3
TGWLGPFDY

SEQ ID NO: 378 - protein, 12 aa, Artificial Sequence
  Description of Artificial Sequence: Synthetic peptide
  XENP019765 vlCDR1
RASQSVGSSYLA

SEQ ID NO: 379 - protein, 7 aa, Artificial Sequence
  Description of Artificial Sequence: Synthetic peptide
  XENP019765 vlCDR2
GAFSRAT

SEQ ID NO: 380 - protein, 9 aa, Artificial Sequence
  Description of Artificial Sequence: Synthetic peptide
  XENP019765 vlCDR3
QQYGSSPWT

SEQ ID NO: 381 - protein, 246 aa, Artificial Sequence
  Description of Artificial Sequence: Synthetic polypeptide
  XENP019766 [CTLA-4]_H0.22_L0_scFv(GKPGS)4
QVQLVESGGGVVQPGRSLRLSCAASGFTFSSNTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 382 - protein, 118 aa, Artificial Sequence
  Description of Artificial Sequence: Synthetic polypeptide
  VH of XENP019766
QVQLVESGGGVVQPGRSLRLSCAASGFTFSSNTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 383 - protein, 108 aa, Artificial Sequence; identical to SEQ ID NO: 23
  Description of Artificial Sequence: Synthetic polypeptide
  VL of XENP019766

SEQ ID NO: 384 - protein, 5 aa, Artificial Sequence
  Description of Artificial Sequence: Synthetic peptide
  XENP019766 vhCDR1
SNTMH

SEQ ID NO: 385 - protein, 17 aa, Artificial Sequence
  Description of Artificial Sequence: Synthetic peptide
  XENP019766 vhCDR2
FISYDGNNKYYADSVKG

SEQ ID NO: 386 - protein, 9 aa, Artificial Sequence
  Description of Artificial Sequence: Synthetic peptide
  XENP019766 vhCDR3
TGWLGPFDY

SEQ ID NO: 387 - protein, 12 aa, Artificial Sequence
  Description of Artificial Sequence: Synthetic peptide
  XENP019766 vlCDR1
RASQSVGSSYLA

SEQ ID NO: 388 - protein, 7 aa, Artificial Sequence
  Description of Artificial Sequence: Synthetic peptide
  XENP019766 vlCDR2
GAFSRAT

SEQ ID NO: 389 - protein, 9 aa, Artificial Sequence
  Description of Artificial Sequence: Synthetic peptide
  XENP019766 vlCDR3
QQYGSSPWT

SEQ ID NO: 390 - protein, 246 aa, Artificial Sequence
  Description of Artificial Sequence: Synthetic polypeptide
  XENP019767 [CTLA-4]_H0.23_L0_scFv(GKPGS)4
QVQLVESGGGVVQPGRSLRLSCAASGFTFSSSTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 391 - protein, 118 aa, Artificial Sequence
  Description of Artificial Sequence: Synthetic polypeptide
  VH of XENP019767
QVQLVESGGGVVQPGRSLRLSCAASGFTFSSSTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 392 - protein, 108 aa, Artificial Sequence; identical to SEQ ID NO: 23
  Description of Artificial Sequence: Synthetic polypeptide
  VL of XENP019767

SEQ ID NO: 393 - protein, 5 aa, Artificial Sequence
  Description of Artificial Sequence: Synthetic peptide
  XENP019767 vhCDR1
SSTMH

SEQ ID NO: 394 - protein, 17 aa, Artificial Sequence
  Description of Artificial Sequence: Synthetic peptide
  XENP019767 vhCDR2
FISYDGNNKYYADSVKG

SEQ ID NO: 395 - protein, 9 aa, Artificial Sequence
  Description of Artificial Sequence: Synthetic peptide
  XENP019767 vhCDR3
TGWLGPFDY

SEQ ID NO: 396 - protein, 12 aa, Artificial Sequence
  Description of Artificial Sequence: Synthetic peptide
  XENP019767 vlCDR1
RASQSVGSSYLA

SEQ ID NO: 397 - protein, 7 aa, Artificial Sequence
  Description of Artificial Sequence: Synthetic peptide
  XENP019767 vlCDR2
GAFSRAT

SEQ ID NO: 398 - protein, 9 aa, Artificial Sequence
  Description of Artificial Sequence: Synthetic peptide
  XENP019767 vlCDR3
QQYGSSPWT

SEQ ID NO: 399 - protein, 246 aa, Artificial Sequence
  Description of Artificial Sequence: Synthetic polypeptide
  XENP019768 [CTLA-4]_H0.24_L0_scFv(GKPGS)4
QVQLVESGGGVVQPGRSLRLSCAASGFTFSSVTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 400 - protein, 118 aa, Artificial Sequence
  Description of Artificial Sequence: Synthetic polypeptide
  VH of XENP019768
QVQLVESGGGVVQPGRSLRLSCAASGFTFSSVTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 401 - protein, 108 aa, Artificial Sequence; identical to SEQ ID NO: 23
  Description of Artificial Sequence: Synthetic polypeptide
  VL of XENP019768

SEQ ID NO: 402 - protein, 5 aa, Artificial Sequence
  Description of Artificial Sequence: Synthetic peptide
  XENP019768 vhCDR1
SVTMH

SEQ ID NO: 403 - protein, 17 aa, Artificial Sequence
  Description of Artificial Sequence: Synthetic peptide
  XENP019768 vhCDR2
FISYDGNNKYYADSVKG

SEQ ID NO: 404 - protein, 9 aa, Artificial Sequence
  Description of Artificial Sequence: Synthetic peptide
  XENP019768 vhCDR3
TGWLGPFDY

SEQ ID NO: 405 - protein, 12 aa, Artificial Sequence
  Description of Artificial Sequence: Synthetic peptide
  XENP019768 vlCDR1
RASQSVGSSYLA

SEQ ID NO: 406 - protein, 7 aa, Artificial Sequence
  Description of Artificial Sequence: Synthetic peptide
  XENP019768 vlCDR2
GAFSRAT

SEQ ID NO: 407 - protein, 9 aa, Artificial Sequence
  Description of Artificial Sequence: Synthetic peptide
  XENP019768 vlCDR3
QQYGSSPWT

SEQ ID NO: 408 - protein, 246 aa, Artificial Sequence
  Description of Artificial Sequence: Synthetic polypeptide
  XENP019769 [CTLA-4]_H0.25_L0_scFv(GKPGS)4
QVQLVESGGGVVQPGRSLRLSCAASGFTFSSYAMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 409 - protein, 118 aa, Artificial Sequence
  Description of Artificial Sequence: Synthetic polypeptide
  VH of XENP019769
QVQLVESGGGVVQPGRSLRLSCAASGFTFSSYAMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 410 - protein, 108 aa, Artificial Sequence; identical to SEQ ID NO: 23
  Description of Artificial Sequence: Synthetic polypeptide
  VL of XENP019769

SEQ ID NO: 411 - protein, 5 aa, Artificial Sequence
  Description of Artificial Sequence: Synthetic peptide
  XENP019769 vhCDR1
SYAMH

SEQ ID NO: 412 - protein, 17 aa, Artificial Sequence
  Description of Artificial Sequence: Synthetic peptide
  XENP019769 vhCDR2
FISYDGNNKYYADSVKG

SEQ ID NO: 413 - protein, 9 aa, Artificial Sequence
  Description of Artificial Sequence: Synthetic peptide
  XENP019769 vhCDR3
TGWLGPFDY

SEQ ID NO: 414 - protein, 12 aa, Artificial Sequence
  Description of Artificial Sequence: Synthetic peptide
  XENP019769 vlCDR1
RASQSVGSSYLA

SEQ ID NO: 415 - protein, 7 aa, Artificial Sequence
  Description of Artificial Sequence: Synthetic peptide
  XENP019769 vlCDR2
GAFSRAT

SEQ ID NO: 416 - protein, 9 aa, Artificial Sequence
  Description of Artificial Sequence: Synthetic peptide
  XENP019769 vlCDR3
QQYGSSPWT

SEQ ID NO: 417 - protein, 246 aa, Artificial Sequence
  Description of Artificial Sequence: Synthetic polypeptide
  XENP019770 [CTLA-4]_H0.26_L0_scFv(GKPGS)4
QVQLVESGGGVVQPGRSLRLSCAASGFTFSSYGMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 418 - protein, 118 aa, Artificial Sequence
  Description of Artificial Sequence: Synthetic polypeptide
  VH of XENP019770
QVQLVESGGGVVQPGRSLRLSCAASGFTFSSYGMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 419 - protein, 108 aa, Artificial Sequence; identical to SEQ ID NO: 23
  Description of Artificial Sequence: Synthetic polypeptide
  VL of XENP019770

SEQ ID NO: 420 - protein, 5 aa, Artificial Sequence
  Description of Artificial Sequence: Synthetic peptide
  XENP019770 vhCDR1
SYGMH

SEQ ID NO: 421 - protein, 17 aa, Artificial Sequence
  Description of Artificial Sequence: Synthetic peptide
  XENP019770 vhCDR2
FISYDGNNKYYADSVKG

SEQ ID NO: 422 - protein, 9 aa, Artificial Sequence
  Description of Artificial Sequence: Synthetic peptide
  XENP019770 vhCDR3
TGWLGPFDY

SEQ ID NO: 423 - protein, 12 aa, Artificial Sequence
  Description of Artificial Sequence: Synthetic peptide
  XENP019770 vlCDR1
RASQSVGSSYLA

SEQ ID NO: 424 - protein, 7 aa, Artificial Sequence
  Description of Artificial Sequence: Synthetic peptide
  XENP019770 vlCDR2
GAFSRAT

SEQ ID NO: 425 - protein, 9 aa, Artificial Sequence
  Description of Artificial Sequence: Synthetic peptide
  XENP019770 vlCDR3
QQYGSSPWT

SEQ ID NO: 426 - protein, 246 aa, Artificial Sequence
  Description of Artificial Sequence: Synthetic polypeptide
  XENP019771 [CTLA-4]_H0.27_L0_scFv(GKPGS)4
QVQLVESGGGVVQPGRSLRLSCAASGFTFSSYSMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 427 - protein, 118 aa, Artificial Sequence
  Description of Artificial Sequence: Synthetic polypeptide
  VH of XENP019771
QVQLVESGGGVVQPGRSLRLSCAASGFTFSSYSMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 428 - protein, 108 aa, Artificial Sequence; identical to SEQ ID NO: 23
  Description of Artificial Sequence: Synthetic polypeptide
  VL of XENP019771

SEQ ID NO: 429 - protein, 5 aa, Artificial Sequence
  Description of Artificial Sequence: Synthetic peptide
  XENP019771 vhCDR1
SYSMH

SEQ ID NO: 430 - protein, 17 aa, Artificial Sequence
  Description of Artificial Sequence: Synthetic peptide
  XENP019771 vhCDR2
FISYDGNNKYYADSVKG

SEQ ID NO: 431 - protein, 9 aa, Artificial Sequence
  Description of Artificial Sequence: Synthetic peptide
  XENP019771 vhCDR3
TGWLGPFDY

SEQ ID NO: 432 - protein, 12 aa, Artificial Sequence
  Description of Artificial Sequence: Synthetic peptide
  XENP019771 vlCDR1
RASQSVGSSYLA

SEQ ID NO: 433 - protein, 7 aa, Artificial Sequence
  Description of Artificial Sequence: Synthetic peptide
  XENP019771 vlCDR2
GAFSRAT

SEQ ID NO: 434 - protein, 9 aa, Artificial Sequence
  Description of Artificial Sequence: Synthetic peptide
  XENP019771 vlCDR3
QQYGSSPWT

SEQ ID NO: 435 - protein, 246 aa, Artificial Sequence
  Description of Artificial Sequence: Synthetic polypeptide
  XENP019772 [CTLA-4]_H0.28_L0_scFv(GKPGS)4
QVQLVESGGGVVQPGRSLRLSCAASGFTFSSYVMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 436 - protein, 118 aa, Artificial Sequence
  Description of Artificial Sequence: Synthetic polypeptide
  VH of XENP019772
QVQLVESGGGVVQPGRSLRLSCAASGFTFSSYVMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 437 - protein, 108 aa, Artificial Sequence; identical to SEQ ID NO: 23
  Description of Artificial Sequence: Synthetic polypeptide
  VL of XENP019772

SEQ ID NO: 438 - protein, 5 aa, Artificial Sequence
  Description of Artificial Sequence: Synthetic peptide
  XENP019772 vhCDR1
SYVMH

SEQ ID NO: 439 - protein, 17 aa, Artificial Sequence
  Description of Artificial Sequence: Synthetic peptide
  XENP019772 vhCDR2
FISYDGNNKYYADSVKG

SEQ ID NO: 440 - protein, 9 aa, Artificial Sequence
  Description of Artificial Sequence: Synthetic peptide
  XENP019772 vhCDR3
TGWLGPFDY

SEQ ID NO: 441 - protein, 12 aa, Artificial Sequence
  Description of Artificial Sequence: Synthetic peptide
  XENP019772 vlCDR1
RASQSVGSSYLA

SEQ ID NO: 442 - protein, 7 aa, Artificial Sequence
  Description of Artificial Sequence: Synthetic peptide
  XENP019772 vlCDR2
GAFSRAT

SEQ ID NO: 443 - protein, 9 aa, Artificial Sequence
  Description of Artificial Sequence: Synthetic peptide
  XENP019772 vlCDR3
QQYGSSPWT

SEQ ID NO: 444 - protein, 246 aa, Artificial Sequence
  Description of Artificial Sequence: Synthetic polypeptide
  XENP019773 [CTLA-4]_H0.29_L0_scFv(GKPGS)4
QVQLVESGGGVVQPGRSLRLSCAASGFTFSSYYMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 445 - protein, 118 aa, Artificial Sequence
  Description of Artificial Sequence: Synthetic polypeptide
  VH of XENP019773
QVQLVESGGGVVQPGRSLRLSCAASGFTFSSYYMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 446 - protein, 108 aa, Artificial Sequence; identical to SEQ ID NO: 23
  Description of Artificial Sequence: Synthetic polypeptide
  VL of XENP019773

SEQ ID NO: 447 - protein, 5 aa, Artificial Sequence
  Description of Artificial Sequence: Synthetic peptide
  XENP019773 vhCDR1
SYYMH

SEQ ID NO: 448 - protein, 17 aa, Artificial Sequence
  Description of Artificial Sequence: Synthetic peptide
  XENP019773 vhCDR2
FISYDGNNKYYADSVKG

SEQ ID NO: 449 - protein, 9 aa, Artificial Sequence
  Description of Artificial Sequence: Synthetic peptide
  XENP019773 vhCDR3
TGWLGPFDY

SEQ ID NO: 450 - protein, 12 aa, Artificial Sequence
  Description of Artificial Sequence: Synthetic peptide
  XENP019773 vlCDR1
RASQSVGSSYLA

SEQ ID NO: 451 - protein, 7 aa, Artificial Sequence
  Description of Artificial Sequence: Synthetic peptide
  XENP019773 vlCDR2
GAFSRAT

SEQ ID NO: 452 - protein, 9 aa, Artificial Sequence
  Description of Artificial Sequence: Synthetic peptide
  XENP019773 vlCDR3
QQYGSSPWT

SEQ ID NO: 453 - protein, 246 aa, Artificial Sequence
  Description of Artificial Sequence: Synthetic polypeptide
  XENP019774 [CTLA-4]_H0.30_L0_scFv(GKPGS)4
QVQLVESGGGVVQPGRSLRLSCAASGFTFSSYTMDWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 454 - protein, 118 aa, Artificial Sequence
  Description of Artificial Sequence: Synthetic polypeptide
  VH of XENP019774
QVQLVESGGGVVQPGRSLRLSCAASGFTFSSYTMDWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 455 - protein, 108 aa, Artificial Sequence; identical to SEQ ID NO: 23
  Description of Artificial Sequence: Synthetic polypeptide
  VL of XENP019774

SEQ ID NO: 456 - protein, 5 aa, Artificial Sequence
  Description of Artificial Sequence: Synthetic peptide
  XENP019774 vhCDR1
SYTMD

SEQ ID NO: 457 - protein, 17 aa, Artificial Sequence
  Description of Artificial Sequence: Synthetic peptide
  XENP019774 vhCDR2
FISYDGNNKYYADSVKG

SEQ ID NO: 458 - protein, 9 aa, Artificial Sequence
  Description of Artificial Sequence: Synthetic peptide
  XENP019774 vhCDR3
TGWLGPFDY

SEQ ID NO: 459 - protein, 12 aa, Artificial Sequence
  Description of Artificial Sequence: Synthetic peptide
  XENP019774 vlCDR1
RASQSVGSSYLA

SEQ ID NO: 460 - protein, 7 aa, Artificial Sequence
  Description of Artificial Sequence: Synthetic peptide
  XENP019774 vlCDR2
GAFSRAT

SEQ ID NO: 461 - protein, 9 aa, Artificial Sequence
  Description of Artificial Sequence: Synthetic peptide
  XENP019774 vlCDR3
QQYGSSPWT

SEQ ID NO: 462 - protein, 246 aa, Artificial Sequence
  Description of Artificial Sequence: Synthetic polypeptide
  XENP019775 [CTLA-4]_H0.31_L0_scFv(GKPGS)4
QVQLVESGGGVVQPGRSLRLSCAASGFTFSSYTMFWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 463 - protein, 118 aa, Artificial Sequence
  Description of Artificial Sequence: Synthetic polypeptide
  VH of XENP019775
QVQLVESGGGVVQPGRSLRLSCAASGFTFSSYTMFWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 464 - protein, 108 aa, Artificial Sequence; identical to SEQ ID NO: 23
  Description of Artificial Sequence: Synthetic polypeptide
  VL of XENP019775

SEQ ID NO: 465 - protein, 5 aa, Artificial Sequence
  Description of Artificial Sequence: Synthetic peptide
  XENP019775 vhCDR1
SYTMF

SEQ ID NO: 466 - protein, 17 aa, Artificial Sequence
  Description of Artificial Sequence: Synthetic peptide
  XENP019775 vhCDR2
FISYDGNNKYYADSVKG

SEQ ID NO: 467 - protein, 9 aa, Artificial Sequence
  Description of Artificial Sequence: Synthetic peptide
  XENP019775 vhCDR3
TGWLGPFDY

SEQ ID NO: 468 - protein, 12 aa, Artificial Sequence
  Description of Artificial Sequence: Synthetic peptide
  XENP019775 vlCDR1
RASQSVGSSYLA

SEQ ID NO: 469 - protein, 7 aa, Artificial Sequence
  Description of Artificial Sequence: Synthetic peptide
  XENP019775 vlCDR2
GAFSRAT

SEQ ID NO: 470 - protein, 9 aa, Artificial Sequence
  Description of Artificial Sequence: Synthetic peptide
  XENP019775 vlCDR3
QQYGSSPWT

SEQ ID NO: 471 - protein, 246 aa, Artificial Sequence
  Description of Artificial Sequence: Synthetic polypeptide
  XENP019776 [CTLA-4]_H0.32_L0_scFv(GKPGS)4
QVQLVESGGGVVQPGRSLRLSCAASGFTFSSYTMNWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 472 - protein, 118 aa, Artificial Sequence
  Description of Artificial Sequence: Synthetic polypeptide
  VH of XENP019776
QVQLVESGGGVVQPGRSLRLSCAASGFTFSSYTMNWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 473 - protein, 108 aa, Artificial Sequence; identical to SEQ ID NO: 23
  Description of Artificial Sequence: Synthetic polypeptide
  VL of XENP019776

SEQ ID NO: 474 - protein, 5 aa, Artificial Sequence
  Description of Artificial Sequence: Synthetic peptide
  XENP019776 vhCDR1
SYTMN

SEQ ID NO: 475 - protein, 17 aa, Artificial Sequence
  Description of Artificial Sequence: Synthetic peptide
  XENP019776 vhCDR2
FISYDGNNKYYADSVKG

SEQ ID NO: 476 - protein, 9 aa, Artificial Sequence
  Description of Artificial Sequence: Synthetic peptide
  XENP019776 vhCDR3
TGWLGPFDY

SEQ ID NO: 477 - protein, 12 aa, Artificial Sequence
  Description of Artificial Sequence: Synthetic peptide
  XENP019776 vlCDR1
RASQSVGSSYLA

SEQ ID NO: 478 - protein, 7 aa, Artificial Sequence
  Description of Artificial Sequence: Synthetic peptide
  XENP019776 vlCDR2
GAFSRAT

SEQ ID NO: 479 - protein, 9 aa, Artificial Sequence
  Description of Artificial Sequence: Synthetic peptide
  XENP019776 vlCDR3
QQYGSSPWT

SEQ ID NO: 480 - protein, 246 aa, Artificial Sequence
  Description of Artificial Sequence: Synthetic polypeptide
  XENP019777 [CTLA-4]_H0.33_L0_scFv(GKPGS)4
QVQLVESGGGVVQPGRSLRLSCAASGFTFSSYTMSWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 481 - protein, 118 aa, Artificial Sequence
  Description of Artificial Sequence: Synthetic polypeptide
  VH of XENP019777
QVQLVESGGGVVQPGRSLRLSCAASGFTFSSYTMSWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 482 - protein, 108 aa, Artificial Sequence; identical to SEQ ID NO: 23
  Description of Artificial Sequence: Synthetic polypeptide
  VL of XENP019777

SEQ ID NO: 483 - protein, 5 aa, Artificial Sequence
  Description of Artificial Sequence: Synthetic peptide
  XENP019777 vhCDR1
SYTMS

SEQ ID NO: 484 - protein, 17 aa, Artificial Sequence
  Description of Artificial Sequence: Synthetic peptide
  XENP019777 vhCDR2
FISYDGNNKYYADSVKG

SEQ ID NO: 485 - protein, 9 aa, Artificial Sequence
  Description of Artificial Sequence: Synthetic peptide
  XENP019777 vhCDR3
TGWLGPFDY

SEQ ID NO: 486 - protein, 12 aa, Artificial Sequence
  Description of Artificial Sequence: Synthetic peptide
  XENP019777 vlCDR1
RASQSVGSSYLA

SEQ ID NO: 487 - protein, 7 aa, Artificial Sequence
  Description of Artificial Sequence: Synthetic peptide
  XENP019777 vlCDR2
GAFSRAT

SEQ ID NO: 488 - protein, 9 aa, Artificial Sequence
  Description of Artificial Sequence: Synthetic peptide
  XENP019777 vlCDR3
QQYGSSPWT

SEQ ID NO: 489 - protein, 246 aa, Artificial Sequence
  Description of Artificial Sequence: Synthetic polypeptide
  XENP019778 [CTLA-4]_H0.34_L0_scFv(GKPGS)4
QVQLVESGGGVVQPGRSLRLSCAASGFTFSSYTMYWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 490 - protein, 118 aa, Artificial Sequence
  Description of Artificial Sequence: Synthetic polypeptide
  VH of XENP019778
QVQLVESGGGVVQPGRSLRLSCAASGFTFSSYTMYWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 491 - protein, 108 aa, Artificial Sequence; identical to SEQ ID NO: 23
  Description of Artificial Sequence: Synthetic polypeptide
  VL of XENP019778

SEQ ID NO: 492 - protein, 5 aa, Artificial Sequence
  Description of Artificial Sequence: Synthetic peptide
  XENP019778 vhCDR1
SYTMY

SEQ ID NO: 493 - protein, 17 aa, Artificial Sequence
  Description of Artificial Sequence: Synthetic peptide
  XENP019778 vhCDR2
FISYDGNNKYYADSVKG

SEQ ID NO: 494 - protein, 9 aa, Artificial Sequence
  Description of Artificial Sequence: Synthetic peptide
  XENP019778 vhCDR3
TGWLGPFDY

SEQ ID NO: 495 - protein, 12 aa, Artificial Sequence
  Description of Artificial Sequence: Synthetic peptide
  XENP019778 vlCDR1
RASQSVGSSYLA

SEQ ID NO: 496 - protein, 7 aa, Artificial Sequence
  Description of Artificial Sequence: Synthetic peptide
  XENP019778 vlCDR2
GAFSRAT

SEQ ID NO: 497 - protein, 9 aa, Artificial Sequence
  Description of Artificial Sequence: Synthetic peptide
  XENP019778 vlCDR3
QQYGSSPWT

SEQ ID NO: 498 - protein, 246 aa, Artificial Sequence
  Description of Artificial Sequence: Synthetic polypeptide
  XENP019779 [CTLA-4]_H0.35_L0_scFv(GKPGS)4
QVQLVESGGGVVQPGRSLRLSCAASGFTFSSYTMHWIRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 499 - protein, 118 aa, Artificial Sequence
  Description of Artificial Sequence: Synthetic polypeptide
  VH of XENP019779
QVQLVESGGGVVQPGRSLRLSCAASGFTFSSYTMHWIRQAPGKGLEWVTFISYDGNNKYYADSVKGRFTISRDNSKNTLYLQMNSLRAEDTAIYYCARTGWLGPFDYWGQGTLVTVSS

SEQ ID NO: 500 - protein, 108 aa, Artificial Sequence; identical to SEQ ID NO: 23
  Description of Artificial Sequence: Synthetic polypeptide
  VL of XENP019779

SEQ ID NO: 501 - protein, 5 aa, Artificial Sequence
  Description of Artificial Sequence: Synthetic peptide
  XENP019779 vhCDR1
SYTMH

SEQ ID NO: 502 - protein, 17 aa, Artificial Sequence
  Description of Artificial Sequence: Synthetic peptide
  XENP019779 vhCDR2
FISYDGNNKYYADSVKG

SEQ ID NO: 503 - protein, 9 aa, Artificial Sequence
  Description of Artificial Sequence: Synthetic peptide
  XENP019779 vhCDR3
TGWLGPFDY

SEQ ID NO: 504 - protein, 12 aa, Artificial Sequence
  Description of Artificial Sequence: Synthetic peptide
  XENP019779 vlCDR1
RASQSVGSSYLA

SEQ ID NO: 505 - protein, 7 aa, Artificial Sequence
  Description of Artificial Sequence: Synthetic peptide
  XENP019779 vlCDR2
GAFSRAT

SEQ ID NO: 506 - protein, 9 aa, Artificial Sequence
  Description of Artificial Sequence: Synthetic peptide
  XENP019779 vlCDR3
QQYGSSPWT

SEQ ID NO: 507 - protein, 246 aa, Artificial Sequence
  Description of Artificial Sequence: Synthetic polypeptide
  XENP019780 [CTLA-4]_H0.36_L0_scFv(GKPGS)4
QVQLVESGGGVVQPGRSLRLSCAASGFTFSSYTMHWVRKAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 508 - protein, 118 aa, Artificial Sequence; identical to SEQ ID NO: 31
  Description of Artificial Sequence: Synthetic polypeptide
  VH of XENP019780

SEQ ID NO: 509 - protein, 108 aa, Artificial Sequence; identical to SEQ ID NO: 23
  Description of Artificial Sequence: Synthetic polypeptide
  VL of XENP019780

SEQ ID NO: 510 - protein, 5 aa, Artificial Sequence
  Description of Artificial Sequence: Synthetic peptide
  XENP019780 vhCDR1
SYTMH

SEQ ID NO: 511 - protein, 17 aa, Artificial Sequence
  Description of Artificial Sequence: Synthetic peptide
  XENP019780 vhCDR2
FISYDGNNKYYADSVKG

SEQ ID NO: 512 - protein, 9 aa, Artificial Sequence
  Description of Artificial Sequence: Synthetic peptide
  XENP019780 vhCDR3
TGWLGPFDY

SEQ ID NO: 513 - protein, 12 aa, Artificial Sequence
  Description of Artificial Sequence: Synthetic peptide
  XENP019780 vlCDR1
RASQSVGSSYLA

SEQ ID NO: 514 - protein, 7 aa, Artificial Sequence
  Description of Artificial Sequence: Synthetic peptide
  XENP019780 vlCDR2
GAFSRAT

SEQ ID NO: 515 - protein, 9 aa, Artificial Sequence
  Description of Artificial Sequence: Synthetic peptide
  XENP019780 vlCDR3
QQYGSSPWT

SEQ ID NO: 516 - protein, 246 aa, Artificial Sequence
  Description of Artificial Sequence: Synthetic polypeptide
  XENP019781 [CTLA-4]_H0.37_L0_scFv(GKPGS)4
QVQLVESGGGVVQPGRSLRLSCAASGFTFSSYTMHWVRQAPGKRLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 517 - protein, 118 aa, Artificial Sequence; identical to SEQ ID NO: 49
  Description of Artificial Sequence: Synthetic polypeptide
  VH of XENP019781

SEQ ID NO: 518 - protein, 108 aa, Artificial Sequence; identical to SEQ ID NO: 23
  Description of Artificial Sequence: Synthetic polypeptide
  VL of XENP019781

SEQ ID NO: 519 - protein, 5 aa, Artificial Sequence
  Description of Artificial Sequence: Synthetic peptide
  XENP019781 vhCDR1
SYTMH

SEQ ID NO: 520 - protein, 17 aa, Artificial Sequence
  Description of Artificial Sequence: Synthetic peptide
  XENP019781 vhCDR2
FISYDGNNKYYADSVKG

SEQ ID NO: 521 - protein, 9 aa, Artificial Sequence
  Description of Artificial Sequence: Synthetic peptide
  XENP019781 vhCDR3
TGWLGPFDY

SEQ ID NO: 522 - protein, 12 aa, Artificial Sequence
  Description of Artificial Sequence: Synthetic peptide
  XENP019781 vlCDR1
RASQSVGSSYLA

SEQ ID NO: 523 - protein, 7 aa, Artificial Sequence
  Description of Artificial Sequence: Synthetic peptide
  XENP019781 vlCDR2
GAFSRAT

SEQ ID NO: 524 - protein, 9 aa, Artificial Sequence
  Description of Artificial Sequence: Synthetic peptide
  XENP019781 vlCDR3
QQYGSSPWT

SEQ ID NO: 525 - protein, 246 aa, Artificial Sequence
  Description of Artificial Sequence: Synthetic polypeptide
  XENP019782 [CTLA-4]_H0.38_L0_scFv(GKPGS)4
QVQLVESGGGVVQPGRSLRLSCAASGFTFSSYTMHWVRQAPGKGLEWVAFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 526 - protein, 118 aa, Artificial Sequence
  Description of Artificial Sequence: Synthetic polypeptide
  VH of XENP019782
QVQLVESGGGVVQPGRSLRLSCAASGFTFSSYTMHWVRQAPGKGLEWVAFISYDGNNKYYADSVKGRFTISRDNSKNTLYLQMNSLRAEDTAIYYCARTGWLGPFDYWGQGTLVTVSS

SEQ ID NO: 527 - protein, 108 aa, Artificial Sequence; identical to SEQ ID NO: 23
  Description of Artificial Sequence: Synthetic polypeptide
  VL of XENP019782

SEQ ID NO: 528 - protein, 5 aa, Artificial Sequence
  Description of Artificial Sequence: Synthetic peptide
  XENP019782 vhCDR1
SYTMH

SEQ ID NO: 529 - protein, 17 aa, Artificial Sequence
  Description of Artificial Sequence: Synthetic peptide
  XENP019782 vhCDR2
FISYDGNNKYYADSVKG

SEQ ID NO: 530 - protein, 9 aa, Artificial Sequence
  Description of Artificial Sequence: Synthetic peptide
  XENP019782 vhCDR3
TGWLGPFDY

SEQ ID NO: 531 - protein, 12 aa, Artificial Sequence
  Description of Artificial Sequence: Synthetic peptide
  XENP019782 vlCDR1
RASQSVGSSYLA

SEQ ID NO: 532 - protein, 7 aa, Artificial Sequence
  Description of Artificial Sequence: Synthetic peptide
  XENP019782 vlCDR2
GAFSRAT

SEQ ID NO: 533 - protein, 9 aa, Artificial Sequence
  Description of Artificial Sequence: Synthetic peptide
  XENP019782 vlCDR3
QQYGSSPWT

SEQ ID NO: 534 - protein, 246 aa, Artificial Sequence
  Description of Artificial Sequence: Synthetic polypeptide
  XENP019783 [CTLA-4]_H0.39_L0_scFv(GKPGS)4
QVQLVESGGGVVQPGRSLRLSCAASGFTFSSYTMHWVRQAPGKGLEWVGFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 535 - protein, 118 aa, Artificial Sequence
  Description of Artificial Sequence: Synthetic polypeptide
  VH of XENP019783
QVQLVESGGGVVQPGRSLRLSCAASGFTFSSYTMHWVRQAPGKGLEWVGFISYDGNNKYYADSVKGRFTISRDNSKNTLYLQMNSLRAEDTAIYYCARTGWLGPFDYWGQGTLVTVSS

SEQ ID NO: 536 - protein, 108 aa, Artificial Sequence; identical to SEQ ID NO: 23
  Description of Artificial Sequence: Synthetic polypeptide
  VL of XENP019783

SEQ ID NO: 537 - protein, 5 aa, Artificial Sequence
  Description of Artificial Sequence: Synthetic peptide
  XENP019783 vhCDR1
SYTMH

SEQ ID NO: 538 - protein, 17 aa, Artificial Sequence
  Description of Artificial Sequence: Synthetic peptide
  XENP019783 vhCDR2
FISYDGNNKYYADSVKG

SEQ ID NO: 539 - protein, 9 aa, Artificial Sequence
  Description of Artificial Sequence: Synthetic peptide
  XENP019783 vhCDR3
TGWLGPFDY

SEQ ID NO: 540 - protein, 12 aa, Artificial Sequence
  Description of Artificial Sequence: Synthetic peptide
  XENP019783 vlCDR1
RASQSVGSSYLA

SEQ ID NO: 541 - protein, 7 aa, Artificial Sequence
  Description of Artificial Sequence: Synthetic peptide
  XENP019783 vlCDR2
GAFSRAT

SEQ ID NO: 542 - protein, 9 aa, Artificial Sequence
  Description of Artificial Sequence: Synthetic peptide
  XENP019783 vlCDR3
QQYGSSPWT

SEQ ID NO: 543 - protein, 246 aa, Artificial Sequence
  Description of Artificial Sequence: Synthetic polypeptide
  XENP019784 [CTLA-4]_H0.40_L0_scFv(GKPGS)4
QVQLVESGGGVVQPGRSLRLSCAASGFTFSSYTMHWVRQAPGKGLEWVSFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 544 - protein, 118 aa, Artificial Sequence
  Description of Artificial Sequence: Synthetic polypeptide
  VH of XENP019784
QVQLVESGGGVVQPGRSLRLSCAASGFTFSSYTMHWVRQAPGKGLEWVSFISYDGNNKYYADSVKGRFTISRDNSKNTLYLQMNSLRAEDTAIYYCARTGWLGPFDYWGQGTLVTVSS

SEQ ID NO: 545 - protein, 108 aa, Artificial Sequence; identical to SEQ ID NO: 23
  Description of Artificial Sequence: Synthetic polypeptide
  VL of XENP019784

SEQ ID NO: 546 - protein, 5 aa, Artificial Sequence
  Description of Artificial Sequence: Synthetic peptide
  XENP019784 vhCDR1
SYTMH

SEQ ID NO: 547 - protein, 17 aa, Artificial Sequence
  Description of Artificial Sequence: Synthetic peptide
  XENP019784 vhCDR2
FISYDGNNKYYADSVKG

SEQ ID NO: 548 - protein, 9 aa, Artificial Sequence
  Description of Artificial Sequence: Synthetic peptide
  XENP019784 vhCDR3
TGWLGPFDY

SEQ ID NO: 549 - protein, 12 aa, Artificial Sequence
  Description of Artificial Sequence: Synthetic peptide
  XENP019784 vlCDR1
RASQSVGSSYLA

SEQ ID NO: 550 - protein, 7 aa, Artificial Sequence
  Description of Artificial Sequence: Synthetic peptide
  XENP019784 vlCDR2
GAFSRAT

SEQ ID NO: 551 - protein, 9 aa, Artificial Sequence
  Description of Artificial Sequence: Synthetic peptide
  XENP019784 vlCDR3
QQYGSSPWT

SEQ ID NO: 552 - protein, 246 aa, Artificial Sequence
  Description of Artificial Sequence: Synthetic polypeptide
  XENP019785 [CTLA-4]_H0.41_L0_scFv(GKPGS)4
QVQLVESGGGVVQPGRSLRLSCAASGFTFSSYTMHWVRQAPGKGLEWVVFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 553 - protein, 118 aa, Artificial Sequence
  Description of Artificial Sequence: Synthetic polypeptide
  VH of XENP019785
QVQLVESGGGVVQPGRSLRLSCAASGFTFSSYTMHWVRQAPGKGLEWVVFISYDGNNKYYADSVKGRFTISRDNSKNTLYLQMNSLRAEDTAIYYCARTGWLGPFDYWGQGTLVTVSS

SEQ ID NO: 554 - protein, 108 aa, Artificial Sequence; identical to SEQ ID NO: 23
  Description of Artificial Sequence: Synthetic polypeptide
  VL of XENP019785

SEQ ID NO: 555 - protein, 5 aa, Artificial Sequence
  Description of Artificial Sequence: Synthetic peptide
  XENP019785 vhCDR1
SYTMH

SEQ ID NO: 556 - protein, 17 aa, Artificial Sequence
  Description of Artificial Sequence: Synthetic peptide
  XENP019785 vhCDR2
FISYDGNNKYYADSVKG

SEQ ID NO: 557 - protein, 9 aa, Artificial Sequence
  Description of Artificial Sequence: Synthetic peptide
  XENP019785 vhCDR3
TGWLGPFDY

SEQ ID NO: 558 - protein, 12 aa, Artificial Sequence
  Description of Artificial Sequence: Synthetic peptide
  XENP019785 vlCDR1
RASQSVGSSYLA

SEQ ID NO: 559 - protein, 7 aa, Artificial Sequence
  Description of Artificial Sequence: Synthetic peptide
  XENP019785 vlCDR2
GAFSRAT

SEQ ID NO: 560 - protein, 9 aa, Artificial Sequence
  Description of Artificial Sequence: Synthetic peptide
  XENP019785 vlCDR3
QQYGSSPWT

SEQ ID NO: 561 - protein, 246 aa, Artificial Sequence
  Description of Artificial Sequence: Synthetic polypeptide
  XENP019786 [CTLA-4]_H0.42_L0_scFv(GKPGS)4
QVQLVESGGGVVQPGRSLRLSCAASGFTFSSYTMHWVRQAPGKGLEWVTAISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 562 - protein, 118 aa, Artificial Sequence
  Description of Artificial Sequence: Synthetic polypeptide
  VH of XENP019786
QVQLVESGGGVVQPGRSLRLSCAASGFTFSSYTMHWVRQAPGKGLEWVTAISYDGNNKYYADSVKGRFTISRDNSKNTLYLQMNSLRAEDTAIYYCARTGWLGPFDYWGQGTLVTVSS

SEQ ID NO: 563 - protein, 108 aa, Artificial Sequence; identical to SEQ ID NO: 23
  Description of Artificial Sequence: Synthetic polypeptide
  VL of XENP019786

SEQ ID NO: 564 - protein, 5 aa, Artificial Sequence
  Description of Artificial Sequence: Synthetic peptide
  XENP019786 vhCDR1
SYTMH

SEQ ID NO: 565 - protein, 17 aa, Artificial Sequence
  Description of Artificial Sequence: Synthetic peptide
  XENP019786 vhCDR2
AISYDGNNKYYADSVKG

SEQ ID NO: 566 - protein, 9 aa, Artificial Sequence
  Description of Artificial Sequence: Synthetic peptide
  XENP019786 vhCDR3
TGWLGPFDY

SEQ ID NO: 567 - protein, 12 aa, Artificial Sequence
  Description of Artificial Sequence: Synthetic peptide
  XENP019786 vlCDR1
RASQSVGSSYLA

SEQ ID NO: 568 - protein, 7 aa, Artificial Sequence
  Description of Artificial Sequence: Synthetic peptide
  XENP019786 vlCDR2
GAFSRAT

SEQ ID NO: 569 - protein, 9 aa, Artificial Sequence
  Description of Artificial Sequence: Synthetic peptide
  XENP019786 vlCDR3
QQYGSSPWT

SEQ ID NO: 570 - protein, 246 aa, Artificial Sequence
  Description of Artificial Sequence: Synthetic polypeptide
  XENP019787 [CTLA-4]_H0.43_L0_scFv(GKPGS)4
QVQLVESGGGVVQPGRSLRLSCAASGFTFSSYTMHWVRQAPGKGLEWVTGISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 571 - protein, 118 aa, Artificial Sequence
  Description of Artificial Sequence: Synthetic polypeptide
  VH of XENP019787
QVQLVESGGGVVQPGRSLRLSCAASGFTFSSYTMHWVRQAPGKGLEWVTGISYDGNNKYYADSVKGRFTISRDNSKNTLYLQMNSLRAEDTAIYYCARTGWLGPFDYWGQGTLVTVSS

SEQ ID NO: 572 - protein, 108 aa, Artificial Sequence; identical to SEQ ID NO: 23
  Description of Artificial Sequence: Synthetic polypeptide
  VL of XENP019787

SEQ ID NO: 573 - protein, 5 aa, Artificial Sequence
  Description of Artificial Sequence: Synthetic peptide
  XENP019787 vhCDR1
SYTMH

SEQ ID NO: 574 - protein, 17 aa, Artificial Sequence
  Description of Artificial Sequence: Synthetic peptide
  XENP019787 vhCDR2
GISYDGNNKYYADSVKG

SEQ ID NO: 575 - protein, 9 aa, Artificial Sequence
  Description of Artificial Sequence: Synthetic peptide
  XENP019787 vhCDR3
TGWLGPFDY

SEQ ID NO: 576 - protein, 12 aa, Artificial Sequence
  Description of Artificial Sequence: Synthetic peptide
  XENP019787 vlCDR1
RASQSVGSSYLA

SEQ ID NO: 577 - protein, 7 aa, Artificial Sequence
  Description of Artificial Sequence: Synthetic peptide
  XENP019787 vlCDR2
GAFSRAT

SEQ ID NO: 578 - protein, 9 aa, Artificial Sequence
  Description of Artificial Sequence: Synthetic peptide
  XENP019787 vlCDR3
QQYGSSPWT

SEQ ID NO: 579 - protein, 246 aa, Artificial Sequence
  Description of Artificial Sequence: Synthetic polypeptide
  XENP019788 [CTLA-4]_H0.44_L0_scFv(GKPGS)4
QVQLVESGGGVVQPGRSLRLSCAASGFTFSSYTMHWVRQAPGKGLEWVTLISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 580 - protein, 118 aa, Artificial Sequence
  Description of Artificial Sequence: Synthetic polypeptide
  VH of XENP019788
QVQLVESGGGVVQPGRSLRLSCAASGFTFSSYTMHWVRQAPGKGLEWVTLISYDGNNKYYADSVKGRFTISRDNSKNTLYLQMNSLRAEDTAIYYCARTGWLGPFDYWGQGTLVTVSS

SEQ ID NO: 581 - protein, 108 aa, Artificial Sequence; identical to SEQ ID NO: 23
  Description of Artificial Sequence: Synthetic polypeptide
  VL of XENP019788

SEQ ID NO: 582 - protein, 5 aa, Artificial Sequence
  Description of Artificial Sequence: Synthetic peptide
  XENP019788 vhCDR1
SYTMH

SEQ ID NO: 583 - protein, 17 aa, Artificial Sequence
  Description of Artificial Sequence: Synthetic peptide
  XENP019788 vhCDR2
LISYDGNNKYYADSVKG

SEQ ID NO: 584 - protein, 9 aa, Artificial Sequence
  Description of Artificial Sequence: Synthetic peptide
  XENP019788 vhCDR3
TGWLGPFDY

SEQ ID NO: 585 - protein, 12 aa, Artificial Sequence
  Description of Artificial Sequence: Synthetic peptide
  XENP019788 vlCDR1
RASQSVGSSYLA

SEQ ID NO: 586 - protein, 7 aa, Artificial Sequence
  Description of Artificial Sequence: Synthetic peptide
  XENP019788 vlCDR2
GAFSRAT

SEQ ID NO: 587 - protein, 9 aa, Artificial Sequence
  Description of Artificial Sequence: Synthetic peptide
  XENP019788 vlCDR3
QQYGSSPWT

SEQ ID NO: 588 - protein, 246 aa, Artificial Sequence
  Description of Artificial Sequence: Synthetic polypeptide
  XENP019789 [CTLA-4]_H0.45_L0_scFv(GKPGS)4
QVQLVESGGGVVQPGRSLRLSCAASGFTFSSYTMHWVRQAPGKGLEWVTIISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 589 - protein, 118 aa, Artificial Sequence
  Description of Artificial Sequence: Synthetic polypeptide
  VH of XENP019789
QVQLVESGGGVVQPGRSLRLSCAASGFTFSSYTMHWVRQAPGKGLEWVTIISYDGNNKYYADSVKGRFTISRDNSKNTLYLQMNSLRAEDTAIYYCARTGWLGPFDYWGQGTLVTVSS

SEQ ID NO: 590 - protein, 108 aa, Artificial Sequence; identical to SEQ ID NO: 23
  Description of Artificial Sequence: Synthetic polypeptide
  VL of XENP019789

SEQ ID NO: 591 - protein, 5 aa, Artificial Sequence
  Description of Artificial Sequence: Synthetic peptide
  XENP019789 vhCDR1
SYTMH

SEQ ID NO: 592 - protein, 17 aa, Artificial Sequence
  Description of Artificial Sequence: Synthetic peptide
  XENP019789 vhCDR2
IISYDGNNKYYADSVKG

SEQ ID NO: 593 - protein, 9 aa, Artificial Sequence
  Description of Artificial Sequence: Synthetic peptide
  XENP019789 vhCDR3
TGWLGPFDY

SEQ ID NO: 594 - protein, 12 aa, Artificial Sequence
  Description of Artificial Sequence: Synthetic peptide
  XENP019789 vlCDR1
RASQSVGSSYLA

SEQ ID NO: 595 - protein, 7 aa, Artificial Sequence
  Description of Artificial Sequence: Synthetic peptide
  XENP019789 vlCDR2
GAFSRAT

SEQ ID NO: 596 - protein, 9 aa, Artificial Sequence
  Description of Artificial Sequence: Synthetic peptide
  XENP019789 vlCDR3
QQYGSSPWT

SEQ ID NO: 597 - protein, 246 aa, Artificial Sequence
  Description of Artificial Sequence: Synthetic polypeptide
  XENP019790 [CTLA-4]_H0.46_L0_scFv(GKPGS)4
QVQLVESGGGVVQPGRSLRLSCAASGFTFSSYTMHWVRQAPGKGLEWVTRISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 598 - protein, 118 aa, Artificial Sequence
  Description of Artificial Sequence: Synthetic polypeptide
  VH of XENP019790
QVQLVESGGGVVQPGRSLRLSCAASGFTFSSYTMHWVRQAPGKGLEWVTRISYDGNNKYYADSVKGRFTISRDNSKNTLYLQMNSLRAEDTAIYYCARTGWLGPFDYWGQGTLVTVSS

SEQ ID NO: 599 - protein, 108 aa, Artificial Sequence; identical to SEQ ID NO: 23
  Description of Artificial Sequence: Synthetic polypeptide
  VL of XENP019790

SEQ ID NO: 600 - protein, 5 aa, Artificial Sequence
  Description of Artificial Sequence: Synthetic peptide
  XENP019790 vhCDR1
SYTMH

SEQ ID NO: 601 - protein, 17 aa, Artificial Sequence
  Description of Artificial Sequence: Synthetic peptide
  XENP019790 vhCDR2
RISYDGNNKYYADSVKG

SEQ ID NO: 602 - protein, 9 aa, Artificial Sequence
  Description of Artificial Sequence: Synthetic peptide
  XENP019790 vhCDR3
TGWLGPFDY

SEQ ID NO: 603 - protein, 12 aa, Artificial Sequence
  Description of Artificial Sequence: Synthetic peptide
  XENP019790 vlCDR1
RASQSVGSSYLA

SEQ ID NO: 604 - protein, 7 aa, Artificial Sequence
  Description of Artificial Sequence: Synthetic peptide
  XENP019790 vlCDR2
GAFSRAT

SEQ ID NO: 605 - protein, 9 aa, Artificial Sequence
  Description of Artificial Sequence: Synthetic peptide
  XENP019790 vlCDR3
QQYGSSPWT

SEQ ID NO: 606 - protein, 246 aa, Artificial Sequence
  Description of Artificial Sequence: Synthetic polypeptide
  XENP019791 [CTLA-4]_H0.47_L0_scFv(GKPGS)4
QVQLVESGGGVVQPGRSLRLSCAASGFTFSSYTMHWVRQAPGKGLEWVTVISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 607 - protein, 118 aa, Artificial Sequence
  Description of Artificial Sequence: Synthetic polypeptide
  VH of XENP019791
QVQLVESGGGVVQPGRSLRLSCAASGFTFSSYTMHWVRQAPGKGLEWVTVISYDGNNKYYADSVKGRFTISRDNSKNTLYLQMNSLRAEDTAIYYCARTGWLGPFDYWGQGTLVTVSS

SEQ ID NO: 608 - protein, 108 aa, Artificial Sequence; identical to SEQ ID NO: 23
  Description of Artificial Sequence: Synthetic polypeptide
  VL of XENP019791

SEQ ID NO: 609 - protein, 5 aa, Artificial Sequence
  Description of Artificial Sequence: Synthetic peptide
  XENP019791 vhCDR1
SYTMH

SEQ ID NO: 610 - protein, 17 aa, Artificial Sequence
  Description of Artificial Sequence: Synthetic peptide
  XENP019791 vhCDR2
VISYDGNNKYYADSVKG

SEQ ID NO: 611 - protein, 9 aa, Artificial Sequence
  Description of Artificial Sequence: Synthetic peptide
  XENP019791 vhCDR3
TGWLGPFDY

SEQ ID NO: 612 - protein, 12 aa, Artificial Sequence
  Description of Artificial Sequence: Synthetic peptide
  XENP019791 vlCDR1
RASQSVGSSYLA

SEQ ID NO: 613 - protein, 7 aa, Artificial Sequence
  Description of Artificial Sequence: Synthetic peptide
  XENP019791 vlCDR2
GAFSRAT

SEQ ID NO: 614 - protein, 9 aa, Artificial Sequence
  Description of Artificial Sequence: Synthetic peptide
  XENP019791 vlCDR3
QQYGSSPWT

SEQ ID NO: 615 - protein, 246 aa, Artificial Sequence
  Description of Artificial Sequence: Synthetic polypeptide
  XENP019792 [CTLA-4]_H0.48_L0_scFv(GKPGS)4
QVQLVESGGGVVQPGRSLRLSCAASGFTFSSYTMHWVRQAPGKGLEWVTYISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 616 - protein, 118 aa, Artificial Sequence
  Description of Artificial Sequence: Synthetic polypeptide
  VH of XENP019792
QVQLVESGGGVVQPGRSLRLSCAASGFTFSSYTMHWVRQAPGKGLEWVTYISYDGNNKYYADSVKGRFTISRDNSKNTLYLQMNSLRAEDTAIYYCARTGWLGPFDYWGQGTLVTVSS

SEQ ID NO: 617 - protein, 108 aa, Artificial Sequence; identical to SEQ ID NO: 23
  Description of Artificial Sequence: Synthetic polypeptide
  VL of XENP019792

SEQ ID NO: 618 - protein, 5 aa, Artificial Sequence
  Description of Artificial Sequence: Synthetic peptide
  XENP019792 vhCDR1
SYTMH

SEQ ID NO: 619 - protein, 17 aa, Artificial Sequence
  Description of Artificial Sequence: Synthetic peptide
  XENP019792 vhCDR2
YISYDGNNKYYADSVKG

SEQ ID NO: 620 - protein, 9 aa, Artificial Sequence
  Description of Artificial Sequence: Synthetic peptide
  XENP019792 vhCDR3
TGWLGPFDY

SEQ ID NO: 621 - protein, 12 aa, Artificial Sequence
  Description of Artificial Sequence: Synthetic peptide
  XENP019792 vlCDR1
RASQSVGSSYLA

SEQ ID NO: 622 - protein, 7 aa, Artificial Sequence
  Description of Artificial Sequence: Synthetic peptide
  XENP019792 vlCDR2
GAFSRAT

SEQ ID NO: 623 - protein, 9 aa, Artificial Sequence
  Description of Artificial Sequence: Synthetic peptide
  XENP019792 vlCDR3
QQYGSSPWT

SEQ ID NO: 624 - protein, 246 aa, Artificial Sequence
  Description of Artificial Sequence: Synthetic polypeptide
  XENP019793 [CTLA-4]_H0.49_L0_scFv(GKPGS)4
QVQLVESGGGVVQPGRSLRLSCAASGFTFSSYTMHWVRQAPGKGLEWVTFESYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 625 - protein, 118 aa, Artificial Sequence
  Description of Artificial Sequence: Synthetic polypeptide
  VH of XENP019793
QVQLVESGGGVVQPGRSLRLSCAASGFTFSSYTMHWVRQAPGKGLEWVTFESYDGNNKYYADSVKGRFTISRDNSKNTLYLQMNSLRAEDTAIYYCARTGWLGPFDYWGQGTLVTVSS

SEQ ID NO: 626 - protein, 108 aa, Artificial Sequence; identical to SEQ ID NO: 23
  Description of Artificial Sequence: Synthetic polypeptide
  VL of XENP019793

SEQ ID NO: 627 - protein, 5 aa, Artificial Sequence
  Description of Artificial Sequence: Synthetic peptide
  XENP019793 vhCDR1
SYTMH

SEQ ID NO: 628 - protein, 17 aa, Artificial Sequence
  Description of Artificial Sequence: Synthetic peptide
  XENP019793 vhCDR2
FESYDGNNKYYADSVKG

SEQ ID NO: 629 - protein, 9 aa, Artificial Sequence
  Description of Artificial Sequence: Synthetic peptide
  XENP019793 vhCDR3
TGWLGPFDY

SEQ ID NO: 630 - protein, 12 aa, Artificial Sequence
  Description of Artificial Sequence: Synthetic peptide
  XENP019793 vlCDR1
RASQSVGSSYLA

SEQ ID NO: 631 - protein, 7 aa, Artificial Sequence
  Description of Artificial Sequence: Synthetic peptide
  XENP019793 vlCDR2
GAFSRAT

SEQ ID NO: 632 - protein, 9 aa, Artificial Sequence
  Description of Artificial Sequence: Synthetic peptide
  XENP019793 vlCDR3
QQYGSSPWT

SEQ ID NO: 633 - protein, 246 aa, Artificial Sequence
  Description of Artificial Sequence: Synthetic polypeptide
  XENP019794 [CTLA-4]_H0.50_L0_scFv(GKPGS)4
QVQLVESGGGVVQPGRSLRLSCAASGFTFSSYTMHWVRQAPGKGLEWVTFHSYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 634 - protein, 118 aa, Artificial Sequence
  Description of Artificial Sequence: Synthetic polypeptide
  VH of XENP019794
QVQLVESGGGVVQPGRSLRLSCAASGFTFSSYTMHWVRQAPGKGLEWVTFHSYDGNNKYYADSVKGRFTISRDNSKNTLYLQMNSLRAEDTAIYYCARTGWLGPFDYWGQGTLVTVSS

SEQ ID NO: 635 - protein, 108 aa, Artificial Sequence; identical to SEQ ID NO: 23
  Description of Artificial Sequence: Synthetic polypeptide
  VL of XENP019794

SEQ ID NO: 636 - protein, 5 aa, Artificial Sequence
  Description of Artificial Sequence: Synthetic peptide
  XENP019794 vhCDR1
SYTMH

SEQ ID NO: 637 - protein, 17 aa, Artificial Sequence
  Description of Artificial Sequence: Synthetic peptide
  XENP019794 vhCDR2
FHSYDGNNKYYADSVKG

SEQ ID NO: 638 - protein, 9 aa, Artificial Sequence
  Description of Artificial Sequence: Synthetic peptide
  XENP019794 vhCDR3
TGWLGPFDY

SEQ ID NO: 639 - protein, 12 aa, Artificial Sequence
  Description of Artificial Sequence: Synthetic peptide
  XENP019794 vlCDR1
RASQSVGSSYLA

SEQ ID NO: 640 - protein, 7 aa, Artificial Sequence
  Description of Artificial Sequence: Synthetic peptide
  XENP019794 vlCDR2
GAFSRAT

SEQ ID NO: 641 - protein, 9 aa, Artificial Sequence
  Description of Artificial Sequence: Synthetic peptide
  XENP019794 vlCDR3
QQYGSSPWT

SEQ ID NO: 642 - protein, 246 aa, Artificial Sequence
  Description of Artificial Sequence: Synthetic polypeptide
  XENP019795 [CTLA-4]_H0.51_L0_scFv(GKPGS)4
QVQLVESGGGVVQPGRSLRLSCAASGFTFSSYTMHWVRQAPGKGLEWVTFTSYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 643 - protein, 118 aa, Artificial Sequence
  Description of Artificial Sequence: Synthetic polypeptide
  VH of XENP019795
QVQLVESGGGVVQPGRSLRLSCAASGFTFSSYTMHWVRQAPGKGLEWVTFTSYDGNNKYYADSVKGRFTISRDNSKNTLYLQMNSLRAEDTAIYYCARTGWLGPFDYWGQGTLVTVSS

SEQ ID NO: 644 - protein, 108 aa, Artificial Sequence; identical to SEQ ID NO: 23
  Description of Artificial Sequence: Synthetic polypeptide
  VL of XENP019795

SEQ ID NO: 645 - protein, 5 aa, Artificial Sequence
  Description of Artificial Sequence: Synthetic peptide
  XENP019795 vhCDR1
SYTMH

SEQ ID NO: 646 - protein, 17 aa, Artificial Sequence
  Description of Artificial Sequence: Synthetic peptide
  XENP019795 vhCDR2
FTSYDGNNKYYADSVKG

SEQ ID NO: 647 - protein, 9 aa, Artificial Sequence
  Description of Artificial Sequence: Synthetic peptide
  XENP019795 vhCDR3
TGWLGPFDY

SEQ ID NO: 648 - protein, 12 aa, Artificial Sequence
  Description of Artificial Sequence: Synthetic peptide
  XENP019795 vlCDR1
RASQSVGSSYLA

SEQ ID NO: 649 - protein, 7 aa, Artificial Sequence
  Description of Artificial Sequence: Synthetic peptide
  XENP019795 vlCDR2
GAFSRAT

SEQ ID NO: 650 - protein, 9 aa, Artificial Sequence
  Description of Artificial Sequence: Synthetic peptide
  XENP019795 vlCDR3
QQYGSSPWT

SEQ ID NO: 651 - protein, 246 aa, Artificial Sequence
  Description of Artificial Sequence: Synthetic polypeptide
  XENP019796 [CTLA-4]_H0.52_L0_scFv(GKPGS)4
QVQLVESGGGVVQPGRSLRLSCAASGFTFSSYTMHWVRQAPGKGLEWVTFVSYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 652 - protein, 118 aa, Artificial Sequence
  Description of Artificial Sequence: Synthetic polypeptide
  VH of XENP019796
QVQLVESGGGVVQPGRSLRLSCAASGFTFSSYTMHWVRQAPGKGLEWVTFVSYDGNNKYYADSVKGRFTISRDNSKNTLYLQMNSLRAEDTAIYYCARTGWLGPFDYWGQGTLVTVSS

SEQ ID NO: 653 - protein, 108 aa, Artificial Sequence; identical to SEQ ID NO: 23
  Description of Artificial Sequence: Synthetic polypeptide
  VL of XENP019796

SEQ ID NO: 654 - protein, 5 aa, Artificial Sequence
  Description of Artificial Sequence: Synthetic peptide
  XENP019796 vhCDR1
SYTMH

SEQ ID NO: 655 - protein, 17 aa, Artificial Sequence
  Description of Artificial Sequence: Synthetic peptide
  XENP019796 vhCDR2
FVSYDGNNKYYADSVKG

SEQ ID NO: 656 - protein, 9 aa, Artificial Sequence
  Description of Artificial Sequence: Synthetic peptide
  XENP019796 vhCDR3
TGWLGPFDY

SEQ ID NO: 657 - protein, 12 aa, Artificial Sequence
  Description of Artificial Sequence: Synthetic peptide
  XENP019796 vlCDR1
RASQSVGSSYLA

SEQ ID NO: 658 - protein, 7 aa, Artificial Sequence
  Description of Artificial Sequence: Synthetic peptide
  XENP019796 vlCDR2
GAFSRAT

SEQ ID NO: 659 - protein, 9 aa, Artificial Sequence
  Description of Artificial Sequence: Synthetic peptide
  XENP019796 vlCDR3
QQYGSSPWT

SEQ ID NO: 660 - protein, 246 aa, Artificial Sequence
  Description of Artificial Sequence: Synthetic polypeptide
  XENP019801 [CTLA-4]_H0.53_L0_scFv(GKPGS)4
QVQLVESGGGVVQPGRSLRLSCAASGFTFSSYTMHWVRQAPGKGLEWVTFYSYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 661 - protein, 118 aa, Artificial Sequence
  Description of Artificial Sequence: Synthetic polypeptide
  VH of XENP019801
QVQLVESGGGVVQPGRSLRLSCAASGFTFSSYTMHWVRQAPGKGLEWVTFYSYDGNNKYYADSVKGRFTISRDNSKNTLYLQMNSLRAEDTAIYYCARTGWLGPFDYWGQGTLVTVSS

SEQ ID NO: 662 - protein, 108 aa, Artificial Sequence; identical to SEQ ID NO: 23
  Description of Artificial Sequence: Synthetic polypeptide
  VL of XENP019801

SEQ ID NO: 663 - protein, 5 aa, Artificial Sequence
  Description of Artificial Sequence: Synthetic peptide
  XENP019801 vhCDR1
SYTMH

SEQ ID NO: 664 - protein, 17 aa, Artificial Sequence
  Description of Artificial Sequence: Synthetic peptide
  XENP019801 vhCDR2
FYSYDGNNKYYADSVKG

SEQ ID NO: 665 - protein, 9 aa, Artificial Sequence
  Description of Artificial Sequence: Synthetic peptide
  XENP019801 vhCDR3
TGWLGPFDY

SEQ ID NO: 666 - protein, 12 aa, Artificial Sequence
  Description of Artificial Sequence: Synthetic peptide
  XENP019801 vlCDR1
RASQSVGSSYLA

SEQ ID NO: 667 - protein, 7 aa, Artificial Sequence
  Description of Artificial Sequence: Synthetic peptide
  XENP019801 vlCDR2
GAFSRAT

SEQ ID NO: 668 - protein, 9 aa, Artificial Sequence
  Description of Artificial Sequence: Synthetic peptide
  XENP019801 vlCDR3
QQYGSSPWT

SEQ ID NO: 669 - protein, 246 aa, Artificial Sequence
  Description of Artificial Sequence: Synthetic polypeptide
  XENP019802 [CTLA-4]_H0.54_L0_scFv(GKPGS)4
QVQLVESGGGVVQPGRSLRLSCAASGFTFSSYTMHWVRQAPGKGLEWVTFISGDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 670 - protein, 118 aa, Artificial Sequence
  Description of Artificial Sequence: Synthetic polypeptide
  VH of XENP019802
QVQLVESGGGVVQPGRSLRLSCAASGFTFSSYTMHWVRQAPGKGLEWVTFISGDGNNKYYADSVKGRFTISRDNSKNTLYLQMNSLRAEDTAIYYCARTGWLGPFDYWGQGTLVTVSS

SEQ ID NO: 671 - protein, 108 aa, Artificial Sequence; identical to SEQ ID NO: 23
  Description of Artificial Sequence: Synthetic polypeptide
  VL of XENP019802

SEQ ID NO: 672 - protein, 5 aa, Artificial Sequence
  Description of Artificial Sequence: Synthetic peptide
  XENP019802 vhCDR1
SYTMH

SEQ ID NO: 673 - protein, 17 aa, Artificial Sequence
  Description of Artificial Sequence: Synthetic peptide
  XENP019802 vhCDR2
FISGDGNNKYYADSVKG

SEQ ID NO: 674 - protein, 9 aa, Artificial Sequence
  Description of Artificial Sequence: Synthetic peptide
  XENP019802 vhCDR3
TGWLGPFDY

SEQ ID NO: 675 - protein, 12 aa, Artificial Sequence
  Description of Artificial Sequence: Synthetic peptide
  XENP019802 vlCDR1
RASQSVGSSYLA

SEQ ID NO: 676 - protein, 7 aa, Artificial Sequence
  Description of Artificial Sequence: Synthetic peptide
  XENP019802 vlCDR2
GAFSRAT

SEQ ID NO: 677 - protein, 9 aa, Artificial Sequence
  Description of Artificial Sequence: Synthetic peptide
  XENP019802 vlCDR3
QQYGSSPWT

SEQ ID NO: 678 - protein, 246 aa, Artificial Sequence
  Description of Artificial Sequence: Synthetic polypeptide
  XENP019803 [CTLA-4]_H0.55_L0_scFv(GKPGS)4
QVQLVESGGGVVQPGRSLRLSCAASGFTFSSYTMHWVRQAPGKGLEWVTFISNDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 679 - protein, 118 aa, Artificial Sequence
  Description of Artificial Sequence: Synthetic polypeptide
  VH of XENP019803
QVQLVESGGGVVQPGRSLRLSCAASGFTFSSYTMHWVRQAPGKGLEWVTFISNDGNNKYYADSVKGRFTISRDNSKNTLYLQMNSLRAEDTAIYYCARTGWLGPFDYWGQGTLVTVSS

SEQ ID NO: 680 - protein, 108 aa, Artificial Sequence; identical to SEQ ID NO: 23
  Description of Artificial Sequence: Synthetic polypeptide
  VL of XENP019803

SEQ ID NO: 681 - protein, 5 aa, Artificial Sequence
  Description of Artificial Sequence: Synthetic peptide
  XENP019803 vhCDR1
SYTMH

SEQ ID NO: 682 - protein, 17 aa, Artificial Sequence
  Description of Artificial Sequence: Synthetic peptide
  XENP019803 vhCDR2
FISNDGNNKYYADSVKG

SEQ ID NO: 683 - protein, 9 aa, Artificial Sequence
  Description of Artificial Sequence: Synthetic peptide
  XENP019803 vhCDR3
TGWLGPFDY

SEQ ID NO: 684 - protein, 12 aa, Artificial Sequence
  Description of Artificial Sequence: Synthetic peptide
  XENP019803 vlCDR1
RASQSVGSSYLA

SEQ ID NO: 685 - protein, 7 aa, Artificial Sequence
  Description of Artificial Sequence: Synthetic peptide
  XENP019803 vlCDR2
GAFSRAT

SEQ ID NO: 686 - protein, 9 aa, Artificial Sequence
  Description of Artificial Sequence: Synthetic peptide
  XENP019803 vlCDR3
QQYGSSPWT

SEQ ID NO: 687 - protein, 246 aa, Artificial Sequence
  Description of Artificial Sequence: Synthetic polypeptide
  XENP019804 [CTLA-4]_H0.56_L0_scFv(GKPGS)4
QVQLVESGGGVVQPGRSLRLSCAASGFTFSSYTMHWVRQAPGKGLEWVTFISSDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 688 - protein, 118 aa, Artificial Sequence
  Description of Artificial Sequence: Synthetic polypeptide
  VH of XENP019804
QVQLVESGGGVVQPGRSLRLSCAASGFTFSSYTMHWVRQAPGKGLEWVTFISSDGNNKYYADSVKGRFTISRDNSKNTLYLQMNSLRAEDTAIYYCARTGWLGPFDYWGQGTLVTVSS

SEQ ID NO: 689 - protein, 108 aa, Artificial Sequence; identical to SEQ ID NO: 23
  Description of Artificial Sequence: Synthetic polypeptide
  VL of XENP019804

SEQ ID NO: 690 - protein, 5 aa, Artificial Sequence
  Description of Artificial Sequence: Synthetic peptide
  XENP019804 vhCDR1
SYTMH

SEQ ID NO: 691 - protein, 17 aa, Artificial Sequence
  Description of Artificial Sequence: Synthetic peptide
  XENP019804 vhCDR2
FISSDGNNKYYADSVKG

SEQ ID NO: 692 - protein, 9 aa, Artificial Sequence
  Description of Artificial Sequence: Synthetic peptide
  XENP019804 vhCDR3
TGWLGPFDY

SEQ ID NO: 693 - protein, 12 aa, Artificial Sequence
  Description of Artificial Sequence: Synthetic peptide
  XENP019804 vlCDR1
RASQSVGSSYLA

SEQ ID NO: 694 - protein, 7 aa, Artificial Sequence
  Description of Artificial Sequence: Synthetic peptide
  XENP019804 vlCDR2
GAFSRAT

SEQ ID NO: 695 - protein, 9 aa, Artificial Sequence
  Description of Artificial Sequence: Synthetic peptide
  XENP019804 vlCDR3
QQYGSSPWT

SEQ ID NO: 696 - protein, 246 aa, Artificial Sequence
  Description of Artificial Sequence: Synthetic polypeptide
  XENP019805 [CTLA-4]_H0.57_L0_scFv(GKPGS)4
QVQLVESGGGVVQPGRSLRLSCAASGFTFSSYTMHWVRQAPGKGLEWVTFISYNGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 697 - protein, 118 aa, Artificial Sequence
  Description of Artificial Sequence: Synthetic polypeptide
  VH of XENP019805
QVQLVESGGGVVQPGRSLRLSCAASGFTFSSYTMHWVRQAPGKGLEWVTFISYNGNNKYYADSVKGRFTISRDNSKNTLYLQMNSLRAEDTAIYYCARTGWLGPFDYWGQGTLVTVSS

SEQ ID NO: 698 - protein, 108 aa, Artificial Sequence; identical to SEQ ID NO: 23
  Description of Artificial Sequence: Synthetic polypeptide
  VL of XENP019805

SEQ ID NO: 699 - protein, 5 aa, Artificial Sequence
  Description of Artificial Sequence: Synthetic peptide
  XENP019805 vhCDR1
SYTMH

SEQ ID NO: 700 - protein, 17 aa, Artificial Sequence
  Description of Artificial Sequence: Synthetic peptide
  XENP019805 vhCDR2
FISYNGNNKYYADSVKG

SEQ ID NO: 701 - protein, 9 aa, Artificial Sequence
  Description of Artificial Sequence: Synthetic peptide
  XENP019805 vhCDR3
TGWLGPFDY

SEQ ID NO: 702 - protein, 12 aa, Artificial Sequence
  Description of Artificial Sequence: Synthetic peptide
  XENP019805 vlCDR1
RASQSVGSSYLA

SEQ ID NO: 703 - protein, 7 aa, Artificial Sequence
  Description of Artificial Sequence: Synthetic peptide
  XENP019805 vlCDR2
GAFSRAT

SEQ ID NO: 704 - protein, 9 aa, Artificial Sequence
  Description of Artificial Sequence: Synthetic peptide
  XENP019805 vlCDR3
QQYGSSPWT

SEQ ID NO: 705 - protein, 246 aa, Artificial Sequence
  Description of Artificial Sequence: Synthetic polypeptide
  XENP019806 [CTLA-4]_H0.58_L0_scFv(GKPGS)4
QVQLVESGGGVVQPGRSLRLSCAASGFTFSSYTMHWVRQAPGKGLEWVTFISYSGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 706 - protein, 118 aa, Artificial Sequence
  Description of Artificial Sequence: Synthetic polypeptide
  VH of XENP019806
QVQLVESGGGVVQPGRSLRLSCAASGFTFSSYTMHWVRQAPGKGLEWVTFISYSGNNKYYADSVKGRFTISRDNSKNTLYLQMNSLRAEDTAIYYCARTGWLGPFDYWGQGTLVTVSS

SEQ ID NO: 707 - protein, 108 aa, Artificial Sequence; identical to SEQ ID NO: 23
  Description of Artificial Sequence: Synthetic polypeptide
  VL of XENP019806

SEQ ID NO: 708 - protein, 5 aa, Artificial Sequence
  Description of Artificial Sequence: Synthetic peptide
  XENP019806 vhCDR1
SYTMH

SEQ ID NO: 709 - protein, 17 aa, Artificial Sequence
  Description of Artificial Sequence: Synthetic peptide
  XENP019806 vhCDR2
FISYSGNNKYYADSVKG

SEQ ID NO: 710 - protein, 9 aa, Artificial Sequence
  Description of Artificial Sequence: Synthetic peptide
  XENP019806 vhCDR3
TGWLGPFDY

SEQ ID NO: 711 - protein, 12 aa, Artificial Sequence
  Description of Artificial Sequence: Synthetic peptide
  XENP019806 vlCDR1
RASQSVGSSYLA

SEQ ID NO: 712 - protein, 7 aa, Artificial Sequence
  Description of Artificial Sequence: Synthetic peptide
  XENP019806 vlCDR2
GAFSRAT

SEQ ID NO: 713 - protein, 9 aa, Artificial Sequence
  Description of Artificial Sequence: Synthetic peptide
  XENP019806 vlCDR3
QQYGSSPWT

SEQ ID NO: 714 - protein, 246 aa, Artificial Sequence
  Description of Artificial Sequence: Synthetic polypeptide
  XENP019807 [CTLA-4]_H0.59_L0_scFv(GKPGS)4
QVQLVESGGGVVQPGRSLRLSCAASGFTFSSYTMHWVRQAPGKGLEWVTFISYEGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 715 - protein, 118 aa, Artificial Sequence
  Description of Artificial Sequence: Synthetic polypeptide
  VH of XENP019807
QVQLVESGGGVVQPGRSLRLSCAASGFTFSSYTMHWVRQAPGKGLEWVTFISYEGNNKYYADSVKGRFTISRDNSKNTLYLQMNSLRAEDTAIYYCARTGWLGPFDYWGQGTLVTVSS

SEQ ID NO: 716 - protein, 108 aa, Artificial Sequence; identical to SEQ ID NO: 23
  Description of Artificial Sequence: Synthetic polypeptide
  VL of XENP019807

SEQ ID NO: 717 - protein, 5 aa, Artificial Sequence
  Description of Artificial Sequence: Synthetic peptide
  XENP019807 vhCDR1
SYTMH

SEQ ID NO: 718 - protein, 17 aa, Artificial Sequence
  Description of Artificial Sequence: Synthetic peptide
  XENP019807 vhCDR2
FISYEGNNKYYADSVKG

SEQ ID NO: 719 - protein, 9 aa, Artificial Sequence
  Description of Artificial Sequence: Synthetic peptide
  XENP019807 vhCDR3
TGWLGPFDY

SEQ ID NO: 720 - protein, 12 aa, Artificial Sequence
  Description of Artificial Sequence: Synthetic peptide
  XENP019807 vlCDR1
RASQSVGSSYLA

SEQ ID NO: 721 - protein, 7 aa, Artificial Sequence
  Description of Artificial Sequence: Synthetic peptide
  XENP019807 vlCDR2
GAFSRAT

SEQ ID NO: 722 - protein, 9 aa, Artificial Sequence
  Description of Artificial Sequence: Synthetic peptide
  XENP019807 vlCDR3
QQYGSSPWT

SEQ ID NO: 723 - protein, 246 aa, Artificial Sequence
  Description of Artificial Sequence: Synthetic polypeptide
  XENP019808 [CTLA-4]_H0.60_L0_scFv(GKPGS)4
QVQLVESGGGVVQPGRSLRLSCAASGFTFSSYTMHWVRQAPGKGLEWVTFISYHGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 724 - protein, 118 aa, Artificial Sequence
  Description of Artificial Sequence: Synthetic polypeptide
  VH of XENP019808
QVQLVESGGGVVQPGRSLRLSCAASGFTFSSYTMHWVRQAPGKGLEWVTFISYHGNNKYYADSVKGRFTISRDNSKNTLYLQMNSLRAEDTAIYYCARTGWLGPFDYWGQGTLVTVSS

SEQ ID NO: 725 - protein, 108 aa, Artificial Sequence; identical to SEQ ID NO: 23
  Description of Artificial Sequence: Synthetic polypeptide
  VL of XENP019808

SEQ ID NO: 726 - protein, 5 aa, Artificial Sequence
  Description of Artificial Sequence: Synthetic peptide
  XENP019808 vhCDR1
SYTMH

SEQ ID NO: 727 - protein, 17 aa, Artificial Sequence
  Description of Artificial Sequence: Synthetic peptide
  XENP019808 vhCDR2
FISYHGNNKYYADSVKG

SEQ ID NO: 728 - protein, 9 aa, Artificial Sequence
  Description of Artificial Sequence: Synthetic peptide
  XENP019808 vhCDR3
TGWLGPFDY

SEQ ID NO: 729 - protein, 12 aa, Artificial Sequence
  Description of Artificial Sequence: Synthetic peptide
  XENP019808 vlCDR1
RASQSVGSSYLA

SEQ ID NO: 730 - protein, 7 aa, Artificial Sequence
  Description of Artificial Sequence: Synthetic peptide
  XENP019808 vlCDR2
GAFSRAT

SEQ ID NO: 731 - protein, 9 aa, Artificial Sequence
  Description of Artificial Sequence: Synthetic peptide
  XENP019808 vlCDR3
QQYGSSPWT

SEQ ID NO: 732 - protein, 246 aa, Artificial Sequence
  Description of Artificial Sequence: Synthetic polypeptide
  XENP019809 [CTLA-4]_H0.61_L0_scFv(GKPGS)4
QVQLVESGGGVVQPGRSLRLSCAASGFTFSSYTMHWVRQAPGKGLEWVTFISYKGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 733 - protein, 118 aa, Artificial Sequence
  Description of Artificial Sequence: Synthetic polypeptide
  VH of XENP019809
QVQLVESGGGVVQPGRSLRLSCAASGFTFSSYTMHWVRQAPGKGLEWVTFISYKGNNKYYADSVKGRFTISRDNSKNTLYLQMNSLRAEDTAIYYCARTGWLGPFDYWGQGTLVTVSS

SEQ ID NO: 734 - protein, 108 aa, Artificial Sequence; identical to SEQ ID NO: 23
  Description of Artificial Sequence: Synthetic polypeptide
  VL of XENP019809

SEQ ID NO: 735 - protein, 5 aa, Artificial Sequence
  Description of Artificial Sequence: Synthetic peptide
  XENP019809 vhCDR1
SYTMH

SEQ ID NO: 736 - protein, 17 aa, Artificial Sequence
  Description of Artificial Sequence: Synthetic peptide
  XENP019809 vhCDR2
FISYKGNNKYYADSVKG

SEQ ID NO: 737 - protein, 9 aa, Artificial Sequence
  Description of Artificial Sequence: Synthetic peptide
  XENP019809 vhCDR3
TGWLGPFDY

SEQ ID NO: 738 - protein, 12 aa, Artificial Sequence
  Description of Artificial Sequence: Synthetic peptide
  XENP019809 vlCDR1
RASQSVGSSYLA

SEQ ID NO: 739 - protein, 7 aa, Artificial Sequence
  Description of Artificial Sequence: Synthetic peptide
  XENP019809 vlCDR2
GAFSRAT

SEQ ID NO: 740 - protein, 9 aa, Artificial Sequence
  Description of Artificial Sequence: Synthetic peptide
  XENP019809 vlCDR3
QQYGSSPWT

SEQ ID NO: 741 - protein, 246 aa, Artificial Sequence
  Description of Artificial Sequence: Synthetic polypeptide
  XENP019810 [CTLA-4]_H0.62_L0_scFv(GKPGS)4
QVQLVESGGGVVQPGRSLRLSCAASGFTFSSYTMHWVRQAPGKGLEWVTFISYKGNNKYYADSVKGRFTISEDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 742 - protein, 118 aa, Artificial Sequence
  Description of Artificial Sequence: Synthetic polypeptide
  VH of XENP019810
QVQLVESGGGVVQPGRSLRLSCAASGFTFSSYTMHWVRQAPGKGLEWVTFISYKGNNKYYADSVKGRFTISEDNSKNTLYLQMNSLRAEDTAIYYCARTGWLGPFDYWGQGTLVTVSS

SEQ ID NO: 743 - protein, 108 aa, Artificial Sequence; identical to SEQ ID NO: 23
  Description of Artificial Sequence: Synthetic polypeptide
  VL of XENP019810

SEQ ID NO: 744 - protein, 5 aa, Artificial Sequence
  Description of Artificial Sequence: Synthetic peptide
  XENP019810 vhCDR1
SYTMH

SEQ ID NO: 745 - protein, 17 aa, Artificial Sequence
  Description of Artificial Sequence: Synthetic peptide
  XENP019810 vhCDR2
FISYKGNNKYYADSVKG

SEQ ID NO: 746 - protein, 9 aa, Artificial Sequence
  Description of Artificial Sequence: Synthetic peptide
  XENP019810 vhCDR3
TGWLGPFDY

SEQ ID NO: 747 - protein, 12 aa, Artificial Sequence
  Description of Artificial Sequence: Synthetic peptide
  XENP019810 vlCDR1
RASQSVGSSYLA

SEQ ID NO: 748 - protein, 7 aa, Artificial Sequence
  Description of Artificial Sequence: Synthetic peptide
  XENP019810 vlCDR2
GAFSRAT

SEQ ID NO: 749 - protein, 9 aa, Artificial Sequence
  Description of Artificial Sequence: Synthetic peptide
  XENP019810 vlCDR3
QQYGSSPWT

SEQ ID NO: 750 - protein, 246 aa, Artificial Sequence
  Description of Artificial Sequence: Synthetic polypeptide
  XENP019811 [CTLA-4]_H0.63_L0_scFv(GKPGS)4
QVQLVESGGGVVQPGRSLRLSCAASGFTFSSYTMHWVRQAPGKGLEWVTFISYQGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 751 - protein, 118 aa, Artificial Sequence
  Description of Artificial Sequence: Synthetic polypeptide
  VH of XENP019811
QVQLVESGGGVVQPGRSLRLSCAASGFTFSSYTMHWVRQAPGKGLEWVTFISYQGNNKYYADSVKGRFTISRDNSKNTLYLQMNSLRAEDTAIYYCARTGWLGPFDYWGQGTLVTVSS

SEQ ID NO: 752 - protein, 108 aa, Artificial Sequence; identical to SEQ ID NO: 23
  Description of Artificial Sequence: Synthetic polypeptide
  VL of XENP019811

SEQ ID NO: 753 - protein, 5 aa, Artificial Sequence
  Description of Artificial Sequence: Synthetic peptide
  XENP019811 vhCDR1
SYTMH

SEQ ID NO: 754 - protein, 17 aa, Artificial Sequence
  Description of Artificial Sequence: Synthetic peptide
  XENP019811 vhCDR2
FISYQGNNKYYADSVKG

SEQ ID NO: 755 - protein, 9 aa, Artificial Sequence
  Description of Artificial Sequence: Synthetic peptide
  XENP019811 vhCDR3
TGWLGPFDY

SEQ ID NO: 756 - protein, 12 aa, Artificial Sequence
  Description of Artificial Sequence: Synthetic peptide
  XENP019811 vlCDR1
RASQSVGSSYLA

SEQ ID NO: 757 - protein, 7 aa, Artificial Sequence
  Description of Artificial Sequence: Synthetic peptide
  XENP019811 vlCDR2
GAFSRAT

SEQ ID NO: 758 - protein, 9 aa, Artificial Sequence
  Description of Artificial Sequence: Synthetic peptide
  XENP019811 vlCDR3
QQYGSSPWT

SEQ ID NO: 759 - protein, 246 aa, Artificial Sequence
  Description of Artificial Sequence: Synthetic polypeptide
  XENP019812 [CTLA-4]_H0.64_L0_scFv(GKPGS)4
QVQLVESGGGVVQPGRSLRLSCAASGFTFSSYTMHWVRQAPGKGLEWVTFISYDKNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 760 - protein, 118 aa, Artificial Sequence
  Description of Artificial Sequence: Synthetic polypeptide
  VH of XENP019812
QVQLVESGGGVVQPGRSLRLSCAASGFTFSSYTMHWVRQAPGKGLEWVTFISYDKNNKYYADSVKGRFTISRDNSKNTLYLQMNSLRAEDTAIYYCARTGWLGPFDYWGQGTLVTVSS

SEQ ID NO: 761 - protein, 108 aa, Artificial Sequence; identical to SEQ ID NO: 23
  Description of Artificial Sequence: Synthetic polypeptide
  VL of XENP019812

SEQ ID NO: 762 - protein, 5 aa, Artificial Sequence
  Description of Artificial Sequence: Synthetic peptide
  XENP019812 vhCDR1
SYTMH

SEQ ID NO: 763 - protein, 17 aa, Artificial Sequence
  Description of Artificial Sequence: Synthetic peptide
  XENP019812 vhCDR2
FISYDKNNKYYADSVKG

SEQ ID NO: 764 - protein, 9 aa, Artificial Sequence
  Description of Artificial Sequence: Synthetic peptide
  XENP019812 vhCDR3
TGWLGPFDY

SEQ ID NO: 765 - protein, 12 aa, Artificial Sequence
  Description of Artificial Sequence: Synthetic peptide
  XENP019812 vlCDR1
RASQSVGSSYLA

SEQ ID NO: 766 - protein, 7 aa, Artificial Sequence
  Description of Artificial Sequence: Synthetic peptide
  XENP019812 vlCDR2
GAFSRAT

SEQ ID NO: 767 - protein, 9 aa, Artificial Sequence
  Description of Artificial Sequence: Synthetic peptide
  XENP019812 vlCDR3
QQYGSSPWT

SEQ ID NO: 768 - protein, 246 aa, Artificial Sequence
  Description of Artificial Sequence: Synthetic polypeptide
  XENP019813 [CTLA-4]_H0.65_L0_scFv(GKPGS)4
QVQLVESGGGVVQPGRSLRLSCAASGFTFSSYTMHWVRQAPGKGLEWVTFISYDKNNKYYADSVKGRFTISEDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 769 - protein, 118 aa, Artificial Sequence
  Description of Artificial Sequence: Synthetic polypeptide
  VH of XENP019813
QVQLVESGGGVVQPGRSLRLSCAASGFTFSSYTMHWVRQAPGKGLEWVTFISYDKNNKYYADSVKGRFTISEDNSKNTLYLQMNSLRAEDTAIYYCARTGWLGPFDYWGQGTLVTVSS

SEQ ID NO: 770 - protein, 108 aa, Artificial Sequence; identical to SEQ ID NO: 23
  Description of Artificial Sequence: Synthetic polypeptide
  VL of XENP019813

SEQ ID NO: 771 - protein, 5 aa, Artificial Sequence
  Description of Artificial Sequence: Synthetic peptide
  XENP019813 vhCDR1
SYTMH

SEQ ID NO: 772 - protein, 17 aa, Artificial Sequence
  Description of Artificial Sequence: Synthetic peptide
  XENP019813 vhCDR2
FISYDKNNKYYADSVKG

SEQ ID NO: 773 - protein, 9 aa, Artificial Sequence
  Description of Artificial Sequence: Synthetic peptide
  XENP019813 vhCDR3
TGWLGPFDY

SEQ ID NO: 774 - protein, 12 aa, Artificial Sequence
  Description of Artificial Sequence: Synthetic peptide
  XENP019813 vlCDR1
RASQSVGSSYLA

SEQ ID NO: 775 - protein, 7 aa, Artificial Sequence
  Description of Artificial Sequence: Synthetic peptide
  XENP019813 vlCDR2
GAFSRAT

SEQ ID NO: 776 - protein, 9 aa, Artificial Sequence
  Description of Artificial Sequence: Synthetic peptide
  XENP019813 vlCDR3
QQYGSSPWT

SEQ ID NO: 777 - protein, 246 aa, Artificial Sequence
  Description of Artificial Sequence: Synthetic polypeptide
  XENP019814 [CTLA-4]_H0.66_L0_scFv(GKPGS)4
QVQLVESGGGVVQPGRSLRLSCAASGFTFSSYTMHWVRQAPGKGLEWVTFISYDGDNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 778 - protein, 118 aa, Artificial Sequence
  Description of Artificial Sequence: Synthetic polypeptide
  VH of XENP019814
QVQLVESGGGVVQPGRSLRLSCAASGFTFSSYTMHWVRQAPGKGLEWVTFISYDGDNKYYADSVKGRFTISRDNSKNTLYLQMNSLRAEDTAIYYCARTGWLGPFDYWGQGTLVTVSS

SEQ ID NO: 779 - protein, 108 aa, Artificial Sequence; identical to SEQ ID NO: 23
  Description of Artificial Sequence: Synthetic polypeptide
  VL of XENP019814

SEQ ID NO: 780 - protein, 5 aa, Artificial Sequence
  Description of Artificial Sequence: Synthetic peptide
  XENP019814 vhCDR1
SYTMH

SEQ ID NO: 781 - protein, 17 aa, Artificial Sequence
  Description of Artificial Sequence: Synthetic peptide
  XENP019814 vhCDR2
FISYDGDNKYYADSVKG

SEQ ID NO: 782 - protein, 9 aa, Artificial Sequence
  Description of Artificial Sequence: Synthetic peptide
  XENP019814 vhCDR3
TGWLGPFDY

SEQ ID NO: 783 - protein, 12 aa, Artificial Sequence
  Description of Artificial Sequence: Synthetic peptide
  XENP019814 vlCDR1
RASQSVGSSYLA

SEQ ID NO: 784 - protein, 7 aa, Artificial Sequence
  Description of Artificial Sequence: Synthetic peptide
  XENP019814 vlCDR2
GAFSRAT

SEQ ID NO: 785 - protein, 9 aa, Artificial Sequence
  Description of Artificial Sequence: Synthetic peptide
  XENP019814 vlCDR3
QQYGSSPWT

SEQ ID NO: 786 - protein, 246 aa, Artificial Sequence
  Description of Artificial Sequence: Synthetic polypeptide
  XENP019815 [CTLA-4]_H0.67_L0_scFv(GKPGS)4
QVQLVESGGGVVQPGRSLRLSCAASGFTFSSYTMHWVRQAPGKGLEWVTFISYDGGNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 787 - protein, 118 aa, Artificial Sequence
  Description of Artificial Sequence: Synthetic polypeptide
  VH of XENP019815
QVQLVESGGGVVQPGRSLRLSCAASGFTFSSYTMHWVRQAPGKGLEWVTFISYDGGNKYYADSVKGRFTISRDNSKNTLYLQMNSLRAEDTAIYYCARTGWLGPFDYWGQGTLVTVSS

SEQ ID NO: 788 - protein, 108 aa, Artificial Sequence; identical to SEQ ID NO: 23
  Description of Artificial Sequence: Synthetic polypeptide
  VL of XENP019815

SEQ ID NO: 789 - protein, 5 aa, Artificial Sequence
  Description of Artificial Sequence: Synthetic peptide
  XENP019815 vhCDR1
SYTMH

SEQ ID NO: 790 - protein, 17 aa, Artificial Sequence
  Description of Artificial Sequence: Synthetic peptide
  XENP019815 vhCDR2
FISYDGGNKYYADSVKG

SEQ ID NO: 791 - protein, 9 aa, Artificial Sequence
  Description of Artificial Sequence: Synthetic peptide
  XENP019815 vhCDR3
TGWLGPFDY

SEQ ID NO: 792 - protein, 12 aa, Artificial Sequence
  Description of Artificial Sequence: Synthetic peptide
  XENP019815 vlCDR1
RASQSVGSSYLA

SEQ ID NO: 793 - protein, 7 aa, Artificial Sequence
  Description of Artificial Sequence: Synthetic peptide
  XENP019815 vlCDR2
GAFSRAT

SEQ ID NO: 794 - protein, 9 aa, Artificial Sequence
  Description of Artificial Sequence: Synthetic peptide
  XENP019815 vlCDR3
QQYGSSPWT

SEQ ID NO: 795 - protein, 246 aa, Artificial Sequence
  Description of Artificial Sequence: Synthetic polypeptide
  XENP019816 [CTLA-4]_H0.68_L0_scFv(GKPGS)4
QVQLVESGGGVVQPGRSLRLSCAASGFTFSSYTMHWVRQAPGKGLEWVTFISYDGHNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 796 - protein, 118 aa, Artificial Sequence
  Description of Artificial Sequence: Synthetic polypeptide
  VH of XENP019816
QVQLVESGGGVVQPGRSLRLSCAASGFTFSSYTMHWVRQAPGKGLEWVTFISYDGHNKYYADSVKGRFTISRDNSKNTLYLQMNSLRAEDTAIYYCARTGWLGPFDYWGQGTLVTVSS

SEQ ID NO: 797 - protein, 108 aa, Artificial Sequence; identical to SEQ ID NO: 23
  Description of Artificial Sequence: Synthetic polypeptide
  VL of XENP019816

SEQ ID NO: 798 - protein, 5 aa, Artificial Sequence
  Description of Artificial Sequence: Synthetic peptide
  XENP019816 vhCDR1
SYTMH

SEQ ID NO: 799 - protein, 17 aa, Artificial Sequence
  Description of Artificial Sequence: Synthetic peptide
  XENP019816 vhCDR2
FISYDGHNKYYADSVKG

SEQ ID NO: 800 - protein, 9 aa, Artificial Sequence
  Description of Artificial Sequence: Synthetic peptide
  XENP019816 vhCDR3
TGWLGPFDY

SEQ ID NO: 801 - protein, 12 aa, Artificial Sequence
  Description of Artificial Sequence: Synthetic peptide
  XENP019816 vlCDR1
RASQSVGSSYLA

SEQ ID NO: 802 - protein, 7 aa, Artificial Sequence
  Description of Artificial Sequence: Synthetic peptide
  XENP019816 vlCDR2
GAFSRAT

SEQ ID NO: 803 - protein, 9 aa, Artificial Sequence
  Description of Artificial Sequence: Synthetic peptide
  XENP019816 vlCDR3
QQYGSSPWT

SEQ ID NO: 804 - protein, 246 aa, Artificial Sequence
  Description of Artificial Sequence: Synthetic polypeptide
  XENP019817 [CTLA-4]_H0.69_L0_scFv(GKPGS)4
QVQLVESGGGVVQPGRSLRLSCAASGFTFSSYTMHWVRQAPGKGLEWVTFISYDGQNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 805 - protein, 118 aa, Artificial Sequence
  Description of Artificial Sequence: Synthetic polypeptide
  VH of XENP019817
QVQLVESGGGVVQPGRSLRLSCAASGFTFSSYTMHWVRQAPGKGLEWVTFISYDGQNKYYADSVKGRFTISRDNSKNTLYLQMNSLRAEDTAIYYCARTGWLGPFDYWGQGTLVTVSS

SEQ ID NO: 806 - protein, 108 aa, Artificial Sequence; identical to SEQ ID NO: 23
  Description of Artificial Sequence: Synthetic polypeptide
  VL of XENP019817

SEQ ID NO: 807 - protein, 5 aa, Artificial Sequence
  Description of Artificial Sequence: Synthetic peptide
  XENP019817 vhCDR1
SYTMH

SEQ ID NO: 808 - protein, 17 aa, Artificial Sequence
  Description of Artificial Sequence: Synthetic peptide
  XENP019817 vhCDR2
FISYDGQNKYYADSVKG

SEQ ID NO: 809 - protein, 9 aa, Artificial Sequence
  Description of Artificial Sequence: Synthetic peptide
  XENP019817 vhCDR3
TGWLGPFDY

SEQ ID NO: 810 - protein, 12 aa, Artificial Sequence
  Description of Artificial Sequence: Synthetic peptide
  XENP019817 vlCDR1
RASQSVGSSYLA

SEQ ID NO: 811 - protein, 7 aa, Artificial Sequence
  Description of Artificial Sequence: Synthetic peptide
  XENP019817 vlCDR2
GAFSRAT

SEQ ID NO: 812 - protein, 9 aa, Artificial Sequence
  Description of Artificial Sequence: Synthetic peptide
  XENP019817 vlCDR3
QQYGSSPWT

SEQ ID NO: 813 - protein, 246 aa, Artificial Sequence
  Description of Artificial Sequence: Synthetic polypeptide
  XENP019818 [CTLA-4]_H0.70_L0_scFv(GKPGS)4
QVQLVESGGGVVQPGRSLRLSCAASGFTFSSYTMHWVRQAPGKGLEWVTFISYDGSNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 814 - protein, 118 aa, Artificial Sequence
  Description of Artificial Sequence: Synthetic polypeptide
  VH of XENP019818
QVQLVESGGGVVQPGRSLRLSCAASGFTFSSYTMHWVRQAPGKGLEWVTFISYDGSNKYYADSVKGRFTISRDNSKNTLYLQMNSLRAEDTAIYYCARTGWLGPFDYWGQGTLVTVSS

SEQ ID NO: 815 - protein, 108 aa, Artificial Sequence; identical to SEQ ID NO: 23
  Description of Artificial Sequence: Synthetic polypeptide
  VL of XENP019818

SEQ ID NO: 816 - protein, 5 aa, Artificial Sequence
  Description of Artificial Sequence: Synthetic peptide
  XENP019818 vhCDR1
SYTMH

SEQ ID NO: 817 - protein, 17 aa, Artificial Sequence
  Description of Artificial Sequence: Synthetic peptide
  XENP019818 vhCDR2
FISYDGSNKYYADSVKG

SEQ ID NO: 818 - protein, 9 aa, Artificial Sequence
  Description of Artificial Sequence: Synthetic peptide
  XENP019818 vhCDR3
TGWLGPFDY

SEQ ID NO: 819 - protein, 12 aa, Artificial Sequence
  Description of Artificial Sequence: Synthetic peptide
  XENP019818 vlCDR1
RASQSVGSSYLA

SEQ ID NO: 820 - protein, 7 aa, Artificial Sequence
  Description of Artificial Sequence: Synthetic peptide
  XENP019818 vlCDR2
GAFSRAT

SEQ ID NO: 821 - protein, 9 aa, Artificial Sequence
  Description of Artificial Sequence: Synthetic peptide
  XENP019818 vlCDR3
QQYGSSPWT

SEQ ID NO: 822 - protein, 246 aa, Artificial Sequence
  Description of Artificial Sequence: Synthetic polypeptide
  XENP019819 [CTLA-4]_H0.71_L0_scFv(GKPGS)4
QVQLVESGGGVVQPGRSLRLSCAASGFTFSSYTMHWVRQAPGKGLEWVTFISYDGNDKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 823 - protein, 118 aa, Artificial Sequence
  Description of Artificial Sequence: Synthetic polypeptide
  VH of XENP019819
QVQLVESGGGVVQPGRSLRLSCAASGFTFSSYTMHWVRQAPGKGLEWVTFISYDGNDKYYADSVKGRFTISRDNSKNTLYLQMNSLRAEDTAIYYCARTGWLGPFDYWGQGTLVTVSS

SEQ ID NO: 824 - protein, 108 aa, Artificial Sequence; identical to SEQ ID NO: 23
  Description of Artificial Sequence: Synthetic polypeptide
  VL of XENP019819

SEQ ID NO: 825 - protein, 5 aa, Artificial Sequence
  Description of Artificial Sequence: Synthetic peptide
  XENP019819 vhCDR1
SYTMH

SEQ ID NO: 826 - protein, 17 aa, Artificial Sequence
  Description of Artificial Sequence: Synthetic peptide
  XENP019819 vhCDR2
FISYDGNDKYYADSVKG

SEQ ID NO: 827 - protein, 9 aa, Artificial Sequence
  Description of Artificial Sequence: Synthetic peptide
  XENP019819 vhCDR3
TGWLGPFDY

SEQ ID NO: 828 - protein, 12 aa, Artificial Sequence
  Description of Artificial Sequence: Synthetic peptide
  XENP019819 vlCDR1
RASQSVGSSYLA

SEQ ID NO: 829 - protein, 7 aa, Artificial Sequence
  Description of Artificial Sequence: Synthetic peptide
  XENP019819 vlCDR2
GAFSRAT

SEQ ID NO: 830 - protein, 9 aa, Artificial Sequence
  Description of Artificial Sequence: Synthetic peptide
  XENP019819 vlCDR3
QQYGSSPWT

SEQ ID NO: 831 - protein, 246 aa, Artificial Sequence
  Description of Artificial Sequence: Synthetic polypeptide
  XENP019820 [CTLA-4]_H0.72_L0_scFv(GKPGS)4
QVQLVESGGGVVQPGRSLRLSCAASGFTFSSYTMHWVRQAPGKGLEWVTFISYDGNEKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 832 - protein, 118 aa, Artificial Sequence
  Description of Artificial Sequence: Synthetic polypeptide
  VH of XENP019820
QVQLVESGGGVVQPGRSLRLSCAASGFTFSSYTMHWVRQAPGKGLEWVTFISYDGNEKYYADSVKGRFTISRDNSKNTLYLQMNSLRAEDTAIYYCARTGWLGPFDYWGQGTLVTVSS

SEQ ID NO: 833 - protein, 108 aa, Artificial Sequence; identical to SEQ ID NO: 23
  Description of Artificial Sequence: Synthetic polypeptide
  VL of XENP019820

SEQ ID NO: 834 - protein, 5 aa, Artificial Sequence
  Description of Artificial Sequence: Synthetic peptide
  XENP019820 vhCDR1
SYTMH

SEQ ID NO: 835 - protein, 17 aa, Artificial Sequence
  Description of Artificial Sequence: Synthetic peptide
  XENP019820 vhCDR2
FISYDGNEKYYADSVKG

SEQ ID NO: 836 - protein, 9 aa, Artificial Sequence
  Description of Artificial Sequence: Synthetic peptide
  XENP019820 vhCDR3
TGWLGPFDY

SEQ ID NO: 837 - protein, 12 aa, Artificial Sequence
  Description of Artificial Sequence: Synthetic peptide
  XENP019820 vlCDR1
RASQSVGSSYLA

SEQ ID NO: 838 - protein, 7 aa, Artificial Sequence
  Description of Artificial Sequence: Synthetic peptide
  XENP019820 vlCDR2
GAFSRAT

SEQ ID NO: 839 - protein, 9 aa, Artificial Sequence
  Description of Artificial Sequence: Synthetic peptide
  XENP019820 vlCDR3
QQYGSSPWT

SEQ ID NO: 840 - protein, 246 aa, Artificial Sequence
  Description of Artificial Sequence: Synthetic polypeptide
  XENP019821 [CTLA-4]_H0.73_L0_scFv(GKPGS)4
QVQLVESGGGVVQPGRSLRLSCAASGFTFSSYTMHWVRQAPGKGLEWVTFISYDGNHKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 841 - protein, 118 aa, Artificial Sequence
  Description of Artificial Sequence: Synthetic polypeptide
  VH of XENP019821
QVQLVESGGGVVQPGRSLRLSCAASGFTFSSYTMHWVRQAPGKGLEWVTFISYDGNHKYYADSVKGRFTISRDNSKNTLYLQMNSLRAEDTAIYYCARTGWLGPFDYWGQGTLVTVSS

SEQ ID NO: 842 - protein, 108 aa, Artificial Sequence; identical to SEQ ID NO: 23
  Description of Artificial Sequence: Synthetic polypeptide
  VL of XENP019821

SEQ ID NO: 843 - protein, 5 aa, Artificial Sequence
  Description of Artificial Sequence: Synthetic peptide
  XENP019821 vhCDR1
SYTMH

SEQ ID NO: 844 - protein, 17 aa, Artificial Sequence
  Description of Artificial Sequence: Synthetic peptide
  XENP019821 vhCDR2
FISYDGNHKYYADSVKG

SEQ ID NO: 845 - protein, 9 aa, Artificial Sequence
  Description of Artificial Sequence: Synthetic peptide
  XENP019821 vhCDR3
TGWLGPFDY

SEQ ID NO: 846 - protein, 12 aa, Artificial Sequence
  Description of Artificial Sequence: Synthetic peptide
  XENP019821 vlCDR1
RASQSVGSSYLA

SEQ ID NO: 847 - protein, 7 aa, Artificial Sequence
  Description of Artificial Sequence: Synthetic peptide
  XENP019821 vlCDR2
GAFSRAT

SEQ ID NO: 848 - protein, 9 aa, Artificial Sequence
  Description of Artificial Sequence: Synthetic peptide
  XENP019821 vlCDR3
QQYGSSPWT

SEQ ID NO: 849 - protein, 246 aa, Artificial Sequence
  Description of Artificial Sequence: Synthetic polypeptide
  XENP019822 [CTLA-4]_H0.74_L0_scFv(GKPGS)4
QVQLVESGGGVVQPGRSLRLSCAASGFTFSSYTMHWVRQAPGKGLEWVTFISYDGNSKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 850 - protein, 118 aa, Artificial Sequence
  Description of Artificial Sequence: Synthetic polypeptide
  VH of XENP019822
QVQLVESGGGVVQPGRSLRLSCAASGFTFSSYTMHWVRQAPGKGLEWVTFISYDGNSKYYADSVKGRFTISRDNSKNTLYLQMNSLRAEDTAIYYCARTGWLGPFDYWGQGTLVTVSS

SEQ ID NO: 851 - protein, 108 aa, Artificial Sequence; identical to SEQ ID NO: 23
  Description of Artificial Sequence: Synthetic polypeptide
  VL of XENP019822

SEQ ID NO: 852 - protein, 5 aa, Artificial Sequence
  Description of Artificial Sequence: Synthetic peptide
  XENP019822 vhCDR1
SYTMH

SEQ ID NO: 853 - protein, 17 aa, Artificial Sequence
  Description of Artificial Sequence: Synthetic peptide
  XENP019822 vhCDR2
FISYDGNSKYYADSVKG

SEQ ID NO: 854 - protein, 9 aa, Artificial Sequence
  Description of Artificial Sequence: Synthetic peptide
  XENP019822 vhCDR3
TGWLGPFDY

SEQ ID NO: 855 - protein, 12 aa, Artificial Sequence
  Description of Artificial Sequence: Synthetic peptide
  XENP019822 vlCDR1
RASQSVGSSYLA

SEQ ID NO: 856 - protein, 7 aa, Artificial Sequence
  Description of Artificial Sequence: Synthetic peptide
  XENP019822 vlCDR2
GAFSRAT

SEQ ID NO: 857 - protein, 9 aa, Artificial Sequence
  Description of Artificial Sequence: Synthetic peptide
  XENP019822 vlCDR3
QQYGSSPWT

SEQ ID NO: 858 - protein, 246 aa, Artificial Sequence
  Description of Artificial Sequence: Synthetic polypeptide
  XENP019823 [CTLA-4]_H0.75_L0_scFv(GKPGS)4
QVQLVESGGGVVQPGRSLRLSCAASGFTFSSYTMHWVRQAPGKGLEWVTFISYDGNTKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 859 - protein, 118 aa, Artificial Sequence
  Description of Artificial Sequence: Synthetic polypeptide
  VH of XENP019823
QVQLVESGGGVVQPGRSLRLSCAASGFTFSSYTMHWVRQAPGKGLEWVTFISYDGNTKYYADSVKGRFTISRDNSKNTLYLQMNSLRAEDTAIYYCARTGWLGPFDYWGQGTLVTVSS

SEQ ID NO: 860 - protein, 108 aa, Artificial Sequence; identical to SEQ ID NO: 23
  Description of Artificial Sequence: Synthetic polypeptide
  VL of XENP019823

SEQ ID NO: 861 - protein, 5 aa, Artificial Sequence
  Description of Artificial Sequence: Synthetic peptide
  XENP019823 vhCDR1
SYTMH

SEQ ID NO: 862 - protein, 17 aa, Artificial Sequence
  Description of Artificial Sequence: Synthetic peptide
  XENP019823 vhCDR2
FISYDGNTKYYADSVKG

SEQ ID NO: 863 - protein, 9 aa, Artificial Sequence
  Description of Artificial Sequence: Synthetic peptide
  XENP019823 vhCDR3
TGWLGPFDY

SEQ ID NO: 864 - protein, 12 aa, Artificial Sequence
  Description of Artificial Sequence: Synthetic peptide
  XENP019823 vlCDR1
RASQSVGSSYLA

SEQ ID NO: 865 - protein, 7 aa, Artificial Sequence
  Description of Artificial Sequence: Synthetic peptide
  XENP019823 vlCDR2
GAFSRAT

SEQ ID NO: 866 - protein, 9 aa, Artificial Sequence
  Description of Artificial Sequence: Synthetic peptide
  XENP019823 vlCDR3
QQYGSSPWT

SEQ ID NO: 867 - protein, 246 aa, Artificial Sequence
  Description of Artificial Sequence: Synthetic polypeptide
  XENP019824 [CTLA-4]_H0.76_L0_scFv(GKPGS)4
QVQLVESGGGVVQPGRSLRLSCAASGFTFSSYTMHWVRQAPGKGLEWVTFISYDGNQKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 868 - protein, 118 aa, Artificial Sequence
  Description of Artificial Sequence: Synthetic polypeptide
  VH of XENP019824
QVQLVESGGGVVQPGRSLRLSCAASGFTFSSYTMHWVRQAPGKGLEWVTFISYDGNQKYYADSVKGRFTISRDNSKNTLYLQMNSLRAEDTAIYYCARTGWLGPFDYWGQGTLVTVSS

SEQ ID NO: 869 - protein, 108 aa, Artificial Sequence; identical to SEQ ID NO: 23
  Description of Artificial Sequence: Synthetic polypeptide
  VL of XENP019824

SEQ ID NO: 870 - protein, 5 aa, Artificial Sequence
  Description of Artificial Sequence: Synthetic peptide
  XENP019824 vhCDR1
SYTMH

SEQ ID NO: 871 - protein, 17 aa, Artificial Sequence
  Description of Artificial Sequence: Synthetic peptide
  XENP019824 vhCDR2
FISYDGNQKYYADSVKG

SEQ ID NO: 872 - protein, 9 aa, Artificial Sequence
  Description of Artificial Sequence: Synthetic peptide
  XENP019824 vhCDR3
TGWLGPFDY

SEQ ID NO: 873 - protein, 12 aa, Artificial Sequence
  Description of Artificial Sequence: Synthetic peptide
  XENP019824 vlCDR1
RASQSVGSSYLA

SEQ ID NO: 874 - protein, 7 aa, Artificial Sequence
  Description of Artificial Sequence: Synthetic peptide
  XENP019824 vlCDR2
GAFSRAT

SEQ ID NO: 875 - protein, 9 aa, Artificial Sequence
  Description of Artificial Sequence: Synthetic peptide
  XENP019824 vlCDR3
QQYGSSPWT

SEQ ID NO: 876 - protein, 246 aa, Artificial Sequence
  Description of Artificial Sequence: Synthetic polypeptide
  XENP019825 [CTLA-4]_H0.77_L0_scFv(GKPGS)4
QVQLVESGGGVVQPGRSLRLSCAASGFTFSSYTMHWVRQAPGKGLEWVTFISYDGNNIYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 877 - protein, 118 aa, Artificial Sequence
  Description of Artificial Sequence: Synthetic polypeptide
  VH of XENP019825
QVQLVESGGGVVQPGRSLRLSCAASGFTFSSYTMHWVRQAPGKGLEWVTFISYDGNNIYYADSVKGRFTISRDNSKNTLYLQMNSLRAEDTAIYYCARTGWLGPFDYWGQGTLVTVSS

SEQ ID NO: 878 - protein, 108 aa, Artificial Sequence; identical to SEQ ID NO: 23
  Description of Artificial Sequence: Synthetic polypeptide
  VL of XENP019825

SEQ ID NO: 879 - protein, 5 aa, Artificial Sequence
  Description of Artificial Sequence: Synthetic peptide
  XENP019825 vhCDR1
SYTMH

SEQ ID NO: 880 - protein, 17 aa, Artificial Sequence
  Description of Artificial Sequence: Synthetic peptide
  XENP019825 vhCDR2
FISYDGNNIYYADSVKG

SEQ ID NO: 881 - protein, 9 aa, Artificial Sequence
  Description of Artificial Sequence: Synthetic peptide
  XENP019825 vhCDR3
TGWLGPFDY

SEQ ID NO: 882 - protein, 12 aa, Artificial Sequence
  Description of Artificial Sequence: Synthetic peptide
  XENP019825 vlCDR1
RASQSVGSSYLA

SEQ ID NO: 883 - protein, 7 aa, Artificial Sequence
  Description of Artificial Sequence: Synthetic peptide
  XENP019825 vlCDR2
GAFSRAT

SEQ ID NO: 884 - protein, 9 aa, Artificial Sequence
  Description of Artificial Sequence: Synthetic peptide
  XENP019825 vlCDR3
QQYGSSPWT

SEQ ID NO: 885 - protein, 246 aa, Artificial Sequence
  Description of Artificial Sequence: Synthetic polypeptide
  XENP019826 [CTLA-4]_H0.78_L0_scFv(GKPGS)4
QVQLVESGGGVVQPGRSLRLSCAASGFTFSSYTMHWVRQAPGKGLEWVTFISYDGNNTYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 886 - protein, 118 aa, Artificial Sequence
  Description of Artificial Sequence: Synthetic polypeptide
  VH of XENP019826
QVQLVESGGGVVQPGRSLRLSCAASGFTFSSYTMHWVRQAPGKGLEWVTFISYDGNNTYYADSVKGRFTISRDNSKNTLYLQMNSLRAEDTAIYYCARTGWLGPFDYWGQGTLVTVSS

SEQ ID NO: 887 - protein, 108 aa, Artificial Sequence; identical to SEQ ID NO: 23
  Description of Artificial Sequence: Synthetic polypeptide
  VL of XENP019826

SEQ ID NO: 888 - protein, 5 aa, Artificial Sequence
  Description of Artificial Sequence: Synthetic peptide
  XENP019826 vhCDR1
SYTMH

SEQ ID NO: 889 - protein, 17 aa, Artificial Sequence
  Description of Artificial Sequence: Synthetic peptide
  XENP019826 vhCDR2
FISYDGNNTYYADSVKG

SEQ ID NO: 890 - protein, 9 aa, Artificial Sequence
  Description of Artificial Sequence: Synthetic peptide
  XENP019826 vhCDR3
TGWLGPFDY

SEQ ID NO: 891 - protein, 12 aa, Artificial Sequence
  Description of Artificial Sequence: Synthetic peptide
  XENP019826 vlCDR1
RASQSVGSSYLA

SEQ ID NO: 892 - protein, 7 aa, Artificial Sequence
  Description of Artificial Sequence: Synthetic peptide
  XENP019826 vlCDR2
GAFSRAT

SEQ ID NO: 893 - protein, 9 aa, Artificial Sequence
  Description of Artificial Sequence: Synthetic peptide
  XENP019826 vlCDR3
QQYGSSPWT

SEQ ID NO: 894 - protein, 246 aa, Artificial Sequence
  Description of Artificial Sequence: Synthetic polypeptide
  XENP019827 [CTLA-4]_H0.79_L0_scFv(GKPGS)4
QVQLVESGGGVVQPGRSLRLSCAASGFTFSSYTMHWVRQAPGKGLEWVTFISYDGNNKAYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 895 - protein, 118 aa, Artificial Sequence
  Description of Artificial Sequence: Synthetic polypeptide
  VH of XENP019827
QVQLVESGGGVVQPGRSLRLSCAASGFTFSSYTMHWVRQAPGKGLEWVTFISYDGNNKAYADSVKGRFTISRDNSKNTLYLQMNSLRAEDTAIYYCARTGWLGPFDYWGQGTLVTVSS

SEQ ID NO: 896 - protein, 108 aa, Artificial Sequence; identical to SEQ ID NO: 23
  Description of Artificial Sequence: Synthetic polypeptide
  VL of XENP019827

SEQ ID NO: 897 - protein, 5 aa, Artificial Sequence
  Description of Artificial Sequence: Synthetic peptide
  XENP019827 vhCDR1
SYTMH

SEQ ID NO: 898 - protein, 17 aa, Artificial Sequence
  Description of Artificial Sequence: Synthetic peptide
  XENP019827 vhCDR2
FISYDGNNKAYADSVKG

SEQ ID NO: 899 - protein, 9 aa, Artificial Sequence
  Description of Artificial Sequence: Synthetic peptide
  XENP019827 vhCDR3
TGWLGPFDY

SEQ ID NO: 900 - protein, 12 aa, Artificial Sequence
  Description of Artificial Sequence: Synthetic peptide
  XENP019827 vlCDR1
RASQSVGSSYLA

SEQ ID NO: 901 - protein, 7 aa, Artificial Sequence
  Description of Artificial Sequence: Synthetic peptide
  XENP019827 vlCDR2
GAFSRAT

SEQ ID NO: 902 - protein, 9 aa, Artificial Sequence
  Description of Artificial Sequence: Synthetic peptide
  XENP019827 vlCDR3
QQYGSSPWT

SEQ ID NO: 903 - protein, 246 aa, Artificial Sequence
  Description of Artificial Sequence: Synthetic polypeptide
  XENP019828 [CTLA-4]_H0.80_L0_scFv(GKPGS)4
QVQLVESGGGVVQPGRSLRLSCAASGFTFSSYTMHWVRQAPGKGLEWVTFISYDGNNKYYAASVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 904 - protein, 118 aa, Artificial Sequence
  Description of Artificial Sequence: Synthetic polypeptide
  VH of XENP019828
QVQLVESGGGVVQPGRSLRLSCAASGFTFSSYTMHWVRQAPGKGLEWVTFISYDGNNKYYAASVKGRFTISRDNSKNTLYLQMNSLRAEDTAIYYCARTGWLGPFDYWGQGTLVTVSS

SEQ ID NO: 905 - protein, 108 aa, Artificial Sequence; identical to SEQ ID NO: 23
  Description of Artificial Sequence: Synthetic polypeptide
  VL of XENP019828

SEQ ID NO: 906 - protein, 5 aa, Artificial Sequence
  Description of Artificial Sequence: Synthetic peptide
  XENP019828 vhCDR1
SYTMH

SEQ ID NO: 907 - protein, 17 aa, Artificial Sequence
  Description of Artificial Sequence: Synthetic peptide
  XENP019828 vhCDR2
FISYDGNNKYYAASVKG

SEQ ID NO: 908 - protein, 9 aa, Artificial Sequence
  Description of Artificial Sequence: Synthetic peptide
  XENP019828 vhCDR3
TGWLGPFDY

SEQ ID NO: 909 - protein, 12 aa, Artificial Sequence
  Description of Artificial Sequence: Synthetic peptide
  XENP019828 vlCDR1
RASQSVGSSYLA

SEQ ID NO: 910 - protein, 7 aa, Artificial Sequence
  Description of Artificial Sequence: Synthetic peptide
  XENP019828 vlCDR2
GAFSRAT

SEQ ID NO: 911 - protein, 9 aa, Artificial Sequence
  Description of Artificial Sequence: Synthetic peptide
  XENP019828 vlCDR3
QQYGSSPWT

SEQ ID NO: 912 - protein, 246 aa, Artificial Sequence
  Description of Artificial Sequence: Synthetic polypeptide
  XENP019829 [CTLA-4]_H0.81_L0_scFv(GKPGS)4
QVQLVESGGGVVQPGRSLRLSCAASGFTFSSYTMHWVRQAPGKGLEWVTFISYDGNNKYYAKSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 913 - protein, 118 aa, Artificial Sequence
  Description of Artificial Sequence: Synthetic polypeptide
  VH of XENP019829
QVQLVESGGGVVQPGRSLRLSCAASGFTFSSYTMHWVRQAPGKGLEWVTFISYDGNNKYYAKSVKGRFTISRDNSKNTLYLQMNSLRAEDTAIYYCARTGWLGPFDYWGQGTLVTVSS

SEQ ID NO: 914 - protein, 108 aa, Artificial Sequence; identical to SEQ ID NO: 23
  Description of Artificial Sequence: Synthetic polypeptide
  VL of XENP019829

SEQ ID NO: 915 - protein, 5 aa, Artificial Sequence
  Description of Artificial Sequence: Synthetic peptide
  XENP019829 vhCDR1
SYTMH

SEQ ID NO: 916 - protein, 17 aa, Artificial Sequence
  Description of Artificial Sequence: Synthetic peptide
  XENP019829 vhCDR2
FISYDGNNKYYAKSVKG

SEQ ID NO: 917 - protein, 9 aa, Artificial Sequence
  Description of Artificial Sequence: Synthetic peptide
  XENP019829 vhCDR3
TGWLGPFDY

SEQ ID NO: 918 - protein, 12 aa, Artificial Sequence
  Description of Artificial Sequence: Synthetic peptide
  XENP019829 vlCDR1
RASQSVGSSYLA

SEQ ID NO: 919 - protein, 7 aa, Artificial Sequence
  Description of Artificial Sequence: Synthetic peptide
  XENP019829 vlCDR2
GAFSRAT

SEQ ID NO: 920 - protein, 9 aa, Artificial Sequence
  Description of Artificial Sequence: Synthetic peptide
  XENP019829 vlCDR3
QQYGSSPWT

SEQ ID NO: 921 - protein, 246 aa, Artificial Sequence
  Description of Artificial Sequence: Synthetic polypeptide
  XENP019830 [CTLA-4]_H0.82_L0_scFv(GKPGS)4
QVQLVESGGGVVQPGRSLRLSCAASGFTFSSYTMHWVRQAPGKGLEWVTFISYDGNNKYYADSVKDRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 922 - protein, 118 aa, Artificial Sequence
  Description of Artificial Sequence: Synthetic polypeptide
  VH of XENP019830
QVQLVESGGGVVQPGRSLRLSCAASGFTFSSYTMHWVRQAPGKGLEWVTFISYDGNNKYYADSVKDRFTISRDNSKNTLYLQMNSLRAEDTAIYYCARTGWLGPFDYWGQGTLVTVSS

SEQ ID NO: 923 - protein, 108 aa, Artificial Sequence; identical to SEQ ID NO: 23
  Description of Artificial Sequence: Synthetic polypeptide
  VL of XENP019830

SEQ ID NO: 924 - protein, 5 aa, Artificial Sequence
  Description of Artificial Sequence: Synthetic peptide
  XENP019830 vhCDR1
SYTMH

SEQ ID NO: 925 - protein, 17 aa, Artificial Sequence
  Description of Artificial Sequence: Synthetic peptide
  XENP019830 vhCDR2
FISYDGNNKYYADSVKD

SEQ ID NO: 926 - protein, 9 aa, Artificial Sequence
  Description of Artificial Sequence: Synthetic peptide
  XENP019830 vhCDR3
TGWLGPFDY

SEQ ID NO: 927 - protein, 12 aa, Artificial Sequence
  Description of Artificial Sequence: Synthetic peptide
  XENP019830 vlCDR1
RASQSVGSSYLA

SEQ ID NO: 928 - protein, 7 aa, Artificial Sequence
  Description of Artificial Sequence: Synthetic peptide
  XENP019830 vlCDR2
GAFSRAT

SEQ ID NO: 929 - protein, 9 aa, Artificial Sequence
  Description of Artificial Sequence: Synthetic peptide
  XENP019830 vlCDR3
QQYGSSPWT

SEQ ID NO: 930 - protein, 246 aa, Artificial Sequence
  Description of Artificial Sequence: Synthetic polypeptide
  XENP019831 [CTLA-4]_H0.83_L0_scFv(GKPGS)4
QVQLVESGGGVVQPGRSLRLSCAASGFTFSSYTMHWVRQAPGKGLEWVTFISYDGNNKYYADSVKERFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 931 - protein, 118 aa, Artificial Sequence
  Description of Artificial Sequence: Synthetic polypeptide
  VH of XENP019831
QVQLVESGGGVVQPGRSLRLSCAASGFTFSSYTMHWVRQAPGKGLEWVTFISYDGNNKYYADSVKERFTISRDNSKNTLYLQMNSLRAEDTAIYYCARTGWLGPFDYWGQGTLVTVSS

SEQ ID NO: 932 - protein, 108 aa, Artificial Sequence; identical to SEQ ID NO: 23
  Description of Artificial Sequence: Synthetic polypeptide
  VL of XENP019831

SEQ ID NO: 933 - protein, 5 aa, Artificial Sequence
  Description of Artificial Sequence: Synthetic peptide
  XENP019831 vhCDR1
SYTMH

SEQ ID NO: 934 - protein, 17 aa, Artificial Sequence
  Description of Artificial Sequence: Synthetic peptide
  XENP019831 vhCDR2
FISYDGNNKYYADSVKE

SEQ ID NO: 935 - protein, 9 aa, Artificial Sequence
  Description of Artificial Sequence: Synthetic peptide
  XENP019831 vhCDR3
TGWLGPFDY

SEQ ID NO: 936 - protein, 12 aa, Artificial Sequence
  Description of Artificial Sequence: Synthetic peptide
  XENP019831 vlCDR1
RASQSVGSSYLA

SEQ ID NO: 937 - protein, 7 aa, Artificial Sequence
  Description of Artificial Sequence: Synthetic peptide
  XENP019831 vlCDR2
GAFSRAT

SEQ ID NO: 938 - protein, 9 aa, Artificial Sequence
  Description of Artificial Sequence: Synthetic peptide
  XENP019831 vlCDR3
QQYGSSPWT

SEQ ID NO: 939 - protein, 246 aa, Artificial Sequence
  Description of Artificial Sequence: Synthetic polypeptide
  XENP019832 [CTLA-4]_H0.84_L0_scFv(GKPGS)4
QVQLVESGGGVVQPGRSLRLSCAASGFTFSSYTMHWVRQAPGKGLEWVTFISYDGNNKYYADSVKGQFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 940 - protein, 118 aa, Artificial Sequence
  Description of Artificial Sequence: Synthetic polypeptide
  VH of XENP019832
QVQLVESGGGVVQPGRSLRLSCAASGFTFSSYTMHWVRQAPGKGLEWVTFISYDGNNKYYADSVKGQFTISRDNSKNTLYLQMNSLRAEDTAIYYCARTGWLGPFDYWGQGTLVTVSS

SEQ ID NO: 941 - protein, 108 aa, Artificial Sequence; identical to SEQ ID NO: 23
  Description of Artificial Sequence: Synthetic polypeptide
  VL of XENP019832

SEQ ID NO: 942 - protein, 5 aa, Artificial Sequence
  Description of Artificial Sequence: Synthetic peptide
  XENP019832 vhCDR1
SYTMH

SEQ ID NO: 943 - protein, 17 aa, Artificial Sequence
  Description of Artificial Sequence: Synthetic peptide
  XENP019832 vhCDR2
FISYDGNNKYYADSVKG

SEQ ID NO: 944 - protein, 9 aa, Artificial Sequence
  Description of Artificial Sequence: Synthetic peptide
  XENP019832 vhCDR3
TGWLGPFDY

SEQ ID NO: 945 - protein, 12 aa, Artificial Sequence
  Description of Artificial Sequence: Synthetic peptide
  XENP019832 vlCDR1
RASQSVGSSYLA

SEQ ID NO: 946 - protein, 7 aa, Artificial Sequence
  Description of Artificial Sequence: Synthetic peptide
  XENP019832 vlCDR2
GAFSRAT

SEQ ID NO: 947 - protein, 9 aa, Artificial Sequence
  Description of Artificial Sequence: Synthetic peptide
  XENP019832 vlCDR3
QQYGSSPWT

SEQ ID NO: 948 - protein, 246 aa, Artificial Sequence
  Description of Artificial Sequence: Synthetic polypeptide
  XENP019833 [CTLA-4]_H0.85_L0_scFv(GKPGS)4
QVQLVESGGGVVQPGRSLRLSCAASGFTFSSYTMHWVRQAPGKGLEWVTFISYDGNNKYYADSVKGRFTMSRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 949 - protein, 118 aa, Artificial Sequence
  Description of Artificial Sequence: Synthetic polypeptide
  VH of XENP019833
QVQLVESGGGVVQPGRSLRLSCAASGFTFSSYTMHWVRQAPGKGLEWVTFISYDGNNKYYADSVKGRFTMSRDNSKNTLYLQMNSLRAEDTAIYYCARTGWLGPFDYWGQGTLVTVSS

SEQ ID NO: 950 - protein, 108 aa, Artificial Sequence; identical to SEQ ID NO: 23
  Description of Artificial Sequence: Synthetic polypeptide
  VL of XENP019833

SEQ ID NO: 951 - protein, 5 aa, Artificial Sequence
  Description of Artificial Sequence: Synthetic peptide
  XENP019833 vhCDR1
SYTMH

SEQ ID NO: 952 - protein, 17 aa, Artificial Sequence
  Description of Artificial Sequence: Synthetic peptide
  XENP019833 vhCDR2
FISYDGNNKYYADSVKG

SEQ ID NO: 953 - protein, 9 aa, Artificial Sequence
  Description of Artificial Sequence: Synthetic peptide
  XENP019833 vhCDR3
TGWLGPFDY

SEQ ID NO: 954 - protein, 12 aa, Artificial Sequence
  Description of Artificial Sequence: Synthetic peptide
  XENP019833 vlCDR1
RASQSVGSSYLA

SEQ ID NO: 955 - protein, 7 aa, Artificial Sequence
  Description of Artificial Sequence: Synthetic peptide
  XENP019833 vlCDR2
GAFSRAT

SEQ ID NO: 956 - protein, 9 aa, Artificial Sequence
  Description of Artificial Sequence: Synthetic peptide
  XENP019833 vlCDR3
QQYGSSPWT

SEQ ID NO: 957 - protein, 246 aa, Artificial Sequence
  Description of Artificial Sequence: Synthetic polypeptide
  XENP019834 [CTLA-4]_H0.86_L0_scFv(GKPGS)4
QVQLVESGGGVVQPGRSLRLSCAASGFTFSSYTMHWVRQAPGKGLEWVTFISYDGNNKYYADSVKGRFTVSRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 958 - protein, 118 aa, Artificial Sequence
  Description of Artificial Sequence: Synthetic polypeptide
  VH of XENP019834
QVQLVESGGGVVQPGRSLRLSCAASGFTFSSYTMHWVRQAPGKGLEWVTFISYDGNNKYYADSVKGRFTVSRDNSKNTLYLQMNSLRAEDTAIYYCARTGWLGPFDYWGQGTLVTVSS

SEQ ID NO: 959 - protein, 108 aa, Artificial Sequence; identical to SEQ ID NO: 23
  Description of Artificial Sequence: Synthetic polypeptide
  VL of XENP019834

SEQ ID NO: 960 - protein, 5 aa, Artificial Sequence
  Description of Artificial Sequence: Synthetic peptide
  XENP019834 vhCDR1
SYTMH

SEQ ID NO: 961 - protein, 17 aa, Artificial Sequence
  Description of Artificial Sequence: Synthetic peptide
  XENP019834 vhCDR2
FISYDGNNKYYADSVKG

SEQ ID NO: 962 - protein, 9 aa, Artificial Sequence
  Description of Artificial Sequence: Synthetic peptide
  XENP019834 vhCDR3
TGWLGPFDY

SEQ ID NO: 963 - protein, 12 aa, Artificial Sequence
  Description of Artificial Sequence: Synthetic peptide
  XENP019834 vlCDR1
RASQSVGSSYLA

SEQ ID NO: 964 - protein, 7 aa, Artificial Sequence
  Description of Artificial Sequence: Synthetic peptide
  XENP019834 vlCDR2
GAFSRAT

SEQ ID NO: 965 - protein, 9 aa, Artificial Sequence
  Description of Artificial Sequence: Synthetic peptide
  XENP019834 vlCDR3
QQYGSSPWT

SEQ ID NO: 966 - protein, 246 aa, Artificial Sequence
  Description of Artificial Sequence: Synthetic polypeptide
  XENP019835 [CTLA-4]_H0.87_L0_scFv(GKPGS)4
QVQLVESGGGVVQPGRSLRLSCAASGFTFSSYTMHWVRQAPGKGLEWVTFISYDGNNKYYADSVKGRFTISEDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 967 - protein, 118 aa, Artificial Sequence
  Description of Artificial Sequence: Synthetic polypeptide
  VH of XENP019835
QVQLVESGGGVVQPGRSLRLSCAASGFTFSSYTMHWVRQAPGKGLEWVTFISYDGNNKYYADSVKGRFTISEDNSKNTLYLQMNSLRAEDTAIYYCARTGWLGPFDYWGQGTLVTVSS

SEQ ID NO: 968 - protein, 108 aa, Artificial Sequence; identical to SEQ ID NO: 23
  Description of Artificial Sequence: Synthetic polypeptide
  VL of XENP019835

SEQ ID NO: 969 - protein, 5 aa, Artificial Sequence
  Description of Artificial Sequence: Synthetic peptide
  XENP019835 vhCDR1
SYTMH

SEQ ID NO: 970 - protein, 17 aa, Artificial Sequence
  Description of Artificial Sequence: Synthetic peptide
  XENP019835 vhCDR2
FISYDGNNKYYADSVKG

SEQ ID NO: 971 - protein, 9 aa, Artificial Sequence
  Description of Artificial Sequence: Synthetic peptide
  XENP019835 vhCDR3
TGWLGPFDY

SEQ ID NO: 972 - protein, 12 aa, Artificial Sequence
  Description of Artificial Sequence: Synthetic peptide
  XENP019835 vlCDR1
RASQSVGSSYLA

SEQ ID NO: 973 - protein, 7 aa, Artificial Sequence
  Description of Artificial Sequence: Synthetic peptide
  XENP019835 vlCDR2
GAFSRAT

SEQ ID NO: 974 - protein, 9 aa, Artificial Sequence
  Description of Artificial Sequence: Synthetic peptide
  XENP019835 vlCDR3
QQYGSSPWT

SEQ ID NO: 975 - protein, 246 aa, Artificial Sequence
  Description of Artificial Sequence: Synthetic polypeptide
  XENP019836 [CTLA-4]_H0.88_L0_scFv(GKPGS)4
QVQLVESGGGVVQPGRSLRLSCAASGFTFSSYTMHWVRQAPGKGLEWVTFISYDGNNKYYADSVKGRFTISRENSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 976 - protein, 118 aa, Artificial Sequence
  Description of Artificial Sequence: Synthetic polypeptide
  VH of XENP019836
QVQLVESGGGVVQPGRSLRLSCAASGFTFSSYTMHWVRQAPGKGLEWVTFISYDGNNKYYADSVKGRFTISRENSKNTLYLQMNSLRAEDTAIYYCARTGWLGPFDYWGQGTLVTVSS

SEQ ID NO: 977 - protein, 108 aa, Artificial Sequence; identical to SEQ ID NO: 23
  Description of Artificial Sequence: Synthetic polypeptide
  VL of XENP019836

SEQ ID NO: 978 - protein, 5 aa, Artificial Sequence
  Description of Artificial Sequence: Synthetic peptide
  XENP019836 vhCDR1
SYTMH

SEQ ID NO: 979 - protein, 17 aa, Artificial Sequence
  Description of Artificial Sequence: Synthetic peptide
  XENP019836 vhCDR2
FISYDGNNKYYADSVKG

SEQ ID NO: 980 - protein, 9 aa, Artificial Sequence
  Description of Artificial Sequence: Synthetic peptide
  XENP019836 vhCDR3
TGWLGPFDY

SEQ ID NO: 981 - protein, 12 aa, Artificial Sequence
  Description of Artificial Sequence: Synthetic peptide
  XENP019836 vlCDR1
RASQSVGSSYLA

SEQ ID NO: 982 - protein, 7 aa, Artificial Sequence
  Description of Artificial Sequence: Synthetic peptide
  XENP019836 vlCDR2
GAFSRAT

SEQ ID NO: 983 - protein, 9 aa, Artificial Sequence
  Description of Artificial Sequence: Synthetic peptide
  XENP019836 vlCDR3
QQYGSSPWT

SEQ ID NO: 984 - protein, 246 aa, Artificial Sequence
  Description of Artificial Sequence: Synthetic polypeptide
  XENP019837 [CTLA-4]_H0.89_L0_scFv(GKPGS)4
QVQLVESGGGVVQPGRSLRLSCAASGFTFSSYTMHWVRQAPGKGLEWVTFISYDGNNKYYADSVKGRFTISRDDSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 985 - protein, 118 aa, Artificial Sequence
  Description of Artificial Sequence: Synthetic polypeptide
  VH of XENP019837
QVQLVESGGGVVQPGRSLRLSCAASGFTFSSYTMHWVRQAPGKGLEWVTFISYDGNNKYYADSVKGRFTISRDDSKNTLYLQMNSLRAEDTAIYYCARTGWLGPFDYWGQGTLVTVSS

SEQ ID NO: 986 - protein, 108 aa, Artificial Sequence; identical to SEQ ID NO: 23
  Description of Artificial Sequence: Synthetic polypeptide
  VL of XENP019837

SEQ ID NO: 987 - protein, 5 aa, Artificial Sequence
  Description of Artificial Sequence: Synthetic peptide
  XENP019837 vhCDR1
SYTMH

SEQ ID NO: 988 - protein, 17 aa, Artificial Sequence
  Description of Artificial Sequence: Synthetic peptide
  XENP019837 vhCDR2
FISYDGNNKYYADSVKG

SEQ ID NO: 989 - protein, 9 aa, Artificial Sequence
  Description of Artificial Sequence: Synthetic peptide
  XENP019837 vhCDR3
TGWLGPFDY

SEQ ID NO: 990 - protein, 12 aa, Artificial Sequence
  Description of Artificial Sequence: Synthetic peptide
  XENP019837 vlCDR1
RASQSVGSSYLA

SEQ ID NO: 991 - protein, 7 aa, Artificial Sequence
  Description of Artificial Sequence: Synthetic peptide
  XENP019837 vlCDR2
GAFSRAT

SEQ ID NO: 992 - protein, 9 aa, Artificial Sequence
  Description of Artificial Sequence: Synthetic peptide
  XENP019837 vlCDR3
QQYGSSPWT

SEQ ID NO: 993 - protein, 246 aa, Artificial Sequence
  Description of Artificial Sequence: Synthetic polypeptide
  XENP019838 [CTLA-4]_H0.90_L0_scFv(GKPGS)4
QVQLVESGGGVVQPGRSLRLSCAASGFTFSSYTMHWVRQAPGKGLEWVTFISYDGNNKYYADSVKGRFTISRDNAKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 994 - protein, 118 aa, Artificial Sequence
  Description of Artificial Sequence: Synthetic polypeptide
  VH of XENP019838
QVQLVESGGGVVQPGRSLRLSCAASGFTFSSYTMHWVRQAPGKGLEWVTFISYDGNNKYYADSVKGRFTISRDNAKNTLYLQMNSLRAEDTAIYYCARTGWLGPFDYWGQGTLVTVSS

SEQ ID NO: 995 - protein, 108 aa, Artificial Sequence; identical to SEQ ID NO: 23
  Description of Artificial Sequence: Synthetic polypeptide
  VL of XENP019838

SEQ ID NO: 996 - protein, 5 aa, Artificial Sequence
  Description of Artificial Sequence: Synthetic peptide
  XENP019838 vhCDR1
SYTMH

SEQ ID NO: 997 - protein, 17 aa, Artificial Sequence
  Description of Artificial Sequence: Synthetic peptide
  XENP019838 vhCDR2
FISYDGNNKYYADSVKG

SEQ ID NO: 998 - protein, 9 aa, Artificial Sequence
  Description of Artificial Sequence: Synthetic peptide
  XENP019838 vhCDR3
TGWLGPFDY

SEQ ID NO: 999 - protein, 12 aa, Artificial Sequence
  Description of Artificial Sequence: Synthetic peptide
  XENP019838 vlCDR1
RASQSVGSSYLA

SEQ ID NO: 1000 - protein, 7 aa, Artificial Sequence
  Description of Artificial Sequence: Synthetic peptide
  XENP019838 vlCDR2
GAFSRAT

SEQ ID NO: 1001 - protein, 9 aa, Artificial Sequence
  Description of Artificial Sequence: Synthetic peptide
  XENP019838 vlCDR3
QQYGSSPWT

SEQ ID NO: 1002 - protein, 246 aa, Artificial Sequence
  Description of Artificial Sequence: Synthetic polypeptide
  XENP019839 [CTLA-4]_H0.91_L0_scFv(GKPGS)4
QVQLVESGGGVVQPGRSLRLSCAASGFTFSSYTMHWVRQAPGKGLEWVTFISYDGNNKYYADSVKGRFTISRDNSRNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1003 - protein, 118 aa, Artificial Sequence
  Description of Artificial Sequence: Synthetic polypeptide
  VH of XENP019839
QVQLVESGGGVVQPGRSLRLSCAASGFTFSSYTMHWVRQAPGKGLEWVTFISYDGNNKYYADSVKGRFTISRDNSRNTLYLQMNSLRAEDTAIYYCARTGWLGPFDYWGQGTLVTVSS

SEQ ID NO: 1004 - protein, 108 aa, Artificial Sequence; identical to SEQ ID NO: 23
  Description of Artificial Sequence: Synthetic polypeptide
  VL of XENP019839

SEQ ID NO: 1005 - protein, 5 aa, Artificial Sequence
  Description of Artificial Sequence: Synthetic peptide
  XENP019839 vhCDR1
SYTMH

SEQ ID NO: 1006 - protein, 17 aa, Artificial Sequence
  Description of Artificial Sequence: Synthetic peptide
  XENP019839 vhCDR2
FISYDGNNKYYADSVKG

SEQ ID NO: 1007 - protein, 9 aa, Artificial Sequence
  Description of Artificial Sequence: Synthetic peptide
  XENP019839 vhCDR3
TGWLGPFDY

SEQ ID NO: 1008 - protein, 12 aa, Artificial Sequence
  Description of Artificial Sequence: Synthetic peptide
  XENP019839 vlCDR1
RASQSVGSSYLA

SEQ ID NO: 1009 - protein, 7 aa, Artificial Sequence
  Description of Artificial Sequence: Synthetic peptide
  XENP019839 vlCDR2
GAFSRAT

SEQ ID NO: 1010 - protein, 9 aa, Artificial Sequence
  Description of Artificial Sequence: Synthetic peptide
  XENP019839 vlCDR3
QQYGSSPWT

SEQ ID NO: 1011 - protein, 246 aa, Artificial Sequence
  Description of Artificial Sequence: Synthetic polypeptide
  XENP019840 [CTLA-4]_H0.92_L0_scFv(GKPGS)4
QVQLVESGGGVVQPGRSLRLSCAASGFTFSSYTMHWVRQAPGKGLEWVTFISYDGNNKYYADSVKGRFTISRDNSKNSLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1012 - protein, 118 aa, Artificial Sequence
  Description of Artificial Sequence: Synthetic polypeptide
  VH of XENP019840
QVQLVESGGGVVQPGRSLRLSCAASGFTFSSYTMHWVRQAPGKGLEWVTFISYDGNNKYYADSVKGRFTISRDNSKNSLYLQMNSLRAEDTAIYYCARTGWLGPFDYWGQGTLVTVSS

SEQ ID NO: 1013 - protein, 108 aa, Artificial Sequence; identical to SEQ ID NO: 23
  Description of Artificial Sequence: Synthetic polypeptide
  VL of XENP019840

SEQ ID NO: 1014 - protein, 5 aa, Artificial Sequence
  Description of Artificial Sequence: Synthetic peptide
  XENP019840 vhCDR1
SYTMH

SEQ ID NO: 1015 - protein, 17 aa, Artificial Sequence
  Description of Artificial Sequence: Synthetic peptide
  XENP019840 vhCDR2
FISYDGNNKYYADSVKG

SEQ ID NO: 1016 - protein, 9 aa, Artificial Sequence
  Description of Artificial Sequence: Synthetic peptide
  XENP019840 vhCDR3
TGWLGPFDY

SEQ ID NO: 1017 - protein, 12 aa, Artificial Sequence
  Description of Artificial Sequence: Synthetic peptide
  XENP019840 vlCDR1
RASQSVGSSYLA

SEQ ID NO: 1018 - protein, 7 aa, Artificial Sequence
  Description of Artificial Sequence: Synthetic peptide
  XENP019840 vlCDR2
GAFSRAT

SEQ ID NO: 1019 - protein, 9 aa, Artificial Sequence
  Description of Artificial Sequence: Synthetic peptide
  XENP019840 vlCDR3
QQYGSSPWT

SEQ ID NO: 1020 - protein, 246 aa, Artificial Sequence
  Description of Artificial Sequence: Synthetic polypeptide
  XENP019841 [CTLA-4]_H0.93_L0_scFv(GKPGS)4
QVQLVESGGGVVQPGRSLRLSCAASGFTFSSYTMHWVRQAPGKGLEWVTFISYDGNNKYYADSVKGRFTISRDNSKNQLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1021 - protein, 118 aa, Artificial Sequence
  Description of Artificial Sequence: Synthetic polypeptide
  VH of XENP019841
QVQLVESGGGVVQPGRSLRLSCAASGFTFSSYTMHWVRQAPGKGLEWVTFISYDGNNKYYADSVKGRFTISRDNSKNQLYLQMNSLRAEDTAIYYCARTGWLGPFDYWGQGTLVTVSS

SEQ ID NO: 1022 - protein, 108 aa, Artificial Sequence; identical to SEQ ID NO: 23
  Description of Artificial Sequence: Synthetic polypeptide
  VL of XENP019841

SEQ ID NO: 1023 - protein, 5 aa, Artificial Sequence
  Description of Artificial Sequence: Synthetic peptide
  XENP019841 vhCDR1
SYTMH

SEQ ID NO: 1024 - protein, 17 aa, Artificial Sequence
  Description of Artificial Sequence: Synthetic peptide
  XENP019841 vhCDR2
FISYDGNNKYYADSVKG

SEQ ID NO: 1025 - protein, 9 aa, Artificial Sequence
  Description of Artificial Sequence: Synthetic peptide
  XENP019841 vhCDR3
TGWLGPFDY

SEQ ID NO: 1026 - protein, 12 aa, Artificial Sequence
  Description of Artificial Sequence: Synthetic peptide
  XENP019841 vlCDR1
RASQSVGSSYLA

SEQ ID NO: 1027 - protein, 7 aa, Artificial Sequence
  Description of Artificial Sequence: Synthetic peptide
  XENP019841 vlCDR2
GAFSRAT

SEQ ID NO: 1028 - protein, 9 aa, Artificial Sequence
  Description of Artificial Sequence: Synthetic peptide
  XENP019841 vlCDR3
QQYGSSPWT

SEQ ID NO: 1029 - protein, 246 aa, Artificial Sequence
  Description of Artificial Sequence: Synthetic polypeptide
  XENP019842 [CTLA-4]_H0.94_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLEMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1030 - protein, 118 aa, Artificial Sequence
  Description of Artificial Sequence: Synthetic polypeptide
  VH of XENP019842
QVQLVESGGGVVQPGRSLRLSCAASGFTFSSYTMHWVRQAPGKGLEWVTFISYDGNNKYYADSVKGRFTISRDNSKNTLYLEMNSLRAEDTAIYYCARTGWLGPFDYWGQGTLVTVSS

SEQ ID NO: 1031 - protein, 108 aa, Artificial Sequence; identical to SEQ ID NO: 23
  Description of Artificial Sequence: Synthetic polypeptide
  VL of XENP019842

SEQ ID NO: 1032 - protein, 5 aa, Artificial Sequence
  Description of Artificial Sequence: Synthetic peptide
  XENP019842 vhCDR1
SYTMH

SEQ ID NO: 1033 - protein, 17 aa, Artificial Sequence
  Description of Artificial Sequence: Synthetic peptide
  XENP019842 vhCDR2
FISYDGNNKYYADSVKG

SEQ ID NO: 1034 - protein, 9 aa, Artificial Sequence
  Description of Artificial Sequence: Synthetic peptide
  XENP019842 vhCDR3
TGWLGPFDY

SEQ ID NO: 1035 - protein, 12 aa, Artificial Sequence
  Description of Artificial Sequence: Synthetic peptide
  XENP019842 vlCDR1
RASQSVGSSYLA

SEQ ID NO: 1036 - protein, 7 aa, Artificial Sequence
  Description of Artificial Sequence: Synthetic peptide
  XENP019842 vlCDR2
GAFSRAT

SEQ ID NO: 1037 - protein, 9 aa, Artificial Sequence
  Description of Artificial Sequence: Synthetic peptide
  XENP019842 vlCDR3
QQYGSSPWT

SEQ ID NO: 1038 - protein, 246 aa, Artificial Sequence
  Description of Artificial Sequence: Synthetic polypeptide
  XENP019843 [CTLA-4]_H0.95_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMDSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1039 - protein, 118 aa, Artificial Sequence
  Description of Artificial Sequence: Synthetic polypeptide
  VH of XENP019843
QVQLVESGGGVVQPGRSLRLSCAASGFTFSSYTMHWVRQAPGKGLEWVTFISYDGNNKYYADSVKGRFTISRDNSKNTLYLQMDSLRAEDTAIYYCARTGWLGPFDYWGQGTLVTVSS

SEQ ID NO: 1040 - protein, 108 aa, Artificial Sequence; identical to SEQ ID NO: 23
  Description of Artificial Sequence: Synthetic polypeptide
  VL of XENP019843

SEQ ID NO: 1041 - protein, 5 aa, Artificial Sequence
  Description of Artificial Sequence: Synthetic peptide
  XENP019843 vhCDR1
SYTMH

SEQ ID NO: 1042 - protein, 17 aa, Artificial Sequence
  Description of Artificial Sequence: Synthetic peptide
  XENP019843 vhCDR2
FISYDGNNKYYADSVKG

SEQ ID NO: 1043 - protein, 9 aa, Artificial Sequence
  Description of Artificial Sequence: Synthetic peptide
  XENP019843 vhCDR3
TGWLGPFDY

SEQ ID NO: 1044 - protein, 12 aa, Artificial Sequence
  Description of Artificial Sequence: Synthetic peptide
  XENP019843 vlCDR1
RASQSVGSSYLA

SEQ ID NO: 1045 - protein, 7 aa, Artificial Sequence
  Description of Artificial Sequence: Synthetic peptide
  XENP019843 vlCDR2
GAFSRAT

SEQ ID NO: 1046 - protein, 9 aa, Artificial Sequence
  Description of Artificial Sequence: Synthetic peptide
  XENP019843 vlCDR3
QQYGSSPWT

SEQ ID NO: 1047 - protein, 246 aa, Artificial Sequence
  Description of Artificial Sequence: Synthetic polypeptide
  XENP019844 [CTLA-4]_H0.96_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNDLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1048 - protein, 118 aa, Artificial Sequence
  Description of Artificial Sequence: Synthetic polypeptide
  VH of XENP019844
QVQLVESGGGVVQPGRSLRLSCAASGFTFSSYTMHWVRQAPGKGLEWVTFISYDGNNKYYADSVKGRFTISRDNSKNTLYLQMNDLRAEDTAIYYCARTGWLGPFDYWGQGTLVTVSS

SEQ ID NO: 1049 - protein, 108 aa, Artificial Sequence; identical to SEQ ID NO: 23
  Description of Artificial Sequence: Synthetic polypeptide
  VL of XENP019844

SEQ ID NO: 1050 - protein, 5 aa, Artificial Sequence
  Description of Artificial Sequence: Synthetic peptide
  XENP019844 vhCDR1
SYTMH

SEQ ID NO: 1051 - protein, 17 aa, Artificial Sequence
  Description of Artificial Sequence: Synthetic peptide
  XENP019844 vhCDR2
FISYDGNNKYYADSVKG

SEQ ID NO: 1052 - protein, 9 aa, Artificial Sequence
  Description of Artificial Sequence: Synthetic peptide
  XENP019844 vhCDR3
TGWLGPFDY

SEQ ID NO: 1053 - protein, 12 aa, Artificial Sequence
  Description of Artificial Sequence: Synthetic peptide
  XENP019844 vlCDR1
RASQSVGSSYLA

SEQ ID NO: 1054 - protein, 7 aa, Artificial Sequence
  Description of Artificial Sequence: Synthetic peptide
  XENP019844 vlCDR2
GAFSRAT

SEQ ID NO: 1055 - protein, 9 aa, Artificial Sequence
  Description of Artificial Sequence: Synthetic peptide
  XENP019844 vlCDR3
QQYGSSPWT

SEQ ID NO: 1056 - protein, 246 aa, Artificial Sequence
  Description of Artificial Sequence: Synthetic polypeptide
  XENP019845 [CTLA-4]_H0.97_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRTEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1057 - protein, 118 aa, Artificial Sequence
  Description of Artificial Sequence: Synthetic polypeptide
  VH of XENP019845
QVQLVESGGGVVQPGRSLRLSCAASGFTFSSYTMHWVRQAPGKGLEWVTFISYDGNNKYYADSVKGRFTISRDNSKNTLYLQMNSLRTEDTAIYYCARTGWLGPFDYWGQGTLVTVSS

SEQ ID NO: 1058 - protein, 108 aa, Artificial Sequence; identical to SEQ ID NO: 23
  Description of Artificial Sequence: Synthetic polypeptide
  VL of XENP019845

SEQ ID NO: 1059 - protein, 5 aa, Artificial Sequence
  Description of Artificial Sequence: Synthetic peptide
  XENP019845 vhCDR1
SYTMH

SEQ ID NO: 1060 - protein, 17 aa, Artificial Sequence
  Description of Artificial Sequence: Synthetic peptide
  XENP019845 vhCDR2
FISYDGNNKYYADSVKG

SEQ ID NO: 1061 - protein, 9 aa, Artificial Sequence
  Description of Artificial Sequence: Synthetic peptide
  XENP019845 vhCDR3
TGWLGPFDY

SEQ ID NO: 1062 - protein, 12 aa, Artificial Sequence
  Description of Artificial Sequence: Synthetic peptide
  XENP019845 vlCDR1
RASQSVGSSYLA

SEQ ID NO: 1063 - protein, 7 aa, Artificial Sequence
  Description of Artificial Sequence: Synthetic peptide
  XENP019845 vlCDR2
GAFSRAT

SEQ ID NO: 1064 - protein, 9 aa, Artificial Sequence
  Description of Artificial Sequence: Synthetic peptide
  XENP019845 vlCDR3
QQYGSSPWT

SEQ ID NO: 1065 - protein, 246 aa, Artificial Sequence
  Description of Artificial Sequence: Synthetic polypeptide
  XENP019846 [CTLA-4]_H0.98_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTALYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1066 - protein, 118 aa, Artificial Sequence
  Description of Artificial Sequence: Synthetic polypeptide
  VH of XENP019846
QVQLVESGGGVVQPGRSLRLSCAASGFTFSSYTMHWVRQAPGKGLEWVTFISYDGNNKYYADSVKGRFTISRDNSKNTLYLQMNSLRAEDTALYYCARTGWLGPFDYWGQGTLVTVSS

SEQ ID NO: 1067 - protein, 108 aa, Artificial Sequence; identical to SEQ ID NO: 23
  Description of Artificial Sequence: Synthetic polypeptide
  VL of XENP019846

SEQ ID NO: 1068 - protein, 5 aa, Artificial Sequence
  Description of Artificial Sequence: Synthetic peptide
  XENP019846 vhCDR1
SYTMH

SEQ ID NO: 1069 - protein, 17 aa, Artificial Sequence
  Description of Artificial Sequence: Synthetic peptide
  XENP019846 vhCDR2
FISYDGNNKYYADSVKG

SEQ ID NO: 1070 - protein, 9 aa, Artificial Sequence
  Description of Artificial Sequence: Synthetic peptide
  XENP019846 vhCDR3
TGWLGPFDY

SEQ ID NO: 1071 - protein, 12 aa, Artificial Sequence
  Description of Artificial Sequence: Synthetic peptide
  XENP019846 vlCDR1
RASQSVGSSYLA

SEQ ID NO: 1072 - protein, 7 aa, Artificial Sequence
  Description of Artificial Sequence: Synthetic peptide
  XENP019846 vlCDR2
GAFSRAT

SEQ ID NO: 1073 - protein, 9 aa, Artificial Sequence
  Description of Artificial Sequence: Synthetic peptide
  XENP019846 vlCDR3
QQYGSSPWT

SEQ ID NO: 1074 - protein, 246 aa, Artificial Sequence
  Description of Artificial Sequence: Synthetic polypeptide
  XENP019847 [CTLA-4]_H0.99_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1075 - protein, 118 aa, Artificial Sequence
  Description of Artificial Sequence: Synthetic polypeptide
  VH of XENP019847
QVQLVESGGGVVQPGRSLRLSCAASGFTFSSYTMHWVRQAPGKGLEWVTFISYDGNNKYYADSVKGRFTISRDNSKNTLYLQMNSLRAEDTAVYYCARTGWLGPFDYWGQGTLVTVSS

SEQ ID NO: 1076 - protein, 108 aa, Artificial Sequence; identical to SEQ ID NO: 23
  Description of Artificial Sequence: Synthetic polypeptide
  VL of XENP019847

SEQ ID NO: 1077 - protein, 5 aa, Artificial Sequence
  Description of Artificial Sequence: Synthetic peptide
  XENP019847 vhCDR1
SYTMH

SEQ ID NO: 1078 - protein, 17 aa, Artificial Sequence
  Description of Artificial Sequence: Synthetic peptide
  XENP019847 vhCDR2
FISYDGNNKYYADSVKG

SEQ ID NO: 1079 - protein, 9 aa, Artificial Sequence
  Description of Artificial Sequence: Synthetic peptide
  XENP019847 vhCDR3
TGWLGPFDY

SEQ ID NO: 1080 - protein, 12 aa, Artificial Sequence
  Description of Artificial Sequence: Synthetic peptide
  XENP019847 vlCDR1
RASQSVGSSYLA

SEQ ID NO: 1081 - protein, 7 aa, Artificial Sequence
  Description of Artificial Sequence: Synthetic peptide
  XENP019847 vlCDR2
GAFSRAT

SEQ ID NO: 1082 - protein, 9 aa, Artificial Sequence
  Description of Artificial Sequence: Synthetic peptide
  XENP019847 vlCDR3
QQYGSSPWT

SEQ ID NO: 1083 - protein, 246 aa, Artificial Sequence
  Description of Artificial Sequence: Synthetic polypeptide
  XENP019848 [CTLA-4]_H0.100_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCTRTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1084 - protein, 118 aa, Artificial Sequence
  Description of Artificial Sequence: Synthetic polypeptide
  VH of XENP019848
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCTRTGWLGPFDYWGQGTLVTVSS

SEQ ID NO: 1085 - protein, 108 aa, Artificial Sequence; identical to SEQ ID NO: 23
  Description of Artificial Sequence: Synthetic polypeptide
  VL of XENP019848

SEQ ID NO: 1086 - protein, 5 aa, Artificial Sequence
  Description of Artificial Sequence: Synthetic peptide
  XENP019848 vhCDR1
SYTMH

SEQ ID NO: 1087 - protein, 17 aa, Artificial Sequence
  Description of Artificial Sequence: Synthetic peptide
  XENP019848 vhCDR2
FISYDGNNKYYADSVKG

SEQ ID NO: 1088 - protein, 9 aa, Artificial Sequence
  Description of Artificial Sequence: Synthetic peptide
  XENP019848 vhCDR3
TGWLGPFDY

SEQ ID NO: 1089 - protein, 12 aa, Artificial Sequence
  Description of Artificial Sequence: Synthetic peptide
  XENP019848 vlCDR1
RASQSVGSSYLA

SEQ ID NO: 1090 - protein, 7 aa, Artificial Sequence
  Description of Artificial Sequence: Synthetic peptide
  XENP019848 vlCDR2
GAFSRAT

SEQ ID NO: 1091 - protein, 9 aa, Artificial Sequence
  Description of Artificial Sequence: Synthetic peptide
  XENP019848 vlCDR3
QQYGSSPWT

SEQ ID NO: 1092 - protein, 246 aa, Artificial Sequence
  Description of Artificial Sequence: Synthetic polypeptide
  XENP019849 [CTLA-4]_H0.101_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCAKTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1093 - protein, 118 aa, Artificial Sequence
  Description of Artificial Sequence: Synthetic polypeptide
  VH of XENP019849
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCAKTGWLGPFDYWGQGTLVTVSS

SEQ ID NO: 1094 - protein, 108 aa, Artificial Sequence; identical to SEQ ID NO: 23
  Description of Artificial Sequence: Synthetic polypeptide
  VL of XENP019849

SEQ ID NO: 1095 - protein, 5 aa, Artificial Sequence
  Description of Artificial Sequence: Synthetic peptide
  XENP019849 vhCDR1
SYTMH

SEQ ID NO: 1096 - protein, 17 aa, Artificial Sequence
  Description of Artificial Sequence: Synthetic peptide
  XENP019849 vhCDR2
FISYDGNNKYYADSVKG

SEQ ID NO: 1097 - protein, 9 aa, Artificial Sequence
  Description of Artificial Sequence: Synthetic peptide
  XENP019849 vhCDR3
TGWLGPFDY

SEQ ID NO: 1098 - protein, 12 aa, Artificial Sequence
  Description of Artificial Sequence: Synthetic peptide
  XENP019849 vlCDR1
RASQSVGSSYLA

SEQ ID NO: 1099 - protein, 7 aa, Artificial Sequence
  Description of Artificial Sequence: Synthetic peptide
  XENP019849 vlCDR2
GAFSRAT

SEQ ID NO: 1100 - protein, 9 aa, Artificial Sequence
  Description of Artificial Sequence: Synthetic peptide
  XENP019849 vlCDR3
QQYGSSPWT

SEQ ID NO: 1101 - protein, 246 aa, Artificial Sequence
  Description of Artificial Sequence: Synthetic polypeptide
  XENP019850 [CTLA-4]_H0.102_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARAGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1102 - protein, 118 aa, Artificial Sequence
  Description of Artificial Sequence: Synthetic polypeptide
  VH of XENP019850
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARAGWLGPFDYWGQGTLVTVSS

SEQ ID NO: 1103 - protein, 108 aa, Artificial Sequence; identical to SEQ ID NO: 23
  Description of Artificial Sequence: Synthetic polypeptide
  VL of XENP019850

SEQ ID NO: 1104 - protein, 5 aa, Artificial Sequence
  Description of Artificial Sequence: Synthetic peptide
  XENP019850 vhCDR1
SYTMH

SEQ ID NO: 1105 - protein, 17 aa, Artificial Sequence
  Description of Artificial Sequence: Synthetic peptide
  XENP019850 vhCDR2
FISYDGNNKYYADSVKG

SEQ ID NO: 1106 - protein, 9 aa, Artificial Sequence
  Description of Artificial Sequence: Synthetic peptide
  XENP019850 vhCDR3
AGWLGPFDY

SEQ ID NO: 1107 - protein, 12 aa, Artificial Sequence
  Description of Artificial Sequence: Synthetic peptide
  XENP019850 vlCDR1
RASQSVGSSYLA

SEQ ID NO: 1108 - protein, 7 aa, Artificial Sequence
  Description of Artificial Sequence: Synthetic peptide
  XENP019850 vlCDR2
GAFSRAT

SEQ ID NO: 1109 - protein, 9 aa, Artificial Sequence
  Description of Artificial Sequence: Synthetic peptide
  XENP019850 vlCDR3
QQYGSSPWT

SEQ ID NO: 1110 - protein, 246 aa, Artificial Sequence
  Description of Artificial Sequence: Synthetic polypeptide
  XENP019851 [CTLA-4]_H0.103_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARGGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1111 - protein, 118 aa, Artificial Sequence
  Description of Artificial Sequence: Synthetic polypeptide
  VH of XENP019851
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARGGWLGPFDYWGQGTLVTVSS

SEQ ID NO: 1112 - protein, 108 aa, Artificial Sequence; identical to SEQ ID NO: 23
  Description of Artificial Sequence: Synthetic polypeptide
  VL of XENP019851

SEQ ID NO: 1113 - protein, 5 aa, Artificial Sequence
  Description of Artificial Sequence: Synthetic peptide
  XENP019851 vhCDR1
SYTMH

SEQ ID NO: 1114 - protein, 17 aa, Artificial Sequence
  Description of Artificial Sequence: Synthetic peptide
  XENP019851 vhCDR2
FISYDGNNKYYADSVKG

SEQ ID NO: 1115 - protein, 9 aa, Artificial Sequence
  Description of Artificial Sequence: Synthetic peptide
  XENP019851 vhCDR3
GGWLGPFDY

SEQ ID NO: 1116 - protein, 12 aa, Artificial Sequence
  Description of Artificial Sequence: Synthetic peptide
  XENP019851 vlCDR1
RASQSVGSSYLA

SEQ ID NO: 1117 - protein, 7 aa, Artificial Sequence
  Description of Artificial Sequence: Synthetic peptide
  XENP019851 vlCDR2
GAFSRAT

SEQ ID NO: 1118 - protein, 9 aa, Artificial Sequence
  Description of Artificial Sequence: Synthetic peptide
  XENP019851 vlCDR3
QQYGSSPWT

SEQ ID NO: 1119 - protein, 246 aa, Artificial Sequence
  Description of Artificial Sequence: Synthetic polypeptide
  XENP019852 [CTLA-4]_H0.104_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARDGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1120 - protein, 118 aa, Artificial Sequence
  Description of Artificial Sequence: Synthetic polypeptide
  VH of XENP019852
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARDGWLGPFDYWGQGTLVTVSS

SEQ ID NO: 1121 - protein, 108 aa, Artificial Sequence; identical to SEQ ID NO: 23
  Description of Artificial Sequence: Synthetic polypeptide
  VL of XENP019852

SEQ ID NO: 1122 - protein, 5 aa, Artificial Sequence
  Description of Artificial Sequence: Synthetic peptide
  XENP019852 vhCDR1
SYTMH

SEQ ID NO: 1123 - protein, 17 aa, Artificial Sequence
  Description of Artificial Sequence: Synthetic peptide
  XENP019852 vhCDR2
FISYDGNNKYYADSVKG

SEQ ID NO: 1124 - protein, 9 aa, Artificial Sequence
  Description of Artificial Sequence: Synthetic peptide
  XENP019852 vhCDR3
DGWLGPFDY

SEQ ID NO: 1125 - protein, 12 aa, Artificial Sequence
  Description of Artificial Sequence: Synthetic peptide
  XENP019852 vlCDR1
RASQSVGSSYLA

SEQ ID NO: 1126 - protein, 7 aa, Artificial Sequence
  Description of Artificial Sequence: Synthetic peptide
  XENP019852 vlCDR2
GAFSRAT

SEQ ID NO: 1127 - protein, 9 aa, Artificial Sequence
  Description of Artificial Sequence: Synthetic peptide
  XENP019852 vlCDR3
QQYGSSPWT

SEQ ID NO: 1128 - protein, 246 aa, Artificial Sequence
  Description of Artificial Sequence: Synthetic polypeptide
  XENP019853 [CTLA-4]_H0.105_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARSGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1129 - protein, 118 aa, Artificial Sequence
  Description of Artificial Sequence: Synthetic polypeptide
  VH of XENP019853
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARSGWLGPFDYWGQGTLVTVSS

SEQ ID NO: 1130 - protein, 108 aa, Artificial Sequence; identical to SEQ ID NO: 23
  Description of Artificial Sequence: Synthetic polypeptide
  VL of XENP019853

SEQ ID NO: 1131 - protein, 5 aa, Artificial Sequence
  Description of Artificial Sequence: Synthetic peptide
  XENP019853 vhCDR1
SYTMH

SEQ ID NO: 1132 - protein, 17 aa, Artificial Sequence
  Description of Artificial Sequence: Synthetic peptide
  XENP019853 vhCDR2
FISYDGNNKYYADSVKG

SEQ ID NO: 1133 - protein, 9 aa, Artificial Sequence
  Description of Artificial Sequence: Synthetic peptide
  XENP019853 vhCDR3
SGWLGPFDY

SEQ ID NO: 1134 - protein, 12 aa, Artificial Sequence
  Description of Artificial Sequence: Synthetic peptide
  XENP019853 vlCDR1
RASQSVGSSYLA

SEQ ID NO: 1135 - protein, 7 aa, Artificial Sequence
  Description of Artificial Sequence: Synthetic peptide
  XENP019853 vlCDR2
GAFSRAT

SEQ ID NO: 1136 - protein, 9 aa, Artificial Sequence
  Description of Artificial Sequence: Synthetic peptide
  XENP019853 vlCDR3
QQYGSSPWT

SEQ ID NO: 1137 - protein, 246 aa, Artificial Sequence
  Description of Artificial Sequence: Synthetic polypeptide
  XENP019854 [CTLA-4]_H0.106_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARVGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1138 - protein, 118 aa, Artificial Sequence
  Description of Artificial Sequence: Synthetic polypeptide
  VH of XENP019854
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARVGWLGPFDYWGQGTLVTVSS

SEQ ID NO: 1139 - protein, 108 aa, Artificial Sequence; identical to SEQ ID NO: 23
  Description of Artificial Sequence: Synthetic polypeptide
  VL of XENP019854

SEQ ID NO: 1140 - protein, 5 aa, Artificial Sequence
  Description of Artificial Sequence: Synthetic peptide
  XENP019854 vhCDR1
SYTMH

SEQ ID NO: 1141 - protein, 17 aa, Artificial Sequence
  Description of Artificial Sequence: Synthetic peptide
  XENP019854 vhCDR2
FISYDGNNKYYADSVKG

SEQ ID NO: 1142 - protein, 9 aa, Artificial Sequence
  Description of Artificial Sequence: Synthetic peptide
  XENP019854 vhCDR3
VGWLGPFDY

SEQ ID NO: 1143 - protein, 12 aa, Artificial Sequence
  Description of Artificial Sequence: Synthetic peptide
  XENP019854 vlCDR1
RASQSVGSSYLA

SEQ ID NO: 1144 - protein, 7 aa, Artificial Sequence
  Description of Artificial Sequence: Synthetic peptide
  XENP019854 vlCDR2
GAFSRAT

SEQ ID NO: 1145 - protein, 9 aa, Artificial Sequence
  Description of Artificial Sequence: Synthetic peptide
  XENP019854 vlCDR3
QQYGSSPWT

SEQ ID NO: 1146 - protein, 246 aa, Artificial Sequence
  Description of Artificial Sequence: Synthetic polypeptide
  XENP019855 [CTLA-4]_H0.107_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARYGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1147 - protein, 118 aa, Artificial Sequence
  Description of Artificial Sequence: Synthetic polypeptide
  VH of XENP019855
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARYGWLGPFDYWGQGTLVTVSS

SEQ ID NO: 1148 - protein, 108 aa, Artificial Sequence; identical to SEQ ID NO: 23
  Description of Artificial Sequence: Synthetic polypeptide
  VL of XENP019855

SEQ ID NO: 1149 - protein, 5 aa, Artificial Sequence
  Description of Artificial Sequence: Synthetic peptide
  XENP019855 vhCDR1
SYTMH

SEQ ID NO: 1150 - protein, 17 aa, Artificial Sequence
  Description of Artificial Sequence: Synthetic peptide
  XENP019855 vhCDR2
FISYDGNNKYYADSVKG

SEQ ID NO: 1151 - protein, 9 aa, Artificial Sequence
  Description of Artificial Sequence: Synthetic peptide
  XENP019855 vhCDR3
YGWLGPFDY

SEQ ID NO: 1152 - protein, 12 aa, Artificial Sequence
  Description of Artificial Sequence: Synthetic peptide
  XENP019855 vlCDR1
RASQSVGSSYLA

SEQ ID NO: 1153 - protein, 7 aa, Artificial Sequence
  Description of Artificial Sequence: Synthetic peptide
  XENP019855 vlCDR2
GAFSRAT

SEQ ID NO: 1154 - protein, 9 aa, Artificial Sequence
  Description of Artificial Sequence: Synthetic peptide
  XENP019855 vlCDR3
QQYGSSPWT

SEQ ID NO: 1155 - protein, 246 aa, Artificial Sequence
  Description of Artificial Sequence: Synthetic polypeptide
  XENP019856 [CTLA-4]_H0.108_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTAWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1156 - protein, 118 aa, Artificial Sequence
  Description of Artificial Sequence: Synthetic polypeptide
  VH of XENP019856
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTAWLGPFDYWGQGTLVTVSS

SEQ ID NO: 1157 - protein, 108 aa, Artificial Sequence; identical to SEQ ID NO: 23
  Description of Artificial Sequence: Synthetic polypeptide
  VL of XENP019856

SEQ ID NO: 1158 - protein, 5 aa, Artificial Sequence
  Description of Artificial Sequence: Synthetic peptide
  XENP019856 vhCDR1
SYTMH

SEQ ID NO: 1159 - protein, 17 aa, Artificial Sequence
  Description of Artificial Sequence: Synthetic peptide
  XENP019856 vhCDR2
FISYDGNNKYYADSVKG

SEQ ID NO: 1160 - protein, 9 aa, Artificial Sequence
  Description of Artificial Sequence: Synthetic peptide
  XENP019856 vhCDR3
TAWLGPFDY

SEQ ID NO: 1161 - protein, 12 aa, Artificial Sequence
  Description of Artificial Sequence: Synthetic peptide
  XENP019856 vlCDR1
RASQSVGSSYLA

SEQ ID NO: 1162 - protein, 7 aa, Artificial Sequence
  Description of Artificial Sequence: Synthetic peptide
  XENP019856 vlCDR2
GAFSRAT

SEQ ID NO: 1163 - protein, 9 aa, Artificial Sequence
  Description of Artificial Sequence: Synthetic peptide
  XENP019856 vlCDR3
QQYGSSPWT

SEQ ID NO: 1164 - protein, 246 aa, Artificial Sequence
  Description of Artificial Sequence: Synthetic polypeptide
  XENP019857 [CTLA-4]_H0.109_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTSWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1165 - protein, 118 aa, Artificial Sequence
  Description of Artificial Sequence: Synthetic polypeptide
  VH of XENP019857
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTSWLGPFDYWGQGTLVTVSS

SEQ ID NO: 1166 - protein, 108 aa, Artificial Sequence; identical to SEQ ID NO: 23
  Description of Artificial Sequence: Synthetic polypeptide
  VL of XENP019857

SEQ ID NO: 1167 - protein, 5 aa, Artificial Sequence
  Description of Artificial Sequence: Synthetic peptide
  XENP019857 vhCDR1
SYTMH

SEQ ID NO: 1168 - protein, 17 aa, Artificial Sequence
  Description of Artificial Sequence: Synthetic peptide
  XENP019857 vhCDR2
FISYDGNNKYYADSVKG

SEQ ID NO: 1169 - protein, 9 aa, Artificial Sequence
  Description of Artificial Sequence: Synthetic peptide
  XENP019857 vhCDR3
TSWLGPFDY

SEQ ID NO: 1170 - protein, 12 aa, Artificial Sequence
  Description of Artificial Sequence: Synthetic peptide
  XENP019857 vlCDR1
RASQSVGSSYLA

SEQ ID NO: 1171 - protein, 7 aa, Artificial Sequence
  Description of Artificial Sequence: Synthetic peptide
  XENP019857 vlCDR2
GAFSRAT

SEQ ID NO: 1172 - protein, 9 aa, Artificial Sequence
  Description of Artificial Sequence: Synthetic peptide
  XENP019857 vlCDR3
QQYGSSPWT

SEQ ID NO: 1173 - protein, 246 aa, Artificial Sequence
  Description of Artificial Sequence: Synthetic polypeptide
  XENP019858 [CTLA-4]_H0.110_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTTWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1174 - protein, 118 aa, Artificial Sequence
  Description of Artificial Sequence: Synthetic polypeptide
  VH of XENP019858
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTTWLGPFDYWGQGTLVTVSS

SEQ ID NO: 1175 - protein, 108 aa, Artificial Sequence; identical to SEQ ID NO: 23
  Description of Artificial Sequence: Synthetic polypeptide
  VL of XENP019858

SEQ ID NO: 1176 - protein, 5 aa, Artificial Sequence
  Description of Artificial Sequence: Synthetic peptide
  XENP019858 vhCDR1
SYTMH

SEQ ID NO: 1177 - protein, 17 aa, Artificial Sequence
  Description of Artificial Sequence: Synthetic peptide
  XENP019858 vhCDR2
FISYDGNNKYYADSVKG

SEQ ID NO: 1178 - protein, 9 aa, Artificial Sequence
  Description of Artificial Sequence: Synthetic peptide
  XENP019858 vhCDR3
TTWLGPFDY

SEQ ID NO: 1179 - protein, 12 aa, Artificial Sequence
  Description of Artificial Sequence: Synthetic peptide
  XENP019858 vlCDR1
RASQSVGSSYLA

SEQ ID NO: 1180 - protein, 7 aa, Artificial Sequence
  Description of Artificial Sequence: Synthetic peptide
  XENP019858 vlCDR2
GAFSRAT

SEQ ID NO: 1181 - protein, 9 aa, Artificial Sequence
  Description of Artificial Sequence: Synthetic peptide
  XENP019858 vlCDR3
QQYGSSPWT

SEQ ID NO: 1182 - protein, 246 aa, Artificial Sequence
  Description of Artificial Sequence: Synthetic polypeptide
  XENP019859 [CTLA-4]_H0.111_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGFLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1183 - protein, 118 aa, Artificial Sequence
  Description of Artificial Sequence: Synthetic polypeptide
  VH of XENP019859
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGFLGPFDYWGQGTLVTVSS

SEQ ID NO: 1184 - protein, 108 aa, Artificial Sequence; identical to SEQ ID NO: 23
  Description of Artificial Sequence: Synthetic polypeptide
  VL of XENP019859

SEQ ID NO: 1185 - protein, 5 aa, Artificial Sequence
  Description of Artificial Sequence: Synthetic peptide
  XENP019859 vhCDR1
SYTMH

SEQ ID NO: 1186 - protein, 17 aa, Artificial Sequence
  Description of Artificial Sequence: Synthetic peptide
  XENP019859 vhCDR2
FISYDGNNKYYADSVKG

SEQ ID NO: 1187 - protein, 9 aa, Artificial Sequence
  Description of Artificial Sequence: Synthetic peptide
  XENP019859 vhCDR3
TGFLGPFDY

SEQ ID NO: 1188 - protein, 12 aa, Artificial Sequence
  Description of Artificial Sequence: Synthetic peptide
  XENP019859 vlCDR1
RASQSVGSSYLA

SEQ ID NO: 1189 - protein, 7 aa, Artificial Sequence
  Description of Artificial Sequence: Synthetic peptide
  XENP019859 vlCDR2
GAFSRAT

SEQ ID NO: 1190 - protein, 9 aa, Artificial Sequence
  Description of Artificial Sequence: Synthetic peptide
  XENP019859 vlCDR3
QQYGSSPWT

SEQ ID NO: 1191 - protein, 246 aa, Artificial Sequence
  Description of Artificial Sequence: Synthetic polypeptide
  XENP019860 [CTLA-4]_H0.112_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGGLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1192 - protein, 118 aa, Artificial Sequence
  Description of Artificial Sequence: Synthetic polypeptide
  VH of XENP019860
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGGLGPFDYWGQGTLVTVSS

SEQ ID NO: 1193 - protein, 108 aa, Artificial Sequence; identical to SEQ ID NO: 23
  Description of Artificial Sequence: Synthetic polypeptide
  VL of XENP019860

SEQ ID NO: 1194 - protein, 5 aa, Artificial Sequence
  Description of Artificial Sequence: Synthetic peptide
  XENP019860 vhCDR1
SYTMH

SEQ ID NO: 1195 - protein, 17 aa, Artificial Sequence
  Description of Artificial Sequence: Synthetic peptide
  XENP019860 vhCDR2
FISYDGNNKYYADSVKG

SEQ ID NO: 1196 - protein, 9 aa, Artificial Sequence
  Description of Artificial Sequence: Synthetic peptide
  XENP019860 vhCDR3
TGGLGPFDY

SEQ ID NO: 1197 - protein, 12 aa, Artificial Sequence
  Description of Artificial Sequence: Synthetic peptide
  XENP019860 vlCDR1
RASQSVGSSYLA

SEQ ID NO: 1198 - protein, 7 aa, Artificial Sequence
  Description of Artificial Sequence: Synthetic peptide
  XENP019860 vlCDR2
GAFSRAT

SEQ ID NO: 1199 - protein, 9 aa, Artificial Sequence
  Description of Artificial Sequence: Synthetic peptide
  XENP019860 vlCDR3
QQYGSSPWT

SEQ ID NO: 1200 - protein, 246 aa, Artificial Sequence
  Description of Artificial Sequence: Synthetic polypeptide
  XENP019861 [CTLA-4]_H0.113_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGHLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1201 - protein, 118 aa, Artificial Sequence
  Description of Artificial Sequence: Synthetic polypeptide
  VH of XENP019861
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGHLGPFDYWGQGTLVTVSS

SEQ ID NO: 1202 - protein, 108 aa, Artificial Sequence; identical to SEQ ID NO: 23
  Description of Artificial Sequence: Synthetic polypeptide
  VL of XENP019861

SEQ ID NO: 1203 - protein, 5 aa, Artificial Sequence
  Description of Artificial Sequence: Synthetic peptide
  XENP019861 vhCDR1
SYTMH

SEQ ID NO: 1204 - protein, 17 aa, Artificial Sequence
  Description of Artificial Sequence: Synthetic peptide
  XENP019861 vhCDR2
FISYDGNNKYYADSVKG

SEQ ID NO: 1205 - protein, 9 aa, Artificial Sequence
  Description of Artificial Sequence: Synthetic peptide
  XENP019861 vhCDR3
TGHLGPFDY

SEQ ID NO: 1206 - protein, 12 aa, Artificial Sequence
  Description of Artificial Sequence: Synthetic peptide
  XENP019861 vlCDR1
RASQSVGSSYLA

SEQ ID NO: 1207 - protein, 7 aa, Artificial Sequence
  Description of Artificial Sequence: Synthetic peptide
  XENP019861 vlCDR2
GAFSRAT

SEQ ID NO: 1208 - protein, 9 aa, Artificial Sequence
  Description of Artificial Sequence: Synthetic peptide
  XENP019861 vlCDR3
QQYGSSPWT

SEQ ID NO: 1209 - protein, 246 aa, Artificial Sequence
  Description of Artificial Sequence: Synthetic polypeptide
  XENP019862 [CTLA-4]_H0.114_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGLLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1210 - protein, 118 aa, Artificial Sequence
  Description of Artificial Sequence: Synthetic polypeptide
  VH of XENP019862
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGLLGPFDYWGQGTLVTVSS

SEQ ID NO: 1211 - protein, 108 aa, Artificial Sequence; identical to SEQ ID NO: 23
  Description of Artificial Sequence: Synthetic polypeptide
  VL of XENP019862

SEQ ID NO: 1212 - protein, 5 aa, Artificial Sequence
  Description of Artificial Sequence: Synthetic peptide
  XENP019862 vhCDR1
SYTMH

SEQ ID NO: 1213 - protein, 17 aa, Artificial Sequence
  Description of Artificial Sequence: Synthetic peptide
  XENP019862 vhCDR2
FISYDGNNKYYADSVKG

SEQ ID NO: 1214 - protein, 9 aa, Artificial Sequence
  Description of Artificial Sequence: Synthetic peptide
  XENP019862 vhCDR3
TGLLGPFDY

SEQ ID NO: 1215 - protein, 12 aa, Artificial Sequence
  Description of Artificial Sequence: Synthetic peptide
  XENP019862 vlCDR1
RASQSVGSSYLA

SEQ ID NO: 1216 - protein, 7 aa, Artificial Sequence
  Description of Artificial Sequence: Synthetic peptide
  XENP019862 vlCDR2
GAFSRAT

SEQ ID NO: 1217 - protein, 9 aa, Artificial Sequence
  Description of Artificial Sequence: Synthetic peptide
  XENP019862 vlCDR3
QQYGSSPWT

SEQ ID NO: 1218 - protein, 246 aa, Artificial Sequence
  Description of Artificial Sequence: Synthetic polypeptide
  XENP019863 [CTLA-4]_H0.115_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGYLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1219 - protein, 118 aa, Artificial Sequence
  Description of Artificial Sequence: Synthetic polypeptide
  VH of XENP019863
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGYLGPFDYWGQGTLVTVSS

SEQ ID NO: 1220 - protein, 108 aa, Artificial Sequence; identical to SEQ ID NO: 23
  Description of Artificial Sequence: Synthetic polypeptide
  VL of XENP019863

SEQ ID NO: 1221 - protein, 5 aa, Artificial Sequence
  Description of Artificial Sequence: Synthetic peptide
  XENP019863 vhCDR1
SYTMH

SEQ ID NO: 1222 - protein, 17 aa, Artificial Sequence
  Description of Artificial Sequence: Synthetic peptide
  XENP019863 vhCDR2
FISYDGNNKYYADSVKG

SEQ ID NO: 1223 - protein, 9 aa, Artificial Sequence
  Description of Artificial Sequence: Synthetic peptide
  XENP019863 vhCDR3
TGYLGPFDY

SEQ ID NO: 1224 - protein, 12 aa, Artificial Sequence
  Description of Artificial Sequence: Synthetic peptide
  XENP019863 vlCDR1
RASQSVGSSYLA

SEQ ID NO: 1225 - protein, 7 aa, Artificial Sequence
  Description of Artificial Sequence: Synthetic peptide
  XENP019863 vlCDR2
GAFSRAT

SEQ ID NO: 1226 - protein, 9 aa, Artificial Sequence
  Description of Artificial Sequence: Synthetic peptide
  XENP019863 vlCDR3
QQYGSSPWT

SEQ ID NO: 1227 - protein, 246 aa, Artificial Sequence
  Description of Artificial Sequence: Synthetic polypeptide
  XENP019864 [CTLA-4]_H0.116_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWDGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1228 - protein, 118 aa, Artificial Sequence
  Description of Artificial Sequence: Synthetic polypeptide
  VH of XENP019864
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWDGPFDYWGQGTLVTVSS

SEQ ID NO: 1229 - protein, 108 aa, Artificial Sequence; identical to SEQ ID NO: 23
  Description of Artificial Sequence: Synthetic polypeptide
  VL of XENP019864

SEQ ID NO: 1230 - protein, 5 aa, Artificial Sequence
  Description of Artificial Sequence: Synthetic peptide
  XENP019864 vhCDR1
SYTMH

SEQ ID NO: 1231 - protein, 17 aa, Artificial Sequence
  Description of Artificial Sequence: Synthetic peptide
  XENP019864 vhCDR2
FISYDGNNKYYADSVKG

SEQ ID NO: 1232 - protein, 9 aa, Artificial Sequence
  Description of Artificial Sequence: Synthetic peptide
  XENP019864 vhCDR3
TGWDGPFDY

SEQ ID NO: 1233 - protein, 12 aa, Artificial Sequence
  Description of Artificial Sequence: Synthetic peptide
  XENP019864 vlCDR1
RASQSVGSSYLA

SEQ ID NO: 1234 - protein, 7 aa, Artificial Sequence
  Description of Artificial Sequence: Synthetic peptide
  XENP019864 vlCDR2
GAFSRAT

SEQ ID NO: 1235 - protein, 9 aa, Artificial Sequence
  Description of Artificial Sequence: Synthetic peptide
  XENP019864 vlCDR3
QQYGSSPWT

SEQ ID NO: 1236 - protein, 246 aa, Artificial Sequence
  Description of Artificial Sequence: Synthetic polypeptide
  XENP019865 [CTLA-4]_H0.117_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWIGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1237 - protein, 118 aa, Artificial Sequence
  Description of Artificial Sequence: Synthetic polypeptide
  VH of XENP019865
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWIGPFDYWGQGTLVTVSS

SEQ ID NO: 1238 - protein, 108 aa, Artificial Sequence; identical to SEQ ID NO: 23
  Description of Artificial Sequence: Synthetic polypeptide
  VL of XENP019865

SEQ ID NO: 1239 - protein, 5 aa, Artificial Sequence
  Description of Artificial Sequence: Synthetic peptide
  XENP019865 vhCDR1
SYTMH

SEQ ID NO: 1240 - protein, 17 aa, Artificial Sequence
  Description of Artificial Sequence: Synthetic peptide
  XENP019865 vhCDR2
FISYDGNNKYYADSVKG

SEQ ID NO: 1241 - protein, 9 aa, Artificial Sequence
  Description of Artificial Sequence: Synthetic peptide
  XENP019865 vhCDR3
TGWIGPFDY

SEQ ID NO: 1242 - protein, 12 aa, Artificial Sequence
  Description of Artificial Sequence: Synthetic peptide
  XENP019865 vlCDR1
RASQSVGSSYLA

SEQ ID NO: 1243 - protein, 7 aa, Artificial Sequence
  Description of Artificial Sequence: Synthetic peptide
  XENP019865 vlCDR2
GAFSRAT

SEQ ID NO: 1244 - protein, 9 aa, Artificial Sequence
  Description of Artificial Sequence: Synthetic peptide
  XENP019865 vlCDR3
QQYGSSPWT

SEQ ID NO: 1245 - protein, 246 aa, Artificial Sequence
  Description of Artificial Sequence: Synthetic polypeptide
  XENP019866 [CTLA-4]_H0.118_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWVGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1246 - protein, 118 aa, Artificial Sequence
  Description of Artificial Sequence: Synthetic polypeptide
  VH of XENP019866
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWVGPFDYWGQGTLVTVSS

SEQ ID NO: 1247 - protein, 108 aa, Artificial Sequence; identical to SEQ ID NO: 23
  Description of Artificial Sequence: Synthetic polypeptide
  VL of XENP019866

SEQ ID NO: 1248 - protein, 5 aa, Artificial Sequence
  Description of Artificial Sequence: Synthetic peptide
  XENP019866 vhCDR1
SYTMH

SEQ ID NO: 1249 - protein, 17 aa, Artificial Sequence
  Description of Artificial Sequence: Synthetic peptide
  XENP019866 vhCDR2
FISYDGNNKYYADSVKG

SEQ ID NO: 1250 - protein, 9 aa, Artificial Sequence
  Description of Artificial Sequence: Synthetic peptide
  XENP019866 vhCDR3
TGWVGPFDY

SEQ ID NO: 1251 - protein, 12 aa, Artificial Sequence
  Description of Artificial Sequence: Synthetic peptide
  XENP019866 vlCDR1
RASQSVGSSYLA

SEQ ID NO: 1252 - protein, 7 aa, Artificial Sequence
  Description of Artificial Sequence: Synthetic peptide
  XENP019866 vlCDR2
GAFSRAT

SEQ ID NO: 1253 - protein, 9 aa, Artificial Sequence
  Description of Artificial Sequence: Synthetic peptide
  XENP019866 vlCDR3
QQYGSSPWT

SEQ ID NO: 1254 - protein, 246 aa, Artificial Sequence
  Description of Artificial Sequence: Synthetic polypeptide
  XENP019867 [CTLA-4]_H0.119_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLAPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1255 - protein, 118 aa, Artificial Sequence
  Description of Artificial Sequence: Synthetic polypeptide
  VH of XENP019867
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLAPFDYWGQGTLVTVSS

SEQ ID NO: 1256 - protein, 108 aa, Artificial Sequence; identical to SEQ ID NO: 23
  Description of Artificial Sequence: Synthetic polypeptide
  VL of XENP019867

SEQ ID NO: 1257 - protein, 5 aa, Artificial Sequence
  Description of Artificial Sequence: Synthetic peptide
  XENP019867 vhCDR1
SYTMH

SEQ ID NO: 1258 - protein, 17 aa, Artificial Sequence
  Description of Artificial Sequence: Synthetic peptide
  XENP019867 vhCDR2
FISYDGNNKYYADSVKG

SEQ ID NO: 1259 - protein, 9 aa, Artificial Sequence
  Description of Artificial Sequence: Synthetic peptide
  XENP019867 vhCDR3
TGWLAPFDY

SEQ ID NO: 1260 - protein, 12 aa, Artificial Sequence
  Description of Artificial Sequence: Synthetic peptide
  XENP019867 vlCDR1
RASQSVGSSYLA

SEQ ID NO: 1261 - protein, 7 aa, Artificial Sequence
  Description of Artificial Sequence: Synthetic peptide
  XENP019867 vlCDR2
GAFSRAT

SEQ ID NO: 1262 - protein, 9 aa, Artificial Sequence
  Description of Artificial Sequence: Synthetic peptide
  XENP019867 vlCDR3
QQYGSSPWT

SEQ ID NO: 1263 - protein, 246 aa, Artificial Sequence
  Description of Artificial Sequence: Synthetic polypeptide
  XENP019868 [CTLA-4]_H0.120_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLSPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1264 - protein, 118 aa, Artificial Sequence
  Description of Artificial Sequence: Synthetic polypeptide
  VH of XENP019868
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLSPFDYWGQGTLVTVSS

SEQ ID NO: 1265 - protein, 108 aa, Artificial Sequence; identical to SEQ ID NO: 23
  Description of Artificial Sequence: Synthetic polypeptide
  VL of XENP019868

SEQ ID NO: 1266 - protein, 5 aa, Artificial Sequence
  Description of Artificial Sequence: Synthetic peptide
  XENP019868 vhCDR1
SYTMH

SEQ ID NO: 1267 - protein, 17 aa, Artificial Sequence
  Description of Artificial Sequence: Synthetic peptide
  XENP019868 vhCDR2
FISYDGNNKYYADSVKG

SEQ ID NO: 1268 - protein, 9 aa, Artificial Sequence
  Description of Artificial Sequence: Synthetic peptide
  XENP019868 vhCDR3
TGWLSPFDY

SEQ ID NO: 1269 - protein, 12 aa, Artificial Sequence
  Description of Artificial Sequence: Synthetic peptide
  XENP019868 vlCDR1
RASQSVGSSYLA

SEQ ID NO: 1270 - protein, 7 aa, Artificial Sequence
  Description of Artificial Sequence: Synthetic peptide
  XENP019868 vlCDR2
GAFSRAT

SEQ ID NO: 1271 - protein, 9 aa, Artificial Sequence
  Description of Artificial Sequence: Synthetic peptide
  XENP019868 vlCDR3
QQYGSSPWT

SEQ ID NO: 1272 - protein, 246 aa, Artificial Sequence
  Description of Artificial Sequence: Synthetic polypeptide
  XENP019869 [CTLA-4]_H0.121_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLTPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1273 - protein, 118 aa, Artificial Sequence
  Description of Artificial Sequence: Synthetic polypeptide
  VH of XENP019869
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLTPFDYWGQGTLVTVSS

SEQ ID NO: 1274 - protein, 108 aa, Artificial Sequence; identical to SEQ ID NO: 23
  Description of Artificial Sequence: Synthetic polypeptide
  VL of XENP019869

SEQ ID NO: 1275 - protein, 5 aa, Artificial Sequence
  Description of Artificial Sequence: Synthetic peptide
  XENP019869 vhCDR1
SYTMH

SEQ ID NO: 1276 - protein, 17 aa, Artificial Sequence
  Description of Artificial Sequence: Synthetic peptide
  XENP019869 vhCDR2
FISYDGNNKYYADSVKG

SEQ ID NO: 1277 - protein, 9 aa, Artificial Sequence
  Description of Artificial Sequence: Synthetic peptide
  XENP019869 vhCDR3
TGWLTPFDY

SEQ ID NO: 1278 - protein, 12 aa, Artificial Sequence
  Description of Artificial Sequence: Synthetic peptide
  XENP019869 vlCDR1
RASQSVGSSYLA

SEQ ID NO: 1279 - protein, 7 aa, Artificial Sequence
  Description of Artificial Sequence: Synthetic peptide
  XENP019869 vlCDR2
GAFSRAT

SEQ ID NO: 1280 - protein, 9 aa, Artificial Sequence
  Description of Artificial Sequence: Synthetic peptide
  XENP019869 vlCDR3
QQYGSSPWT

SEQ ID NO: 1281 - protein, 246 aa, Artificial Sequence
  Description of Artificial Sequence: Synthetic polypeptide
  XENP019870 [CTLA-4]_H0.122_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPLDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1282 - protein, 118 aa, Artificial Sequence
  Description of Artificial Sequence: Synthetic polypeptide
  VH of XENP019870
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPLDYWGQGTLVTVSS

SEQ ID NO: 1283 - protein, 108 aa, Artificial Sequence; identical to SEQ ID NO: 23
  Description of Artificial Sequence: Synthetic polypeptide
  VL of XENP019870

SEQ ID NO: 1284 - protein, 5 aa, Artificial Sequence
  Description of Artificial Sequence: Synthetic peptide
  XENP019870 vhCDR1
SYTMH

SEQ ID NO: 1285 - protein, 17 aa, Artificial Sequence
  Description of Artificial Sequence: Synthetic peptide
  XENP019870 vhCDR2
FISYDGNNKYYADSVKG

SEQ ID NO: 1286 - protein, 9 aa, Artificial Sequence
  Description of Artificial Sequence: Synthetic peptide
  XENP019870 vhCDR3
TGWLGPLDY

SEQ ID NO: 1287 - protein, 12 aa, Artificial Sequence
  Description of Artificial Sequence: Synthetic peptide
  XENP019870 vlCDR1
RASQSVGSSYLA

SEQ ID NO: 1288 - protein, 7 aa, Artificial Sequence
  Description of Artificial Sequence: Synthetic peptide
  XENP019870 vlCDR2
GAFSRAT

SEQ ID NO: 1289 - protein, 9 aa, Artificial Sequence
  Description of Artificial Sequence: Synthetic peptide
  XENP019870 vlCDR3
QQYGSSPWT

SEQ ID NO: 1290 - protein, 246 aa, Artificial Sequence
  Description of Artificial Sequence: Synthetic polypeptide
  XENP019871 [CTLA-4]_H0.123_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPMDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1291 - protein, 118 aa, Artificial Sequence
  Description of Artificial Sequence: Synthetic polypeptide
  VH of XENP019871
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPMDYWGQGTLVTVSS

SEQ ID NO: 1292 - protein, 108 aa, Artificial Sequence; identical to SEQ ID NO: 23
  Description of Artificial Sequence: Synthetic polypeptide
  VL of XENP019871

SEQ ID NO: 1293 - protein, 5 aa, Artificial Sequence
  Description of Artificial Sequence: Synthetic peptide
  XENP019871 vhCDR1
SYTMH

SEQ ID NO: 1294 - protein, 17 aa, Artificial Sequence
  Description of Artificial Sequence: Synthetic peptide
  XENP019871 vhCDR2
FISYDGNNKYYADSVKG

SEQ ID NO: 1295 - protein, 9 aa, Artificial Sequence
  Description of Artificial Sequence: Synthetic peptide
  XENP019871 vhCDR3
TGWLGPMDY

SEQ ID NO: 1296 - protein, 12 aa, Artificial Sequence
  Description of Artificial Sequence: Synthetic peptide
  XENP019871 vlCDR1
RASQSVGSSYLA

SEQ ID NO: 1297 - protein, 7 aa, Artificial Sequence
  Description of Artificial Sequence: Synthetic peptide
  XENP019871 vlCDR2
GAFSRAT

SEQ ID NO: 1298 - protein, 9 aa, Artificial Sequence
  Description of Artificial Sequence: Synthetic peptide
  XENP019871 vlCDR3
QQYGSSPWT

SEQ ID NO: 1299 - protein, 246 aa, Artificial Sequence
  Description of Artificial Sequence: Synthetic polypeptide
  XENP019872 [CTLA-4]_H0.124_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFAYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1300 - protein, 118 aa, Artificial Sequence
  Description of Artificial Sequence: Synthetic polypeptide
  VH of XENP019872
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFAYWGQGTLVTVSS

SEQ ID NO: 1301 - protein, 108 aa, Artificial Sequence; identical to SEQ ID NO: 23
  Description of Artificial Sequence: Synthetic polypeptide
  VL of XENP019872

SEQ ID NO: 1302 - protein, 5 aa, Artificial Sequence
  Description of Artificial Sequence: Synthetic peptide
  XENP019872 vhCDR1
SYTMH

SEQ ID NO: 1303 - protein, 17 aa, Artificial Sequence
  Description of Artificial Sequence: Synthetic peptide
  XENP019872 vhCDR2
FISYDGNNKYYADSVKG

SEQ ID NO: 1304 - protein, 9 aa, Artificial Sequence
  Description of Artificial Sequence: Synthetic peptide
  XENP019872 vhCDR3
TGWLGPFAY

SEQ ID NO: 1305 - protein, 12 aa, Artificial Sequence
  Description of Artificial Sequence: Synthetic peptide
  XENP019872 vlCDR1
RASQSVGSSYLA

SEQ ID NO: 1306 - protein, 7 aa, Artificial Sequence
  Description of Artificial Sequence: Synthetic peptide
  XENP019872 vlCDR2
GAFSRAT

SEQ ID NO: 1307 - protein, 9 aa, Artificial Sequence
  Description of Artificial Sequence: Synthetic peptide
  XENP019872 vlCDR3
QQYGSSPWT

SEQ ID NO: 1308 - protein, 246 aa, Artificial Sequence
  Description of Artificial Sequence: Synthetic polypeptide
  XENP019873 [CTLA-4]_H0.125_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFEYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1309 - protein, 118 aa, Artificial Sequence
  Description of Artificial Sequence: Synthetic polypeptide
  VH of XENP019873
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFEYWGQGTLVTVSS

SEQ ID NO: 1310 - protein, 108 aa, Artificial Sequence; identical to SEQ ID NO: 23
  Description of Artificial Sequence: Synthetic polypeptide
  VL of XENP019873

SEQ ID NO: 1311 - protein, 5 aa, Artificial Sequence
  Description of Artificial Sequence: Synthetic peptide
  XENP019873 vhCDR1
SYTMH

SEQ ID NO: 1312 - protein, 17 aa, Artificial Sequence
  Description of Artificial Sequence: Synthetic peptide
  XENP019873 vhCDR2
FISYDGNNKYYADSVKG

SEQ ID NO: 1313 - protein, 9 aa, Artificial Sequence
  Description of Artificial Sequence: Synthetic peptide
  XENP019873 vhCDR3
TGWLGPFEY

SEQ ID NO: 1314 - protein, 12 aa, Artificial Sequence
  Description of Artificial Sequence: Synthetic peptide
  XENP019873 vlCDR1
RASQSVGSSYLA

SEQ ID NO: 1315 - protein, 7 aa, Artificial Sequence
  Description of Artificial Sequence: Synthetic peptide
  XENP019873 vlCDR2
GAFSRAT

SEQ ID NO: 1316 - protein, 9 aa, Artificial Sequence
  Description of Artificial Sequence: Synthetic peptide
  XENP019873 vlCDR3
QQYGSSPWT

SEQ ID NO: 1317 - protein, 246 aa, Artificial Sequence
  Description of Artificial Sequence: Synthetic polypeptide
  XENP019874 [CTLA-4]_H0.126_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFHYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1318 - protein, 118 aa, Artificial Sequence
  Description of Artificial Sequence: Synthetic polypeptide
  VH of XENP019874
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFHYWGQGTLVTVSS

SEQ ID NO: 1319 - protein, 108 aa, Artificial Sequence; identical to SEQ ID NO: 23
  Description of Artificial Sequence: Synthetic polypeptide
  VL of XENP019874

SEQ ID NO: 1320 - protein, 5 aa, Artificial Sequence
  Description of Artificial Sequence: Synthetic peptide
  XENP019874 vhCDR1
SYTMH

SEQ ID NO: 1321 - protein, 17 aa, Artificial Sequence
  Description of Artificial Sequence: Synthetic peptide
  XENP019874 vhCDR2
FISYDGNNKYYADSVKG

SEQ ID NO: 1322 - protein, 9 aa, Artificial Sequence
  Description of Artificial Sequence: Synthetic peptide
  XENP019874 vhCDR3
TGWLGPFHY

SEQ ID NO: 1323 - protein, 12 aa, Artificial Sequence
  Description of Artificial Sequence: Synthetic peptide
  XENP019874 vlCDR1
RASQSVGSSYLA

SEQ ID NO: 1324 - protein, 7 aa, Artificial Sequence
  Description of Artificial Sequence: Synthetic peptide
  XENP019874 vlCDR2
GAFSRAT

SEQ ID NO: 1325 - protein, 9 aa, Artificial Sequence
  Description of Artificial Sequence: Synthetic peptide
  XENP019874 vlCDR3
QQYGSSPWT

SEQ ID NO: 1326 - protein, 246 aa, Artificial Sequence
  Description of Artificial Sequence: Synthetic polypeptide
  XENP019875 [CTLA-4]_H0.127_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFNYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1327 - protein, 118 aa, Artificial Sequence
  Description of Artificial Sequence: Synthetic polypeptide
  VH of XENP019875
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFNYWGQGTLVTVSS

SEQ ID NO: 1328 - protein, 108 aa, Artificial Sequence; identical to SEQ ID NO: 23
  Description of Artificial Sequence: Synthetic polypeptide
  VL of XENP019875

SEQ ID NO: 1329 - protein, 5 aa, Artificial Sequence
  Description of Artificial Sequence: Synthetic peptide
  XENP019875 vhCDR1
SYTMH

SEQ ID NO: 1330 - protein, 17 aa, Artificial Sequence
  Description of Artificial Sequence: Synthetic peptide
  XENP019875 vhCDR2
FISYDGNNKYYADSVKG

SEQ ID NO: 1331 - protein, 9 aa, Artificial Sequence
  Description of Artificial Sequence: Synthetic peptide
  XENP019875 vhCDR3
TGWLGPFNY

SEQ ID NO: 1332 - protein, 12 aa, Artificial Sequence
  Description of Artificial Sequence: Synthetic peptide
  XENP019875 vlCDR1
RASQSVGSSYLA

SEQ ID NO: 1333 - protein, 7 aa, Artificial Sequence
  Description of Artificial Sequence: Synthetic peptide
  XENP019875 vlCDR2
GAFSRAT

SEQ ID NO: 1334 - protein, 9 aa, Artificial Sequence
  Description of Artificial Sequence: Synthetic peptide
  XENP019875 vlCDR3
QQYGSSPWT

SEQ ID NO: 1335 - protein, 246 aa, Artificial Sequence
  Description of Artificial Sequence: Synthetic polypeptide
  XENP019876 [CTLA-4]_H0.128_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFSYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1336 - protein, 118 aa, Artificial Sequence
  Description of Artificial Sequence: Synthetic polypeptide
  VH of XENP019876
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFSYWGQGTLVTVSS

SEQ ID NO: 1337 - protein, 108 aa, Artificial Sequence; identical to SEQ ID NO: 23
  Description of Artificial Sequence: Synthetic polypeptide
  VL of XENP019876

SEQ ID NO: 1338 - protein, 5 aa, Artificial Sequence
  Description of Artificial Sequence: Synthetic peptide
  XENP019876 vhCDR1
SYTMH

SEQ ID NO: 1339 - protein, 17 aa, Artificial Sequence
  Description of Artificial Sequence: Synthetic peptide
  XENP019876 vhCDR2
FISYDGNNKYYADSVKG

SEQ ID NO: 1340 - protein, 9 aa, Artificial Sequence
  Description of Artificial Sequence: Synthetic peptide
  XENP019876 vhCDR3
TGWLGPFSY

SEQ ID NO: 1341 - protein, 12 aa, Artificial Sequence
  Description of Artificial Sequence: Synthetic peptide
  XENP019876 vlCDR1
RASQSVGSSYLA

SEQ ID NO: 1342 - protein, 7 aa, Artificial Sequence
  Description of Artificial Sequence: Synthetic peptide
  XENP019876 vlCDR2
GAFSRAT

SEQ ID NO: 1343 - protein, 9 aa, Artificial Sequence
  Description of Artificial Sequence: Synthetic peptide
  XENP019876 vlCDR3
QQYGSSPWT

SEQ ID NO: 1344 - protein, 246 aa, Artificial Sequence
  Description of Artificial Sequence: Synthetic polypeptide
  XENP019877 [CTLA-4]_H0.129_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFQYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1345 - protein, 118 aa, Artificial Sequence
  Description of Artificial Sequence: Synthetic polypeptide
  VH of XENP019877
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFQYWGQGTLVTVSS

SEQ ID NO: 1346 - protein, 108 aa, Artificial Sequence; identical to SEQ ID NO: 23
  Description of Artificial Sequence: Synthetic polypeptide
  VL of XENP019877

SEQ ID NO: 1347 - protein, 5 aa, Artificial Sequence
  Description of Artificial Sequence: Synthetic peptide
  XENP019877 vhCDR1
SYTMH

SEQ ID NO: 1348 - protein, 17 aa, Artificial Sequence
  Description of Artificial Sequence: Synthetic peptide
  XENP019877 vhCDR2
FISYDGNNKYYADSVKG

SEQ ID NO: 1349 - protein, 9 aa, Artificial Sequence
  Description of Artificial Sequence: Synthetic peptide
  XENP019877 vhCDR3
TGWLGPFQY

SEQ ID NO: 1350 - protein, 12 aa, Artificial Sequence
  Description of Artificial Sequence: Synthetic peptide
  XENP019877 vlCDR1
RASQSVGSSYLA

SEQ ID NO: 1351 - protein, 7 aa, Artificial Sequence
  Description of Artificial Sequence: Synthetic peptide
  XENP019877 vlCDR2
GAFSRAT

SEQ ID NO: 1352 - protein, 9 aa, Artificial Sequence
  Description of Artificial Sequence: Synthetic peptide
  XENP019877 vlCDR3
QQYGSSPWT

SEQ ID NO: 1353 - protein, 246 aa, Artificial Sequence
  Description of Artificial Sequence: Synthetic polypeptide
  XENP019878 [CTLA-4]_H0.130_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDHWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1354 - protein, 118 aa, Artificial Sequence
  Description of Artificial Sequence: Synthetic polypeptide
  VH of XENP019878
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDHWGQGTLVTVSS

SEQ ID NO: 1355 - protein, 108 aa, Artificial Sequence; identical to SEQ ID NO: 23
  Description of Artificial Sequence: Synthetic polypeptide
  VL of XENP019878

SEQ ID NO: 1356 - protein, 5 aa, Artificial Sequence
  Description of Artificial Sequence: Synthetic peptide
  XENP019878 vhCDR1
SYTMH

SEQ ID NO: 1357 - protein, 17 aa, Artificial Sequence
  Description of Artificial Sequence: Synthetic peptide
  XENP019878 vhCDR2
FISYDGNNKYYADSVKG

SEQ ID NO: 1358 - protein, 9 aa, Artificial Sequence
  Description of Artificial Sequence: Synthetic peptide
  XENP019878 vhCDR3
TGWLGPFDH

SEQ ID NO: 1359 - protein, 12 aa, Artificial Sequence
  Description of Artificial Sequence: Synthetic peptide
  XENP019878 vlCDR1
RASQSVGSSYLA

SEQ ID NO: 1360 - protein, 7 aa, Artificial Sequence
  Description of Artificial Sequence: Synthetic peptide
  XENP019878 vlCDR2
GAFSRAT

SEQ ID NO: 1361 - protein, 9 aa, Artificial Sequence
  Description of Artificial Sequence: Synthetic peptide
  XENP019878 vlCDR3
QQYGSSPWT

SEQ ID NO: 1362 - protein, 246 aa, Artificial Sequence
  Description of Artificial Sequence: Synthetic polypeptide
  XENP019879 [CTLA-4]_H0.131_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDLWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1363 - protein, 118 aa, Artificial Sequence
  Description of Artificial Sequence: Synthetic polypeptide
  VH of XENP019879
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDLWGQGTLVTVSS

SEQ ID NO: 1364 - protein, 108 aa, Artificial Sequence; identical to SEQ ID NO: 23
  Description of Artificial Sequence: Synthetic polypeptide
  VL of XENP019879

SEQ ID NO: 1365 - protein, 5 aa, Artificial Sequence
  Description of Artificial Sequence: Synthetic peptide
  XENP019879 vhCDR1
SYTMH

SEQ ID NO: 1366 - protein, 17 aa, Artificial Sequence
  Description of Artificial Sequence: Synthetic peptide
  XENP019879 vhCDR2
FISYDGNNKYYADSVKG

SEQ ID NO: 1367 - protein, 9 aa, Artificial Sequence
  Description of Artificial Sequence: Synthetic peptide
  XENP019879 vhCDR3
TGWLGPFDL

SEQ ID NO: 1368 - protein, 12 aa, Artificial Sequence
  Description of Artificial Sequence: Synthetic peptide
  XENP019879 vlCDR1
RASQSVGSSYLA

SEQ ID NO: 1369 - protein, 7 aa, Artificial Sequence
  Description of Artificial Sequence: Synthetic peptide
  XENP019879 vlCDR2
GAFSRAT

SEQ ID NO: 1370 - protein, 9 aa, Artificial Sequence
  Description of Artificial Sequence: Synthetic peptide
  XENP019879 vlCDR3
QQYGSSPWT

SEQ ID NO: 1371 - protein, 246 aa, Artificial Sequence
  Description of Artificial Sequence: Synthetic polypeptide
  XENP019880 [CTLA-4]_H0.132_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDSWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1372 - protein, 118 aa, Artificial Sequence
  Description of Artificial Sequence: Synthetic polypeptide
  VH of XENP019880
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDSWGQGTLVTVSS

SEQ ID NO: 1373 - protein, 108 aa, Artificial Sequence; identical to SEQ ID NO: 23
  Description of Artificial Sequence: Synthetic polypeptide
  VL of XENP019880

SEQ ID NO: 1374 - protein, 5 aa, Artificial Sequence
  Description of Artificial Sequence: Synthetic peptide
  XENP019880 vhCDR1
SYTMH

SEQ ID NO: 1375 - protein, 17 aa, Artificial Sequence
  Description of Artificial Sequence: Synthetic peptide
  XENP019880 vhCDR2
FISYDGNNKYYADSVKG

SEQ ID NO: 1376 - protein, 9 aa, Artificial Sequence
  Description of Artificial Sequence: Synthetic peptide
  XENP019880 vhCDR3
TGWLGPFDS

SEQ ID NO: 1377 - protein, 12 aa, Artificial Sequence
  Description of Artificial Sequence: Synthetic peptide
  XENP019880 vlCDR1
RASQSVGSSYLA

SEQ ID NO: 1378 - protein, 7 aa, Artificial Sequence
  Description of Artificial Sequence: Synthetic peptide
  XENP019880 vlCDR2
GAFSRAT

SEQ ID NO: 1379 - protein, 9 aa, Artificial Sequence
  Description of Artificial Sequence: Synthetic peptide
  XENP019880 vlCDR3
QQYGSSPWT

SEQ ID NO: 1380 - protein, 246 aa, Artificial Sequence
  Description of Artificial Sequence: Synthetic polypeptide
  XENP019881 [CTLA-4]_H0.133_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDVWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1381 - protein, 118 aa, Artificial Sequence
  Description of Artificial Sequence: Synthetic polypeptide
  VH of XENP019881
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDVWGQGTLVTVSS

SEQ ID NO: 1382 - protein, 108 aa, Artificial Sequence; identical to SEQ ID NO: 23
  Description of Artificial Sequence: Synthetic polypeptide
  VL of XENP019881

SEQ ID NO: 1383 - protein, 5 aa, Artificial Sequence
  Description of Artificial Sequence: Synthetic peptide
  XENP019881 vhCDR1
SYTMH

SEQ ID NO: 1384 - protein, 17 aa, Artificial Sequence
  Description of Artificial Sequence: Synthetic peptide
  XENP019881 vhCDR2
FISYDGNNKYYADSVKG

SEQ ID NO: 1385 - protein, 9 aa, Artificial Sequence
  Description of Artificial Sequence: Synthetic peptide
  XENP019881 vhCDR3
TGWLGPFDV

SEQ ID NO: 1386 - protein, 12 aa, Artificial Sequence
  Description of Artificial Sequence: Synthetic peptide
  XENP019881 vlCDR1
RASQSVGSSYLA

SEQ ID NO: 1387 - protein, 7 aa, Artificial Sequence
  Description of Artificial Sequence: Synthetic peptide
  XENP019881 vlCDR2
GAFSRAT

SEQ ID NO: 1388 - protein, 9 aa, Artificial Sequence
  Description of Artificial Sequence: Synthetic peptide
  XENP019881 vlCDR3
QQYGSSPWT

SEQ ID NO: 1389 - protein, 246 aa, Artificial Sequence
  Description of Artificial Sequence: Synthetic polypeptide
  XENP019882 [CTLA-4]_H0.134_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1390 - protein, 118 aa, Artificial Sequence; identical to SEQ ID NO: 67
  Description of Artificial Sequence: Synthetic polypeptide
  VH of XENP019882

SEQ ID NO: 1391 - protein, 108 aa, Artificial Sequence; identical to SEQ ID NO: 23
  Description of Artificial Sequence: Synthetic polypeptide
  VL of XENP019882

SEQ ID NO: 1392 - protein, 5 aa, Artificial Sequence
  Description of Artificial Sequence: Synthetic peptide
  XENP019882 vhCDR1
SYTMH

SEQ ID NO: 1393 - protein, 17 aa, Artificial Sequence
  Description of Artificial Sequence: Synthetic peptide
  XENP019882 vhCDR2
FISYDGNNKYYADSVKG

SEQ ID NO: 1394 - protein, 9 aa, Artificial Sequence
  Description of Artificial Sequence: Synthetic peptide
  XENP019882 vhCDR3
TGWLGPFDY

SEQ ID NO: 1395 - protein, 12 aa, Artificial Sequence
  Description of Artificial Sequence: Synthetic peptide
  XENP019882 vlCDR1
RASQSVGSSYLA

SEQ ID NO: 1396 - protein, 7 aa, Artificial Sequence
  Description of Artificial Sequence: Synthetic peptide
  XENP019882 vlCDR2
GAFSRAT

SEQ ID NO: 1397 - protein, 9 aa, Artificial Sequence
  Description of Artificial Sequence: Synthetic peptide
  XENP019882 vlCDR3
QQYGSSPWT

SEQ ID NO: 1398 - protein, 246 aa, Artificial Sequence
  Description of Artificial Sequence: Synthetic polypeptide
  XENP019883 [CTLA-4]_H0.135_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTMVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1399 - protein, 118 aa, Artificial Sequence
  Description of Artificial Sequence: Synthetic polypeptide
  VH of XENP019883
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTMVTVSS

SEQ ID NO: 1400 - protein, 108 aa, Artificial Sequence; identical to SEQ ID NO: 23
  Description of Artificial Sequence: Synthetic polypeptide
  VL of XENP019883

SEQ ID NO: 1401 - protein, 5 aa, Artificial Sequence
  Description of Artificial Sequence: Synthetic peptide
  XENP019883 vhCDR1
SYTMH

SEQ ID NO: 1402 - protein, 17 aa, Artificial Sequence
  Description of Artificial Sequence: Synthetic peptide
  XENP019883 vhCDR2
FISYDGNNKYYADSVKG

SEQ ID NO: 1403 - protein, 9 aa, Artificial Sequence
  Description of Artificial Sequence: Synthetic peptide
  XENP019883 vhCDR3
TGWLGPFDY

SEQ ID NO: 1404 - protein, 12 aa, Artificial Sequence
  Description of Artificial Sequence: Synthetic peptide
  XENP019883 vlCDR1
RASQSVGSSYLA

SEQ ID NO: 1405 - protein, 7 aa, Artificial Sequence
  Description of Artificial Sequence: Synthetic peptide
  XENP019883 vlCDR2
GAFSRAT

SEQ ID NO: 1406 - protein, 9 aa, Artificial Sequence
  Description of Artificial Sequence: Synthetic peptide
  XENP019883 vlCDR3
QQYGSSPWT

SEQ ID NO: 1407 - protein, 246 aa, Artificial Sequence
  Description of Artificial Sequence: Synthetic polypeptide
  XENP019884 [CTLA-4]_H0.136_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTTVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1408 - protein, 118 aa, Artificial Sequence
  Description of Artificial Sequence: Synthetic polypeptide
  VH of XENP019884
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTTVTVSS

SEQ ID NO: 1409 - protein, 108 aa, Artificial Sequence; identical to SEQ ID NO: 23
  Description of Artificial Sequence: Synthetic polypeptide
  VL of XENP019884

SEQ ID NO: 1410 - protein, 5 aa, Artificial Sequence
  Description of Artificial Sequence: Synthetic peptide
  XENP019884 vhCDR1
SYTMH

SEQ ID NO: 1411 - protein, 17 aa, Artificial Sequence
  Description of Artificial Sequence: Synthetic peptide
  XENP019884 vhCDR2
FISYDGNNKYYADSVKG

SEQ ID NO: 1412 - protein, 9 aa, Artificial Sequence
  Description of Artificial Sequence: Synthetic peptide
  XENP019884 vhCDR3
TGWLGPFDY

SEQ ID NO: 1413 - protein, 12 aa, Artificial Sequence
  Description of Artificial Sequence: Synthetic peptide
  XENP019884 vlCDR1
RASQSVGSSYLA

SEQ ID NO: 1414 - protein, 7 aa, Artificial Sequence
  Description of Artificial Sequence: Synthetic peptide
  XENP019884 vlCDR2
GAFSRAT

SEQ ID NO: 1415 - protein, 9 aa, Artificial Sequence
  Description of Artificial Sequence: Synthetic peptide
  XENP019884 vlCDR3
QQYGSSPWT

SEQ ID NO: 1416 - protein, 246 aa, Artificial Sequence
  Description of Artificial Sequence: Synthetic polypeptide
  XENP019885 [CTLA-4]_H0_L0.1_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSAIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1417 - protein, 118 aa, Artificial Sequence; identical to SEQ ID NO: 22
  Description of Artificial Sequence: Synthetic polypeptide
  VH of XENP019885

SEQ ID NO: 1418 - protein, 108 aa, Artificial Sequence
  Description of Artificial Sequence: Synthetic polypeptide
  VL of XENP019885
AIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1419 - protein, 5 aa, Artificial Sequence
  Description of Artificial Sequence: Synthetic peptide
  XENP019885 vhCDR1
SYTMH

SEQ ID NO: 1420 - protein, 17 aa, Artificial Sequence
  Description of Artificial Sequence: Synthetic peptide
  XENP019885 vhCDR2
FISYDGNNKYYADSVKG

SEQ ID NO: 1421 - protein, 9 aa, Artificial Sequence
  Description of Artificial Sequence: Synthetic peptide
  XENP019885 vhCDR3
TGWLGPFDY

SEQ ID NO: 1422 - protein, 12 aa, Artificial Sequence
  Description of Artificial Sequence: Synthetic peptide
  XENP019885 vlCDR1
RASQSVGSSYLA

SEQ ID NO: 1423 - protein, 7 aa, Artificial Sequence
  Description of Artificial Sequence: Synthetic peptide
  XENP019885 vlCDR2
GAFSRAT

SEQ ID NO: 1424 - protein, 9 aa, Artificial Sequence
  Description of Artificial Sequence: Synthetic peptide
  XENP019885 vlCDR3
QQYGSSPWT

SEQ ID NO: 1425 - protein, 246 aa, Artificial Sequence
  Description of Artificial Sequence: Synthetic polypeptide
  XENP019886 [CTLA-4]_H0_L0.2_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSDIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1426 - protein, 118 aa, Artificial Sequence; identical to SEQ ID NO: 22
  Description of Artificial Sequence: Synthetic polypeptide
  VH of XENP019886

SEQ ID NO: 1427 - protein, 108 aa, Artificial Sequence
  Description of Artificial Sequence: Synthetic polypeptide
  VL of XENP019886
DIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1428 - protein, 5 aa, Artificial Sequence
  Description of Artificial Sequence: Synthetic peptide
  XENP019886 vhCDR1
SYTMH

SEQ ID NO: 1429 - protein, 17 aa, Artificial Sequence
  Description of Artificial Sequence: Synthetic peptide
  XENP019886 vhCDR2
FISYDGNNKYYADSVKG

SEQ ID NO: 1430 - protein, 9 aa, Artificial Sequence
  Description of Artificial Sequence: Synthetic peptide
  XENP019886 vhCDR3
TGWLGPFDY

SEQ ID NO: 1431 - protein, 12 aa, Artificial Sequence
  Description of Artificial Sequence: Synthetic peptide
  XENP019886 vlCDR1
RASQSVGSSYLA

SEQ ID NO: 1432 - protein, 7 aa, Artificial Sequence
  Description of Artificial Sequence: Synthetic peptide
  XENP019886 vlCDR2
GAFSRAT

SEQ ID NO: 1433 - protein, 9 aa, Artificial Sequence
  Description of Artificial Sequence: Synthetic peptide
  XENP019886 vlCDR3
QQYGSSPWT

SEQ ID NO: 1434 - protein, 246 aa, Artificial Sequence
  Description of Artificial Sequence: Synthetic polypeptide
  XENP019887 [CTLA-4]_H0_L0.3_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSQIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1435 - protein, 118 aa, Artificial Sequence; identical to SEQ ID NO: 22
  Description of Artificial Sequence: Synthetic polypeptide
  VH of XENP019887

SEQ ID NO: 1436 - protein, 108 aa, Artificial Sequence
  Description of Artificial Sequence: Synthetic polypeptide
  VL of XENP019887
QIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1437 - protein, 5 aa, Artificial Sequence
  Description of Artificial Sequence: Synthetic peptide
  XENP019887 vhCDR1
SYTMH

SEQ ID NO: 1438 - protein, 17 aa, Artificial Sequence
  Description of Artificial Sequence: Synthetic peptide
  XENP019887 vhCDR2
FISYDGNNKYYADSVKG

SEQ ID NO: 1439 - protein, 9 aa, Artificial Sequence
  Description of Artificial Sequence: Synthetic peptide
  XENP019887 vhCDR3
TGWLGPFDY

SEQ ID NO: 1440 - protein, 12 aa, Artificial Sequence
  Description of Artificial Sequence: Synthetic peptide
  XENP019887 vlCDR1
RASQSVGSSYLA

SEQ ID NO: 1441 - protein, 7 aa, Artificial Sequence
  Description of Artificial Sequence: Synthetic peptide
  XENP019887 vlCDR2
GAFSRAT

SEQ ID NO: 1442 - protein, 9 aa, Artificial Sequence
  Description of Artificial Sequence: Synthetic peptide
  XENP019887 vlCDR3
QQYGSSPWT

SEQ ID NO: 1443 - protein, 246 aa, Artificial Sequence
  Description of Artificial Sequence: Synthetic polypeptide
  XENP019888 [CTLA-4]_H0_L0.4_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSRIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1444 - protein, 118 aa, Artificial Sequence; identical to SEQ ID NO: 22
  Description of Artificial Sequence: Synthetic polypeptide
  VH of XENP019888

SEQ ID NO: 1445 - protein, 108 aa, Artificial Sequence
  Description of Artificial Sequence: Synthetic polypeptide
  VL of XENP019888
RIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1446 - protein, 5 aa, Artificial Sequence
  Description of Artificial Sequence: Synthetic peptide
  XENP019888 vhCDR1
SYTMH

SEQ ID NO: 1447 - protein, 17 aa, Artificial Sequence
  Description of Artificial Sequence: Synthetic peptide
  XENP019888 vhCDR2
FISYDGNNKYYADSVKG

SEQ ID NO: 1448 - protein, 9 aa, Artificial Sequence
  Description of Artificial Sequence: Synthetic peptide
  XENP019888 vhCDR3
TGWLGPFDY

SEQ ID NO: 1449 - protein, 12 aa, Artificial Sequence
  Description of Artificial Sequence: Synthetic peptide
  XENP019888 vlCDR1
RASQSVGSSYLA

SEQ ID NO: 1450 - protein, 7 aa, Artificial Sequence
  Description of Artificial Sequence: Synthetic peptide
  XENP019888 vlCDR2
GAFSRAT

SEQ ID NO: 1451 - protein, 9 aa, Artificial Sequence
  Description of Artificial Sequence: Synthetic peptide
  XENP019888 vlCDR3
QQYGSSPWT

SEQ ID NO: 1452 - protein, 246 aa, Artificial Sequence
  Description of Artificial Sequence: Synthetic polypeptide
  XENP019889 [CTLA-4]_H0_L0.5_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1453 - protein, 118 aa, Artificial Sequence; identical to SEQ ID NO: 22
  Description of Artificial Sequence: Synthetic polypeptide
  VH of XENP019889

SEQ ID NO: 1454 - protein, 108 aa, Artificial Sequence
  Description of Artificial Sequence: Synthetic polypeptide
  VL of XENP019889
EIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1455 - protein, 5 aa, Artificial Sequence
  Description of Artificial Sequence: Synthetic peptide
  XENP019889 vhCDR1
SYTMH

SEQ ID NO: 1456 - protein, 17 aa, Artificial Sequence
  Description of Artificial Sequence: Synthetic peptide
  XENP019889 vhCDR2
FISYDGNNKYYADSVKG

SEQ ID NO: 1457 - protein, 9 aa, Artificial Sequence
  Description of Artificial Sequence: Synthetic peptide
  XENP019889 vhCDR3
TGWLGPFDY

SEQ ID NO: 1458 - protein, 12 aa, Artificial Sequence
  Description of Artificial Sequence: Synthetic peptide
  XENP019889 vlCDR1
RASQSVGSSYLA

SEQ ID NO: 1459 - protein, 7 aa, Artificial Sequence
  Description of Artificial Sequence: Synthetic peptide
  XENP019889 vlCDR2
GAFSRAT

SEQ ID NO: 1460 - protein, 9 aa, Artificial Sequence
  Description of Artificial Sequence: Synthetic peptide
  XENP019889 vlCDR3
QQYGSSPWT

SEQ ID NO: 1461 - protein, 246 aa, Artificial Sequence
  Description of Artificial Sequence: Synthetic polypeptide
  XENP019890 [CTLA-4]_H0_L0.6_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIK

SEQ ID NO: 1462 - protein, 118 aa, Artificial Sequence; identical to SEQ ID NO: 22
  Description of Artificial Sequence: Synthetic polypeptide
  VH of XENP019890

SEQ ID NO: 1463 - protein, 108 aa, Artificial Sequence
  Description of Artificial Sequence: Synthetic polypeptide
  VL of XENP019890
EIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIK

SEQ ID NO: 1464 - protein, 5 aa, Artificial Sequence
  Description of Artificial Sequence: Synthetic peptide
  XENP019890 vhCDR1
SYTMH

SEQ ID NO: 1465 - protein, 17 aa, Artificial Sequence
  Description of Artificial Sequence: Synthetic peptide
  XENP019890 vhCDR2
FISYDGNNKYYADSVKG

SEQ ID NO: 1466 - protein, 9 aa, Artificial Sequence
  Description of Artificial Sequence: Synthetic peptide
  XENP019890 vhCDR3
TGWLGPFDY

SEQ ID NO: 1467 - protein, 12 aa, Artificial Sequence
  Description of Artificial Sequence: Synthetic peptide
  XENP019890 vlCDR1
RASQSVGSSYLA

SEQ ID NO: 1468 - protein, 7 aa, Artificial Sequence
  Description of Artificial Sequence: Synthetic peptide
  XENP019890 vlCDR2
GAFSRAT

SEQ ID NO: 1469 - protein, 9 aa, Artificial Sequence
  Description of Artificial Sequence: Synthetic peptide
  XENP019890 vlCDR3
QQYGSSPWT

SEQ ID NO: 1470 - protein, 246 aa, Artificial Sequence
  Description of Artificial Sequence: Synthetic polypeptide
  XENP019891 [CTLA-4]_H0_L0.7_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVMTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1471 - protein, 118 aa, Artificial Sequence; identical to SEQ ID NO: 22
  Description of Artificial Sequence: Synthetic polypeptide
  VH of XENP019891

SEQ ID NO: 1472 - protein, 108 aa, Artificial Sequence
  Description of Artificial Sequence: Synthetic polypeptide
  VL of XENP019891
EIVMTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1473 - protein, 5 aa, Artificial Sequence
  Description of Artificial Sequence: Synthetic peptide
  XENP019891 vhCDR1
SYTMH

SEQ ID NO: 1474 - protein, 17 aa, Artificial Sequence
  Description of Artificial Sequence: Synthetic peptide
  XENP019891 vhCDR2
FISYDGNNKYYADSVKG

SEQ ID NO: 1475 - protein, 9 aa, Artificial Sequence
  Description of Artificial Sequence: Synthetic peptide
  XENP019891 vhCDR3
TGWLGPFDY

SEQ ID NO: 1476 - protein, 12 aa, Artificial Sequence
  Description of Artificial Sequence: Synthetic peptide
  XENP019891 vlCDR1
RASQSVGSSYLA

SEQ ID NO: 1477 - protein, 7 aa, Artificial Sequence
  Description of Artificial Sequence: Synthetic peptide
  XENP019891 vlCDR2
GAFSRAT

SEQ ID NO: 1478 - protein, 9 aa, Artificial Sequence
  Description of Artificial Sequence: Synthetic peptide
  XENP019891 vlCDR3
QQYGSSPWT

SEQ ID NO: 1479 - protein, 246 aa, Artificial Sequence
  Description of Artificial Sequence: Synthetic polypeptide
  XENP019892 [CTLA-4]_H0_L0.8_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPATLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1480 - protein, 118 aa, Artificial Sequence; identical to SEQ ID NO: 22
  Description of Artificial Sequence: Synthetic polypeptide
  VH of XENP019892

SEQ ID NO: 1481 - protein, 108 aa, Artificial Sequence
  Description of Artificial Sequence: Synthetic polypeptide
  VL of XENP019892
EIVLTQSPATLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1482 - protein, 5 aa, Artificial Sequence
  Description of Artificial Sequence: Synthetic peptide
  XENP019892 vhCDR1
SYTMH

SEQ ID NO: 1483 - protein, 17 aa, Artificial Sequence
  Description of Artificial Sequence: Synthetic peptide
  XENP019892 vhCDR2
FISYDGNNKYYADSVKG

SEQ ID NO: 1484 - protein, 9 aa, Artificial Sequence
  Description of Artificial Sequence: Synthetic peptide
  XENP019892 vhCDR3
TGWLGPFDY

SEQ ID NO: 1485 - protein, 12 aa, Artificial Sequence
  Description of Artificial Sequence: Synthetic peptide
  XENP019892 vlCDR1
RASQSVGSSYLA

SEQ ID NO: 1486 - protein, 7 aa, Artificial Sequence
  Description of Artificial Sequence: Synthetic peptide
  XENP019892 vlCDR2
GAFSRAT

SEQ ID NO: 1487 - protein, 9 aa, Artificial Sequence
  Description of Artificial Sequence: Synthetic peptide
  XENP019892 vlCDR3
QQYGSSPWT

SEQ ID NO: 1488 - protein, 246 aa, Artificial Sequence
  Description of Artificial Sequence: Synthetic polypeptide
  XENP019893 [CTLA-4]_H0_L0.9_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPPTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1489 - protein, 118 aa, Artificial Sequence; identical to SEQ ID NO: 22
  Description of Artificial Sequence: Synthetic polypeptide
  VH of XENP019893

SEQ ID NO: 1490 - protein, 108 aa, Artificial Sequence
  Description of Artificial Sequence: Synthetic polypeptide
  VL of XENP019893
EIVLTQSPPTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1491 - protein, 5 aa, Artificial Sequence
  Description of Artificial Sequence: Synthetic peptide
  XENP019893 vhCDR1
SYTMH

SEQ ID NO: 1492 - protein, 17 aa, Artificial Sequence
  Description of Artificial Sequence: Synthetic peptide
  XENP019893 vhCDR2
FISYDGNNKYYADSVKG

SEQ ID NO: 1493 - protein, 9 aa, Artificial Sequence
  Description of Artificial Sequence: Synthetic peptide
  XENP019893 vhCDR3
TGWLGPFDY

SEQ ID NO: 1494 - protein, 12 aa, Artificial Sequence
  Description of Artificial Sequence: Synthetic peptide
  XENP019893 vlCDR1
RASQSVGSSYLA

SEQ ID NO: 1495 - protein, 7 aa, Artificial Sequence
  Description of Artificial Sequence: Synthetic peptide
  XENP019893 vlCDR2
GAFSRAT

SEQ ID NO: 1496 - protein, 9 aa, Artificial Sequence
  Description of Artificial Sequence: Synthetic peptide
  XENP019893 vlCDR3
QQYGSSPWT

SEQ ID NO: 1497 - protein, 246 aa, Artificial Sequence
  Description of Artificial Sequence: Synthetic polypeptide
  XENP019894 [CTLA-4]_H0_L0.10_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPSTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1498 - protein, 118 aa, Artificial Sequence; identical to SEQ ID NO: 22
  Description of Artificial Sequence: Synthetic polypeptide
  VH of XENP019894

SEQ ID NO: 1499 - protein, 108 aa, Artificial Sequence
  Description of Artificial Sequence: Synthetic polypeptide
  VL of XENP019894
EIVLTQSPSTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1500 - protein, 5 aa, Artificial Sequence
  Description of Artificial Sequence: Synthetic peptide
  XENP019894 vhCDR1
SYTMH

SEQ ID NO: 1501 - protein, 17 aa, Artificial Sequence
  Description of Artificial Sequence: Synthetic peptide
  XENP019894 vhCDR2
FISYDGNNKYYADSVKG

SEQ ID NO: 1502 - protein, 9 aa, Artificial Sequence
  Description of Artificial Sequence: Synthetic peptide
  XENP019894 vhCDR3
TGWLGPFDY

SEQ ID NO: 1503 - protein, 12 aa, Artificial Sequence
  Description of Artificial Sequence: Synthetic peptide
  XENP019894 vlCDR1
RASQSVGSSYLA

SEQ ID NO: 1504 - protein, 7 aa, Artificial Sequence
  Description of Artificial Sequence: Synthetic peptide
  XENP019894 vlCDR2
GAFSRAT

SEQ ID NO: 1505 - protein, 9 aa, Artificial Sequence
  Description of Artificial Sequence: Synthetic peptide
  XENP019894 vlCDR3
QQYGSSPWT

SEQ ID NO: 1506 - protein, 246 aa, Artificial Sequence
  Description of Artificial Sequence: Synthetic polypeptide
  XENP019895 [CTLA-4]_H0_L0.11_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGSLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1507 - protein, 118 aa, Artificial Sequence; identical to SEQ ID NO: 22
  Description of Artificial Sequence: Synthetic polypeptide
  VH of XENP019895

SEQ ID NO: 1508 - protein, 108 aa, Artificial Sequence
  Description of Artificial Sequence: Synthetic polypeptide
  VL of XENP019895
EIVLTQSPGSLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1509 - protein, 5 aa, Artificial Sequence
  Description of Artificial Sequence: Synthetic peptide
  XENP019895 vhCDR1
SYTMH

SEQ ID NO: 1510 - protein, 17 aa, Artificial Sequence
  Description of Artificial Sequence: Synthetic peptide
  XENP019895 vhCDR2
FISYDGNNKYYADSVKG

SEQ ID NO: 1511 - protein, 9 aa, Artificial Sequence
  Description of Artificial Sequence: Synthetic peptide
  XENP019895 vhCDR3
TGWLGPFDY

SEQ ID NO: 1512 - protein, 12 aa, Artificial Sequence
  Description of Artificial Sequence: Synthetic peptide
  XENP019895 vlCDR1
RASQSVGSSYLA

SEQ ID NO: 1513 - protein, 7 aa, Artificial Sequence
  Description of Artificial Sequence: Synthetic peptide
  XENP019895 vlCDR2
GAFSRAT

SEQ ID NO: 1514 - protein, 9 aa, Artificial Sequence
  Description of Artificial Sequence: Synthetic peptide
  XENP019895 vlCDR3
QQYGSSPWT

SEQ ID NO: 1515 - protein, 246 aa, Artificial Sequence
  Description of Artificial Sequence: Synthetic polypeptide
  XENP019896 [CTLA-4]_H0_L0.12_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1516 - protein, 118 aa, Artificial Sequence; identical to SEQ ID NO: 22
  Description of Artificial Sequence: Synthetic polypeptide
  VH of XENP019896

SEQ ID NO: 1517 - protein, 108 aa, Artificial Sequence
  Description of Artificial Sequence: Synthetic polypeptide
  VL of XENP019896
EIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1518 - protein, 5 aa, Artificial Sequence
  Description of Artificial Sequence: Synthetic peptide
  XENP019896 vhCDR1
SYTMH

SEQ ID NO: 1519 - protein, 17 aa, Artificial Sequence
  Description of Artificial Sequence: Synthetic peptide
  XENP019896 vhCDR2
FISYDGNNKYYADSVKG

SEQ ID NO: 1520 - protein, 9 aa, Artificial Sequence
  Description of Artificial Sequence: Synthetic peptide
  XENP019896 vhCDR3
TGWLGPFDY

SEQ ID NO: 1521 - protein, 12 aa, Artificial Sequence
  Description of Artificial Sequence: Synthetic peptide
  XENP019896 vlCDR1
RASQSVGSSYLA

SEQ ID NO: 1522 - protein, 7 aa, Artificial Sequence
  Description of Artificial Sequence: Synthetic peptide
  XENP019896 vlCDR2
GAFSRAT

SEQ ID NO: 1523 - protein, 9 aa, Artificial Sequence
  Description of Artificial Sequence: Synthetic peptide
  XENP019896 vlCDR3
QQYGSSPWT

SEQ ID NO: 1524 - protein, 246 aa, Artificial Sequence
  Description of Artificial Sequence: Synthetic polypeptide
  XENP019901 [CTLA-4]_H0_L0.13_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGEPATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1525 - protein, 118 aa, Artificial Sequence; identical to SEQ ID NO: 22
  Description of Artificial Sequence: Synthetic polypeptide
  VH of XENP019901

SEQ ID NO: 1526 - protein, 108 aa, Artificial Sequence
  Description of Artificial Sequence: Synthetic polypeptide
  VL of XENP019901
EIVLTQSPGTLSLSPGEPATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1527 - protein, 5 aa, Artificial Sequence
  Description of Artificial Sequence: Synthetic peptide
  XENP019901 vhCDR1
SYTMH

SEQ ID NO: 1528 - protein, 17 aa, Artificial Sequence
  Description of Artificial Sequence: Synthetic peptide
  XENP019901 vhCDR2
FISYDGNNKYYADSVKG

SEQ ID NO: 1529 - protein, 9 aa, Artificial Sequence
  Description of Artificial Sequence: Synthetic peptide
  XENP019901 vhCDR3
TGWLGPFDY

SEQ ID NO: 1530 - protein, 12 aa, Artificial Sequence
  Description of Artificial Sequence: Synthetic peptide
  XENP019901 vlCDR1
RASQSVGSSYLA

SEQ ID NO: 1531 - protein, 7 aa, Artificial Sequence
  Description of Artificial Sequence: Synthetic peptide
  XENP019901 vlCDR2
GAFSRAT

SEQ ID NO: 1532 - protein, 9 aa, Artificial Sequence
  Description of Artificial Sequence: Synthetic peptide
  XENP019901 vlCDR3
QQYGSSPWT

SEQ ID NO: 1533 - protein, 246 aa, Artificial Sequence
  Description of Artificial Sequence: Synthetic polypeptide
  XENP019902 [CTLA-4]_H0_L0.14_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGEQATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1534 - protein, 118 aa, Artificial Sequence; identical to SEQ ID NO: 22
  Description of Artificial Sequence: Synthetic polypeptide
  VH of XENP019902

SEQ ID NO: 1535 - protein, 108 aa, Artificial Sequence
  Description of Artificial Sequence: Synthetic polypeptide
  VL of XENP019902
EIVLTQSPGTLSLSPGEQATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1536 - protein, 5 aa, Artificial Sequence
  Description of Artificial Sequence: Synthetic peptide
  XENP019902 vhCDR1
SYTMH

SEQ ID NO: 1537 - protein, 17 aa, Artificial Sequence
  Description of Artificial Sequence: Synthetic peptide
  XENP019902 vhCDR2
FISYDGNNKYYADSVKG

SEQ ID NO: 1538 - protein, 9 aa, Artificial Sequence
  Description of Artificial Sequence: Synthetic peptide
  XENP019902 vhCDR3
TGWLGPFDY

SEQ ID NO: 1539 - protein, 12 aa, Artificial Sequence
  Description of Artificial Sequence: Synthetic peptide
  XENP019902 vlCDR1
RASQSVGSSYLA

SEQ ID NO: 1540 - protein, 7 aa, Artificial Sequence
  Description of Artificial Sequence: Synthetic peptide
  XENP019902 vlCDR2
GAFSRAT

SEQ ID NO: 1541 - protein, 9 aa, Artificial Sequence
  Description of Artificial Sequence: Synthetic peptide
  XENP019902 vlCDR3
QQYGSSPWT

SEQ ID NO: 1542 - protein, 246 aa, Artificial Sequence
  Description of Artificial Sequence: Synthetic polypeptide
  XENP019903 [CTLA-4]_H0_L0.15_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERVTLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1543 - protein, 118 aa, Artificial Sequence; identical to SEQ ID NO: 22
  Description of Artificial Sequence: Synthetic polypeptide
  VH of XENP019903

SEQ ID NO: 1544 - protein, 108 aa, Artificial Sequence
  Description of Artificial Sequence: Synthetic polypeptide
  VL of XENP019903
EIVLTQSPGTLSLSPGERVTLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1545 - protein, 5 aa, Artificial Sequence
  Description of Artificial Sequence: Synthetic peptide
  XENP019903 vhCDR1
SYTMH

SEQ ID NO: 1546 - protein, 17 aa, Artificial Sequence
  Description of Artificial Sequence: Synthetic peptide
  XENP019903 vhCDR2
FISYDGNNKYYADSVKG

SEQ ID NO: 1547 - protein, 9 aa, Artificial Sequence
  Description of Artificial Sequence: Synthetic peptide
  XENP019903 vhCDR3
TGWLGPFDY

SEQ ID NO: 1548 - protein, 12 aa, Artificial Sequence
  Description of Artificial Sequence: Synthetic peptide
  XENP019903 vlCDR1
RASQSVGSSYLA

SEQ ID NO: 1549 - protein, 7 aa, Artificial Sequence
  Description of Artificial Sequence: Synthetic peptide
  XENP019903 vlCDR2
GAFSRAT

SEQ ID NO: 1550 - protein, 9 aa, Artificial Sequence
  Description of Artificial Sequence: Synthetic peptide
  XENP019903 vlCDR3
QQYGSSPWT

SEQ ID NO: 1551 - protein, 246 aa, Artificial Sequence
  Description of Artificial Sequence: Synthetic polypeptide
  XENP019904 [CTLA-4]_H0_L0.16_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERASLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1552 - protein, 118 aa, Artificial Sequence; identical to SEQ ID NO: 22
  Description of Artificial Sequence: Synthetic polypeptide
  VH of XENP019904

SEQ ID NO: 1553 - protein, 108 aa, Artificial Sequence
  Description of Artificial Sequence: Synthetic polypeptide
  VL of XENP019904
EIVLTQSPGTLSLSPGERASLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1554 - protein, 5 aa, Artificial Sequence
  Description of Artificial Sequence: Synthetic peptide
  XENP019904 vhCDR1
SYTMH

SEQ ID NO: 1555 - protein, 17 aa, Artificial Sequence
  Description of Artificial Sequence: Synthetic peptide
  XENP019904 vhCDR2
FISYDGNNKYYADSVKG

SEQ ID NO: 1556 - protein, 9 aa, Artificial Sequence
  Description of Artificial Sequence: Synthetic peptide
  XENP019904 vhCDR3
TGWLGPFDY

SEQ ID NO: 1557 - protein, 12 aa, Artificial Sequence
  Description of Artificial Sequence: Synthetic peptide
  XENP019904 vlCDR1
RASQSVGSSYLA

SEQ ID NO: 1558 - protein, 7 aa, Artificial Sequence
  Description of Artificial Sequence: Synthetic peptide
  XENP019904 vlCDR2
GAFSRAT

SEQ ID NO: 1559 - protein, 9 aa, Artificial Sequence
  Description of Artificial Sequence: Synthetic peptide
  XENP019904 vlCDR3
QQYGSSPWT

SEQ ID NO: 1560 - protein, 246 aa, Artificial Sequence
  Description of Artificial Sequence: Synthetic polypeptide
  XENP019905 [CTLA-4]_H0_L0.17_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATISCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1561 - protein, 118 aa, Artificial Sequence; identical to SEQ ID NO: 22
  Description of Artificial Sequence: Synthetic polypeptide
  VH of XENP019905

SEQ ID NO: 1562 - protein, 108 aa, Artificial Sequence
  Description of Artificial Sequence: Synthetic polypeptide
  VL of XENP019905
EIVLTQSPGTLSLSPGERATISCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1563 - protein, 5 aa, Artificial Sequence
  Description of Artificial Sequence: Synthetic peptide
  XENP019905 vhCDR1
SYTMH

SEQ ID NO: 1564 - protein, 17 aa, Artificial Sequence
  Description of Artificial Sequence: Synthetic peptide
  XENP019905 vhCDR2
FISYDGNNKYYADSVKG

SEQ ID NO: 1565 - protein, 9 aa, Artificial Sequence
  Description of Artificial Sequence: Synthetic peptide
  XENP019905 vhCDR3
TGWLGPFDY

SEQ ID NO: 1566 - protein, 12 aa, Artificial Sequence
  Description of Artificial Sequence: Synthetic peptide
  XENP019905 vlCDR1
RASQSVGSSYLA

SEQ ID NO: 1567 - protein, 7 aa, Artificial Sequence
  Description of Artificial Sequence: Synthetic peptide
  XENP019905 vlCDR2
GAFSRAT

SEQ ID NO: 1568 - protein, 9 aa, Artificial Sequence
  Description of Artificial Sequence: Synthetic peptide
  XENP019905 vlCDR3
QQYGSSPWT

SEQ ID NO: 1569 - protein, 246 aa, Artificial Sequence
  Description of Artificial Sequence: Synthetic polypeptide
  XENP019906 [CTLA-4]_H0_L0.18_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRSSQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1570 - protein, 118 aa, Artificial Sequence; identical to SEQ ID NO: 22
  Description of Artificial Sequence: Synthetic polypeptide
  VH of XENP019906

SEQ ID NO: 1571 - protein, 108 aa, Artificial Sequence
  Description of Artificial Sequence: Synthetic polypeptide
  VL of XENP019906
EIVLTQSPGTLSLSPGERATLSCRSSQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1572 - protein, 5 aa, Artificial Sequence
  Description of Artificial Sequence: Synthetic peptide
  XENP019906 vhCDR1
SYTMH

SEQ ID NO: 1573 - protein, 17 aa, Artificial Sequence
  Description of Artificial Sequence: Synthetic peptide
  XENP019906 vhCDR2
FISYDGNNKYYADSVKG

SEQ ID NO: 1574 - protein, 9 aa, Artificial Sequence
  Description of Artificial Sequence: Synthetic peptide
  XENP019906 vhCDR3
TGWLGPFDY

SEQ ID NO: 1575 - protein, 12 aa, Artificial Sequence
  Description of Artificial Sequence: Synthetic peptide
  XENP019906 vlCDR1
RSSQSVGSSYLA

SEQ ID NO: 1576 - protein, 7 aa, Artificial Sequence
  Description of Artificial Sequence: Synthetic peptide
  XENP019906 vlCDR2
GAFSRAT

SEQ ID NO: 1577 - protein, 9 aa, Artificial Sequence
  Description of Artificial Sequence: Synthetic peptide
  XENP019906 vlCDR3
QQYGSSPWT

SEQ ID NO: 1578 - protein, 246 aa, Artificial Sequence
  Description of Artificial Sequence: Synthetic polypeptide
  XENP019907 [CTLA-4]_H0_L0.19_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSDGSSYLAWYQQKPGQAPRLLIYGAFSRATGIPDRFSGSGSGTDFTLTISRLEPEDFAVYYCQQYGSSPWTFGQGTKVEIK

SEQ ID NO: 1579 - protein, 118 aa, Artificial Sequence; identical to SEQ ID NO: 22
  Description of Artificial Sequence: Synthetic polypeptide
  VH of XENP019907

SEQ ID NO: 1580 - protein, 108 aa, Artificial Sequence
  Description of Artificial Sequence: Synthetic polypeptide
  VL of XENP019907
EIVLTQSPGTLSLSPGERATLSCRASQSDGSSYLAWYQQKPGQAPRLLIYGAFSRATGIPDRFSGSGSGTDFTLTISRLEPEDFAVYYCQQYGSSPWTFGQGTKVEIK

SEQ ID NO: 1581 - protein, 5 aa, Artificial Sequence
  Description of Artificial Sequence: Synthetic peptide
  XENP019907 vhCDR1
SYTMH

SEQ ID NO: 1582 - protein, 17 aa, Artificial Sequence
  Description of Artificial Sequence: Synthetic peptide
  XENP019907 vhCDR2
FISYDGNNKYYADSVKG

SEQ ID NO: 1583 - protein, 9 aa, Artificial Sequence
  Description of Artificial Sequence: Synthetic peptide
  XENP019907 vhCDR3
TGWLGPFDY

SEQ ID NO: 1584 - protein, 12 aa, Artificial Sequence
  Description of Artificial Sequence: Synthetic peptide
  XENP019907 vlCDR1
RASQSDGSSYLA

SEQ ID NO: 1585 - protein, 7 aa, Artificial Sequence
  Description of Artificial Sequence: Synthetic peptide
  XENP019907 vlCDR2
GAFSRAT

SEQ ID NO: 1586 - protein, 9 aa, Artificial Sequence
  Description of Artificial Sequence: Synthetic peptide
  XENP019907 vlCDR3
QQYGSSPWT

SEQ ID NO: 1587 - protein, 246 aa, Artificial Sequence
  Description of Artificial Sequence: Synthetic polypeptide
  XENP019908 [CTLA-4]_H0_L0.20_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSSGSSYLAWYQQKPGQAPRLLIYGAFSRATGIPDRFSGSGSGTDFTLTISRLEPEDFAVYYCQQYGSSPWTFGQGTKVEIK

SEQ ID NO: 1588 - protein, 118 aa, Artificial Sequence; identical to SEQ ID NO: 22
  Description of Artificial Sequence: Synthetic polypeptide
  VH of XENP019908

SEQ ID NO: 1589 - protein, 108 aa, Artificial Sequence
  Description of Artificial Sequence: Synthetic polypeptide
  VL of XENP019908
EIVLTQSPGTLSLSPGERATLSCRASQSSGSSYLAWYQQKPGQAPRLLIYGAFSRATGIPDRFSGSGSGTDFTLTISRLEPEDFAVYYCQQYGSSPWTFGQGTKVEIK

SEQ ID NO: 1590 - protein, 5 aa, Artificial Sequence
  Description of Artificial Sequence: Synthetic peptide
  XENP019908 vhCDR1
SYTMH

SEQ ID NO: 1591 - protein, 17 aa, Artificial Sequence
  Description of Artificial Sequence: Synthetic peptide
  XENP019908 vhCDR2
FISYDGNNKYYADSVKG

SEQ ID NO: 1592 - protein, 9 aa, Artificial Sequence
  Description of Artificial Sequence: Synthetic peptide
  XENP019908 vhCDR3
TGWLGPFDY

SEQ ID NO: 1593 - protein, 12 aa, Artificial Sequence
  Description of Artificial Sequence: Synthetic peptide
  XENP019908 vlCDR1
RASQSSGSSYLA

SEQ ID NO: 1594 - protein, 7 aa, Artificial Sequence
  Description of Artificial Sequence: Synthetic peptide
  XENP019908 vlCDR2
GAFSRAT

SEQ ID NO: 1595 - protein, 9 aa, Artificial Sequence
  Description of Artificial Sequence: Synthetic peptide
  XENP019908 vlCDR3
QQYGSSPWT

SEQ ID NO: 1596 - protein, 246 aa, Artificial Sequence
  Description of Artificial Sequence: Synthetic polypeptide
  XENP019909 [CTLA-4]_H0_L0.21_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVASSYLAWYQQKPGQAPRLLIYGAFSRATGIPDRFSGSGSGTDFTLTISRLEPEDFAVYYCQQYGSSPWTFGQGTKVEIK

SEQ ID NO: 1597 - protein, 118 aa, Artificial Sequence; identical to SEQ ID NO: 22
  Description of Artificial Sequence: Synthetic polypeptide
  VH of XENP019909

SEQ ID NO: 1598 - protein, 108 aa, Artificial Sequence
  Description of Artificial Sequence: Synthetic polypeptide
  VL of XENP019909
EIVLTQSPGTLSLSPGERATLSCRASQSVASSYLAWYQQKPGQAPRLLIYGAFSRATGIPDRFSGSGSGTDFTLTISRLEPEDFAVYYCQQYGSSPWTFGQGTKVEIK

SEQ ID NO: 1599 - protein, 5 aa, Artificial Sequence
  Description of Artificial Sequence: Synthetic peptide
  XENP019909 vhCDR1
SYTMH

SEQ ID NO: 1600 - protein, 17 aa, Artificial Sequence
  Description of Artificial Sequence: Synthetic peptide
  XENP019909 vhCDR2
FISYDGNNKYYADSVKG

SEQ ID NO: 1601 - protein, 9 aa, Artificial Sequence
  Description of Artificial Sequence: Synthetic peptide
  XENP019909 vhCDR3
TGWLGPFDY

SEQ ID NO: 1602 - protein, 12 aa, Artificial Sequence
  Description of Artificial Sequence: Synthetic peptide
  XENP019909 vlCDR1
RASQSVASSYLA

SEQ ID NO: 1603 - protein, 7 aa, Artificial Sequence
  Description of Artificial Sequence: Synthetic peptide
  XENP019909 vlCDR2
GAFSRAT

SEQ ID NO: 1604 - protein, 9 aa, Artificial Sequence
  Description of Artificial Sequence: Synthetic peptide
  XENP019909 vlCDR3
QQYGSSPWT

SEQ ID NO: 1605 - protein, 246 aa, Artificial Sequence
  Description of Artificial Sequence: Synthetic polypeptide
  XENP019910 [CTLA-4]_H0_L0.22_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 1606 - protein, 118 aa, Artificial Sequence; identical to SEQ ID NO: 22
  Description of Artificial Sequence: Synthetic polypeptide
  VH of XENP019910

SEQ ID NO: 1607 - protein, 108 aa, Artificial Sequence
  Description of Artificial Sequence: Synthetic polypeptide
  VL of XENP019910
EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 1608 - protein, 5 aa, Artificial Sequence
  Description of Artificial Sequence: Synthetic peptide
  XENP019910 vhCDR1
SYTMH

SEQ ID NO: 1609 - protein, 17 aa, Artificial Sequence
  Description of Artificial Sequence: Synthetic peptide
  XENP019910 vhCDR2
FISYDGNNKYYADSVKG

SEQ ID NO: 1610 - protein, 9 aa, Artificial Sequence
  Description of Artificial Sequence: Synthetic peptide
  XENP019910 vhCDR3
TGWLGPFDY

SEQ ID NO: 1611 - protein, 12 aa, Artificial Sequence
  Description of Artificial Sequence: Synthetic peptide
  XENP019910 vlCDR1
RASQSVSSSYLA

SEQ ID NO: 1612 - protein, 7 aa, Artificial Sequence
  Description of Artificial Sequence: Synthetic peptide
  XENP019910 vlCDR2
GAFSRAT

SEQ ID NO: 1613 - protein, 9 aa, Artificial Sequence
  Description of Artificial Sequence: Synthetic peptide
  XENP019910 vlCDR3
QQYGSSPWT

SEQ ID NO: 1614 - protein, 246 aa, Artificial Sequence
  Description of Artificial Sequence: Synthetic polypeptide
  XENP019911 [CTLA-4]_H0_L0.23_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVTSSYLAWYQQKPGQAPRLLIYGAFSRATGIPDRFSGSGSGTDFTLTISRLEPEDFAVYYCQQYGSSPWTFGQGTKVEIK

SEQ ID NO: 1615 - protein, 118 aa, Artificial Sequence; identical to SEQ ID NO: 22
  Description of Artificial Sequence: Synthetic polypeptide
  VH of XENP019911

SEQ ID NO: 1616 - protein, 108 aa, Artificial Sequence
  Description of Artificial Sequence: Synthetic polypeptide
  VL of XENP019911
EIVLTQSPGTLSLSPGERATLSCRASQSVTSSYLAWYQQKPGQAPRLLIYGAFSRATGIPDRFSGSGSGTDFTLTISRLEPEDFAVYYCQQYGSSPWTFGQGTKVEIK

SEQ ID NO: 1617 - protein, 5 aa, Artificial Sequence
  Description of Artificial Sequence: Synthetic peptide
  XENP019911 vhCDR1
SYTMH

SEQ ID NO: 1618 - protein, 17 aa, Artificial Sequence
  Description of Artificial Sequence: Synthetic peptide
  XENP019911 vhCDR2
FISYDGNNKYYADSVKG

SEQ ID NO: 1619 - protein, 9 aa, Artificial Sequence
  Description of Artificial Sequence: Synthetic peptide
  XENP019911 vhCDR3
TGWLGPFDY

SEQ ID NO: 1620 - protein, 12 aa, Artificial Sequence
  Description of Artificial Sequence: Synthetic peptide
  XENP019911 vlCDR1
RASQSVTSSYLA

SEQ ID NO: 1621 - protein, 7 aa, Artificial Sequence
  Description of Artificial Sequence: Synthetic peptide
  XENP019911 vlCDR2
GAFSRAT

SEQ ID NO: 1622 - protein, 9 aa, Artificial Sequence
  Description of Artificial Sequence: Synthetic peptide
  XENP019911 vlCDR3
QQYGSSPWT

SEQ ID NO: 1623 - protein, 246 aa, Artificial Sequence
  Description of Artificial Sequence: Synthetic polypeptide
  XENP019912 [CTLA-4]_H0_L0.24_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGASYLAWYQQKPGQAPRLLIYGAFSRATGIPDRFSGSGSGTDFTLTISRLEPEDFAVYYCQQYGSSPWTFGQGTKVEIK

SEQ ID NO: 1624 - protein, 118 aa, Artificial Sequence; identical to SEQ ID NO: 22
  Description of Artificial Sequence: Synthetic polypeptide
  VH of XENP019912

SEQ ID NO: 1625 - protein, 108 aa, Artificial Sequence
  Description of Artificial Sequence: Synthetic polypeptide
  VL of XENP019912
EIVLTQSPGTLSLSPGERATLSCRASQSVGASYLAWYQQKPGQAPRLLIYGAFSRATGIPDRFSGSGSGTDFTLTISRLEPEDFAVYYCQQYGSSPWTFGQGTKVEIK

SEQ ID NO: 1626 - protein, 5 aa, Artificial Sequence
  Description of Artificial Sequence: Synthetic peptide
  XENP019912 vhCDR1
SYTMH

SEQ ID NO: 1627 - protein, 17 aa, Artificial Sequence
  Description of Artificial Sequence: Synthetic peptide
  XENP019912 vhCDR2
FISYDGNNKYYADSVKG

SEQ ID NO: 1628 - protein, 9 aa, Artificial Sequence
  Description of Artificial Sequence: Synthetic peptide
  XENP019912 vhCDR3
TGWLGPFDY

SEQ ID NO: 1629 - protein, 12 aa, Artificial Sequence
  Description of Artificial Sequence: Synthetic peptide
  XENP019912 vlCDR1
RASQSVGASYLA

SEQ ID NO: 1630 - protein, 7 aa, Artificial Sequence
  Description of Artificial Sequence: Synthetic peptide
  XENP019912 vlCDR2
GAFSRAT

SEQ ID NO: 1631 - protein, 9 aa, Artificial Sequence
  Description of Artificial Sequence: Synthetic peptide
  XENP019912 vlCDR3
QQYGSSPWT

SEQ ID NO: 1632 - protein, 246 aa, Artificial Sequence
  Description of Artificial Sequence: Synthetic polypeptide
  XENP019913 [CTLA-4]_H0_L0.25_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGGSYLAWYQQKPGQAPRLLIYGAFSRATGIPDRFSGSGSGTDFTLTISRLEPEDFAVYYCQQYGSSPWTFGQGTKVEIK

SEQ ID NO: 1633 - protein, 118 aa, Artificial Sequence; identical to SEQ ID NO: 22
  Description of Artificial Sequence: Synthetic polypeptide
  VH of XENP019913

SEQ ID NO: 1634 - protein, 108 aa, Artificial Sequence
  Description of Artificial Sequence: Synthetic polypeptide
  VL of XENP019913
EIVLTQSPGTLSLSPGERATLSCRASQSVGGSYLAWYQQKPGQAPRLLIYGAFSRATGIPDRFSGSGSGTDFTLTISRLEPEDFAVYYCQQYGSSPWTFGQGTKVEIK

SEQ ID NO: 1635 - protein, 5 aa, Artificial Sequence
  Description of Artificial Sequence: Synthetic peptide
  XENP019913 vhCDR1
SYTMH

SEQ ID NO: 1636 - protein, 17 aa, Artificial Sequence
  Description of Artificial Sequence: Synthetic peptide
  XENP019913 vhCDR2
FISYDGNNKYYADSVKG

SEQ ID NO: 1637 - protein, 9 aa, Artificial Sequence
  Description of Artificial Sequence: Synthetic peptide
  XENP019913 vhCDR3
TGWLGPFDY

SEQ ID NO: 1638 - protein, 12 aa, Artificial Sequence
  Description of Artificial Sequence: Synthetic peptide
  XENP019913 vlCDR1
RASQSVGGSYLA

SEQ ID NO: 1639 - protein, 7 aa, Artificial Sequence
  Description of Artificial Sequence: Synthetic peptide
  XENP019913 vlCDR2
GAFSRAT

SEQ ID NO: 1640 - protein, 9 aa, Artificial Sequence
  Description of Artificial Sequence: Synthetic peptide
  XENP019913 vlCDR3
QQYGSSPWT

SEQ ID NO: 1641 - protein, 246 aa, Artificial Sequence
  Description of Artificial Sequence: Synthetic polypeptide
  XENP019914 [CTLA-4]_H0_L0.26_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGNSYLAWYQQKPGQAPRLLIYGAFSRATGIPDRFSGSGSGTDFTLTISRLEPEDFAVYYCQQYGSSPWTFGQGTKVEIK

SEQ ID NO: 1642 - protein, 118 aa, Artificial Sequence; identical to SEQ ID NO: 22
  Description of Artificial Sequence: Synthetic polypeptide
  VH of XENP019914

SEQ ID NO: 1643 - protein, 108 aa, Artificial Sequence
  Description of Artificial Sequence: Synthetic polypeptide
  VL of XENP019914
EIVLTQSPGTLSLSPGERATLSCRASQSVGNSYLAWYQQKPGQAPRLLIYGAFSRATGIPDRFSGSGSGTDFTLTISRLEPEDFAVYYCQQYGSSPWTFGQGTKVEIK

SEQ ID NO: 1644 - protein, 5 aa, Artificial Sequence
  Description of Artificial Sequence: Synthetic peptide
  XENP019914 vhCDR1
SYTMH

SEQ ID NO: 1645 - protein, 17 aa, Artificial Sequence
  Description of Artificial Sequence: Synthetic peptide
  XENP019914 vhCDR2
FISYDGNNKYYADSVKG

SEQ ID NO: 1646 - protein, 9 aa, Artificial Sequence
  Description of Artificial Sequence: Synthetic peptide
  XENP019914 vhCDR3
TGWLGPFDY

SEQ ID NO: 1647 - protein, 12 aa, Artificial Sequence
  Description of Artificial Sequence: Synthetic peptide
  XENP019914 vlCDR1
RASQSVGNSYLA

SEQ ID NO: 1648 - protein, 7 aa, Artificial Sequence
  Description of Artificial Sequence: Synthetic peptide
  XENP019914 vlCDR2
GAFSRAT

SEQ ID NO: 1649 - protein, 9 aa, Artificial Sequence
  Description of Artificial Sequence: Synthetic peptide
  XENP019914 vlCDR3
QQYGSSPWT

SEQ ID NO: 1650 - protein, 246 aa, Artificial Sequence
  Description of Artificial Sequence: Synthetic polypeptide
  XENP019915 [CTLA-4]_H0_L0.27_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGQSYLAWYQQKPGQAPRLLIYGAFSRATGIPDRFSGSGSGTDFTLTISRLEPEDFAVYYCQQYGSSPWTFGQGTKVEIK

SEQ ID NO: 1651 - protein, 118 aa, Artificial Sequence; identical to SEQ ID NO: 22
  Description of Artificial Sequence: Synthetic polypeptide
  VH of XENP019915

SEQ ID NO: 1652 - protein, 108 aa, Artificial Sequence
  Description of Artificial Sequence: Synthetic polypeptide
  VL of XENP019915
EIVLTQSPGTLSLSPGERATLSCRASQSVGQSYLAWYQQKPGQAPRLLIYGAFSRATGIPDRFSGSGSGTDFTLTISRLEPEDFAVYYCQQYGSSPWTFGQGTKVEIK

SEQ ID NO: 1653 - protein, 5 aa, Artificial Sequence
  Description of Artificial Sequence: Synthetic peptide
  XENP019915 vhCDR1
SYTMH

SEQ ID NO: 1654 - protein, 17 aa, Artificial Sequence
  Description of Artificial Sequence: Synthetic peptide
  XENP019915 vhCDR2
FISYDGNNKYYADSVKG

SEQ ID NO: 1655 - protein, 9 aa, Artificial Sequence
  Description of Artificial Sequence: Synthetic peptide
  XENP019915 vhCDR3
TGWLGPFDY

SEQ ID NO: 1656 - protein, 12 aa, Artificial Sequence
  Description of Artificial Sequence: Synthetic peptide
  XENP019915 vlCDR1
RASQSVGQSYLA

SEQ ID NO: 1657 - protein, 7 aa, Artificial Sequence
  Description of Artificial Sequence: Synthetic peptide
  XENP019915 vlCDR2
GAFSRAT

SEQ ID NO: 1658 - protein, 9 aa, Artificial Sequence
  Description of Artificial Sequence: Synthetic peptide
  XENP019915 vlCDR3
QQYGSSPWT

SEQ ID NO: 1659 - protein, 246 aa, Artificial Sequence
  Description of Artificial Sequence: Synthetic polypeptide
  XENP019916 [CTLA-4]_H0_L0.28_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGTSYLAWYQQKPGQAPRLLIYGAFSRATGIPDRFSGSGSGTDFTLTISRLEPEDFAVYYCQQYGSSPWTFGQGTKVEIK

SEQ ID NO: 1660 - protein, 118 aa, Artificial Sequence; identical to SEQ ID NO: 22
  Description of Artificial Sequence: Synthetic polypeptide
  VH of XENP019916

SEQ ID NO: 1661 - protein, 108 aa, Artificial Sequence
  Description of Artificial Sequence: Synthetic polypeptide
  VL of XENP019916
EIVLTQSPGTLSLSPGERATLSCRASQSVGTSYLAWYQQKPGQAPRLLIYGAFSRATGIPDRFSGSGSGTDFTLTISRLEPEDFAVYYCQQYGSSPWTFGQGTKVEIK

SEQ ID NO: 1662 - protein, 5 aa, Artificial Sequence
  Description of Artificial Sequence: Synthetic peptide
  XENP019916 vhCDR1
SYTMH

SEQ ID NO: 1663 - protein, 17 aa, Artificial Sequence
  Description of Artificial Sequence: Synthetic peptide
  XENP019916 vhCDR2
FISYDGNNKYYADSVKG

SEQ ID NO: 1664 - protein, 9 aa, Artificial Sequence
  Description of Artificial Sequence: Synthetic peptide
  XENP019916 vhCDR3
TGWLGPFDY

SEQ ID NO: 1665 - protein, 12 aa, Artificial Sequence
  Description of Artificial Sequence: Synthetic peptide
  XENP019916 vlCDR1
RASQSVGTSYLA

SEQ ID NO: 1666 - protein, 7 aa, Artificial Sequence
  Description of Artificial Sequence: Synthetic peptide
  XENP019916 vlCDR2
GAFSRAT

SEQ ID NO: 1667 - protein, 9 aa, Artificial Sequence
  Description of Artificial Sequence: Synthetic peptide
  XENP019916 vlCDR3
QQYGSSPWT

SEQ ID NO: 1668 - protein, 246 aa, Artificial Sequence
  Description of Artificial Sequence: Synthetic polypeptide
  XENP019917 [CTLA-4]_H0_L0.29_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSAYLAWYQQKPGQAPRLLIYGAFSRATGIPDRFSGSGSGTDFTLTISRLEPEDFAVYYCQQYGSSPWTFGQGTKVEIK

SEQ ID NO: 1669 - protein, 118 aa, Artificial Sequence; identical to SEQ ID NO: 22
  Description of Artificial Sequence: Synthetic polypeptide
  VH of XENP019917

SEQ ID NO: 1670 - protein, 108 aa, Artificial Sequence
  Description of Artificial Sequence: Synthetic polypeptide
  VL of XENP019917
EIVLTQSPGTLSLSPGERATLSCRASQSVGSAYLAWYQQKPGQAPRLLIYGAFSRATGIPDRFSGSGSGTDFTLTISRLEPEDFAVYYCQQYGSSPWTFGQGTKVEIK

SEQ ID NO: 1671 - protein, 5 aa, Artificial Sequence
  Description of Artificial Sequence: Synthetic peptide
  XENP019917 vhCDR1
SYTMH

SEQ ID NO: 1672 - protein, 17 aa, Artificial Sequence
  Description of Artificial Sequence: Synthetic peptide
  XENP019917 vhCDR2
FISYDGNNKYYADSVKG

SEQ ID NO: 1673 - protein, 9 aa, Artificial Sequence
  Description of Artificial Sequence: Synthetic peptide
  XENP019917 vhCDR3
TGWLGPFDY

SEQ ID NO: 1674 - protein, 12 aa, Artificial Sequence
  Description of Artificial Sequence: Synthetic peptide
  XENP019917 vlCDR1
RASQSVGSAYLA

SEQ ID NO: 1675 - protein, 7 aa, Artificial Sequence
  Description of Artificial Sequence: Synthetic peptide
  XENP019917 vlCDR2
GAFSRAT

SEQ ID NO: 1676 - protein, 9 aa, Artificial Sequence
  Description of Artificial Sequence: Synthetic peptide
  XENP019917 vlCDR3
QQYGSSPWT

SEQ ID NO: 1677 - protein, 246 aa, Artificial Sequence
  Description of Artificial Sequence: Synthetic polypeptide
  XENP019918 [CTLA-4]_H0_L0.30_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSGYLAWYQQKPGQAPRLLIYGAFSRATGIPDRFSGSGSGTDFTLTISRLEPEDFAVYYCQQYGSSPWTFGQGTKVEIK

SEQ ID NO: 1678 - protein, 118 aa, Artificial Sequence; identical to SEQ ID NO: 22
  Description of Artificial Sequence: Synthetic polypeptide
  VH of XENP019918

SEQ ID NO: 1679 - protein, 108 aa, Artificial Sequence
  Description of Artificial Sequence: Synthetic polypeptide
  VL of XENP019918
EIVLTQSPGTLSLSPGERATLSCRASQSVGSGYLAWYQQKPGQAPRLLIYGAFSRATGIPDRFSGSGSGTDFTLTISRLEPEDFAVYYCQQYGSSPWTFGQGTKVEIK

SEQ ID NO: 1680 - protein, 5 aa, Artificial Sequence
  Description of Artificial Sequence: Synthetic peptide
  XENP019918 vhCDR1
SYTMH

SEQ ID NO: 1681 - protein, 17 aa, Artificial Sequence
  Description of Artificial Sequence: Synthetic peptide
  XENP019918 vhCDR2
FISYDGNNKYYADSVKG

SEQ ID NO: 1682 - protein, 9 aa, Artificial Sequence
  Description of Artificial Sequence: Synthetic peptide
  XENP019918 vhCDR3
TGWLGPFDY

SEQ ID NO: 1683 - protein, 12 aa, Artificial Sequence
  Description of Artificial Sequence: Synthetic peptide
  XENP019918 vlCDR1
RASQSVGSGYLA

SEQ ID NO: 1684 - protein, 7 aa, Artificial Sequence
  Description of Artificial Sequence: Synthetic peptide
  XENP019918 vlCDR2
GAFSRAT

SEQ ID NO: 1685 - protein, 9 aa, Artificial Sequence
  Description of Artificial Sequence: Synthetic peptide
  XENP019918 vlCDR3
QQYGSSPWT

SEQ ID NO: 1686 - protein, 246 aa, Artificial Sequence
  Description of Artificial Sequence: Synthetic polypeptide
  XENP019919 [CTLA-4]_H0_L0.31_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSNYLAWYQQKPGQAPRLLIYGAFSRATGIPDRFSGSGSGTDFTLTISRLEPEDFAVYYCQQYGSSPWTFGQGTKVEIK

SEQ ID NO: 1687 - protein, 118 aa, Artificial Sequence; identical to SEQ ID NO: 22
  Description of Artificial Sequence: Synthetic polypeptide
  VH of XENP019919

SEQ ID NO: 1688 - protein, 108 aa, Artificial Sequence
  Description of Artificial Sequence: Synthetic polypeptide
  VL of XENP019919
EIVLTQSPGTLSLSPGERATLSCRASQSVGSNYLAWYQQKPGQAPRLLIYGAFSRATGIPDRFSGSGSGTDFTLTISRLEPEDFAVYYCQQYGSSPWTFGQGTKVEIK

SEQ ID NO: 1689 - protein, 5 aa, Artificial Sequence
  Description of Artificial Sequence: Synthetic peptide
  XENP019919 vhCDR1
SYTMH

SEQ ID NO: 1690 - protein, 17 aa, Artificial Sequence
  Description of Artificial Sequence: Synthetic peptide
  XENP019919 vhCDR2
FISYDGNNKYYADSVKG

SEQ ID NO: 1691 - protein, 9 aa, Artificial Sequence
  Description of Artificial Sequence: Synthetic peptide
  XENP019919 vhCDR3
TGWLGPFDY

SEQ ID NO: 1692 - protein, 12 aa, Artificial Sequence
  Description of Artificial Sequence: Synthetic peptide
  XENP019919 vlCDR1
RASQSVGSNYLA

SEQ ID NO: 1693 - protein, 7 aa, Artificial Sequence
  Description of Artificial Sequence: Synthetic peptide
  XENP019919 vlCDR2
GAFSRAT

SEQ ID NO: 1694 - protein, 9 aa, Artificial Sequence
  Description of Artificial Sequence: Synthetic peptide
  XENP019919 vlCDR3
QQYGSSPWT

SEQ ID NO: 1695 - protein, 246 aa, Artificial Sequence
  Description of Artificial Sequence: Synthetic polypeptide
  XENP019920 [CTLA-4]_H0_L0.32_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSQYLAWYQQKPGQAPRLLIYGAFSRATGIPDRFSGSGSGTDFTLTISRLEPEDFAVYYCQQYGSSPWTFGQGTKVEIK

SEQ ID NO: 1696 - protein, 118 aa, Artificial Sequence; identical to SEQ ID NO: 22
  Description of Artificial Sequence: Synthetic polypeptide
  VH of XENP019920

SEQ ID NO: 1697 - protein, 108 aa, Artificial Sequence
  Description of Artificial Sequence: Synthetic polypeptide
  VL of XENP019920
EIVLTQSPGTLSLSPGERATLSCRASQSVGSQYLAWYQQKPGQAPRLLIYGAFSRATGIPDRFSGSGSGTDFTLTISRLEPEDFAVYYCQQYGSSPWTFGQGTKVEIK

SEQ ID NO: 1698 - protein, 5 aa, Artificial Sequence
  Description of Artificial Sequence: Synthetic peptide
  XENP019920 vhCDR1
SYTMH

SEQ ID NO: 1699 - protein, 17 aa, Artificial Sequence
  Description of Artificial Sequence: Synthetic peptide
  XENP019920 vhCDR2
FISYDGNNKYYADSVKG

SEQ ID NO: 1700 - protein, 9 aa, Artificial Sequence
  Description of Artificial Sequence: Synthetic peptide
  XENP019920 vhCDR3
TGWLGPFDY

SEQ ID NO: 1701 - protein, 12 aa, Artificial Sequence
  Description of Artificial Sequence: Synthetic peptide
  XENP019920 vlCDR1
RASQSVGSQYLA

SEQ ID NO: 1702 - protein, 7 aa, Artificial Sequence
  Description of Artificial Sequence: Synthetic peptide
  XENP019920 vlCDR2
GAFSRAT

SEQ ID NO: 1703 - protein, 9 aa, Artificial Sequence
  Description of Artificial Sequence: Synthetic peptide
  XENP019920 vlCDR3
QQYGSSPWT

SEQ ID NO: 1704 - protein, 246 aa, Artificial Sequence
  Description of Artificial Sequence: Synthetic polypeptide
  XENP019921 [CTLA-4]_H0_L0.33_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSTYLAWYQQKPGQAPRLLIYGAFSRATGIPDRFSGSGSGTDFTLTISRLEPEDFAVYYCQQYGSSPWTFGQGTKVEIK

SEQ ID NO: 1705 - protein, 118 aa, Artificial Sequence; identical to SEQ ID NO: 22
  Description of Artificial Sequence: Synthetic polypeptide
  VH of XENP019921

SEQ ID NO: 1706 - protein, 108 aa, Artificial Sequence
  Description of Artificial Sequence: Synthetic polypeptide
  VL of XENP019921
EIVLTQSPGTLSLSPGERATLSCRASQSVGSTYLAWYQQKPGQAPRLLIYGAFSRATGIPDRFSGSGSGTDFTLTISRLEPEDFAVYYCQQYGSSPWTFGQGTKVEIK

SEQ ID NO: 1707 - protein, 5 aa, Artificial Sequence
  Description of Artificial Sequence: Synthetic peptide
  XENP019921 vhCDR1
SYTMH

SEQ ID NO: 1708 - protein, 17 aa, Artificial Sequence
  Description of Artificial Sequence: Synthetic peptide
  XENP019921 vhCDR2
FISYDGNNKYYADSVKG

SEQ ID NO: 1709 - protein, 9 aa, Artificial Sequence
  Description of Artificial Sequence: Synthetic peptide
  XENP019921 vhCDR3
TGWLGPFDY

SEQ ID NO: 1710 - protein, 12 aa, Artificial Sequence
  Description of Artificial Sequence: Synthetic peptide
  XENP019921 vlCDR1
RASQSVGSTYLA

SEQ ID NO: 1711 - protein, 7 aa, Artificial Sequence
  Description of Artificial Sequence: Synthetic peptide
  XENP019921 vlCDR2
GAFSRAT

SEQ ID NO: 1712 - protein, 9 aa, Artificial Sequence
  Description of Artificial Sequence: Synthetic peptide
  XENP019921 vlCDR3
QQYGSSPWT

SEQ ID NO: 1713 - protein, 246 aa, Artificial Sequence
  Description of Artificial Sequence: Synthetic polypeptide
  XENP019922 [CTLA-4]_H0_L0.34_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSALAWYQQKPGQAPRLLIYGAFSRATGIPDRFSGSGSGTDFTLTISRLEPEDFAVYYCQQYGSSPWTFGQGTKVEIK

SEQ ID NO: 1714 - protein, 118 aa, Artificial Sequence; identical to SEQ ID NO: 22
  Description of Artificial Sequence: Synthetic polypeptide
  VH of XENP019922

SEQ ID NO: 1715 - protein, 108 aa, Artificial Sequence
  Description of Artificial Sequence: Synthetic polypeptide
  VL of XENP019922
EIVLTQSPGTLSLSPGERATLSCRASQSVGSSALAWYQQKPGQAPRLLIYGAFSRATGIPDRFSGSGSGTDFTLTISRLEPEDFAVYYCQQYGSSPWTFGQGTKVEIK

SEQ ID NO: 1716 - protein, 5 aa, Artificial Sequence
  Description of Artificial Sequence: Synthetic peptide
  XENP019922 vhCDR1
SYTMH

SEQ ID NO: 1717 - protein, 17 aa, Artificial Sequence
  Description of Artificial Sequence: Synthetic peptide
  XENP019922 vhCDR2
FISYDGNNKYYADSVKG

SEQ ID NO: 1718 - protein, 9 aa, Artificial Sequence
  Description of Artificial Sequence: Synthetic peptide
  XENP019922 vhCDR3
TGWLGPFDY

SEQ ID NO: 1719 - protein, 12 aa, Artificial Sequence
  Description of Artificial Sequence: Synthetic peptide
  XENP019922 vlCDR1
RASQSVGSSALA

SEQ ID NO: 1720 - protein, 7 aa, Artificial Sequence
  Description of Artificial Sequence: Synthetic peptide
  XENP019922 vlCDR2
GAFSRAT

SEQ ID NO: 1721 - protein, 9 aa, Artificial Sequence
  Description of Artificial Sequence: Synthetic peptide
  XENP019922 vlCDR3
QQYGSSPWT

SEQ ID NO: 1722 - protein, 246 aa, Artificial Sequence
  Description of Artificial Sequence: Synthetic polypeptide
  XENP019923 [CTLA-4]_H0_L0.35_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSFLAWYQQKPGQAPRLLIYGAFSRATGIPDRFSGSGSGTDFTLTISRLEPEDFAVYYCQQYGSSPWTFGQGTKVEIK

SEQ ID NO: 1723 - protein, 118 aa, Artificial Sequence; identical to SEQ ID NO: 22
  Description of Artificial Sequence: Synthetic polypeptide
  VH of XENP019923

SEQ ID NO: 1724 - protein, 108 aa, Artificial Sequence
  Description of Artificial Sequence: Synthetic polypeptide
  VL of XENP019923
EIVLTQSPGTLSLSPGERATLSCRASQSVGSSFLAWYQQKPGQAPRLLIYGAFSRATGIPDRFSGSGSGTDFTLTISRLEPEDFAVYYCQQYGSSPWTFGQGTKVEIK

SEQ ID NO: 1725 - protein, 5 aa, Artificial Sequence
  Description of Artificial Sequence: Synthetic peptide
  XENP019923 vhCDR1
SYTMH

SEQ ID NO: 1726 - protein, 17 aa, Artificial Sequence
  Description of Artificial Sequence: Synthetic peptide
  XENP019923 vhCDR2
FISYDGNNKYYADSVKG

SEQ ID NO: 1727 - protein, 9 aa, Artificial Sequence
  Description of Artificial Sequence: Synthetic peptide
  XENP019923 vhCDR3
TGWLGPFDY

SEQ ID NO: 1728 - protein, 12 aa, Artificial Sequence
  Description of Artificial Sequence: Synthetic peptide
  XENP019923 vlCDR1
RASQSVGSSFLA

SEQ ID NO: 1729 - protein, 7 aa, Artificial Sequence
  Description of Artificial Sequence: Synthetic peptide
  XENP019923 vlCDR2
GAFSRAT

SEQ ID NO: 1730 - protein, 9 aa, Artificial Sequence
  Description of Artificial Sequence: Synthetic peptide
  XENP019923 vlCDR3
QQYGSSPWT

SEQ ID NO: 1731 - protein, 246 aa, Artificial Sequence
  Description of Artificial Sequence: Synthetic polypeptide
  XENP019924 [CTLA-4]_H0_L0.36_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSHLAWYQQKPGQAPRLLIYGAFSRATGIPDRFSGSGSGTDFTLTISRLEPEDFAVYYCQQYGSSPWTFGQGTKVEIK

SEQ ID NO: 1732 - protein, 118 aa, Artificial Sequence; identical to SEQ ID NO: 22
  Description of Artificial Sequence: Synthetic polypeptide
  VH of XENP019924

SEQ ID NO: 1733 - protein, 108 aa, Artificial Sequence
  Description of Artificial Sequence: Synthetic polypeptide
  VL of XENP019924
EIVLTQSPGTLSLSPGERATLSCRASQSVGSSHLAWYQQKPGQAPRLLIYGAFSRATGIPDRFSGSGSGTDFTLTISRLEPEDFAVYYCQQYGSSPWTFGQGTKVEIK

SEQ ID NO: 1734 - protein, 5 aa, Artificial Sequence
  Description of Artificial Sequence: Synthetic peptide
  XENP019924 vhCDR1
SYTMH

SEQ ID NO: 1735 - protein, 17 aa, Artificial Sequence
  Description of Artificial Sequence: Synthetic peptide
  XENP019924 vhCDR2
FISYDGNNKYYADSVKG

SEQ ID NO: 1736 - protein, 9 aa, Artificial Sequence
  Description of Artificial Sequence: Synthetic peptide
  XENP019924 vhCDR3
TGWLGPFDY

SEQ ID NO: 1737 - protein, 12 aa, Artificial Sequence
  Description of Artificial Sequence: Synthetic peptide
  XENP019924 vlCDR1
RASQSVGSSHLA

SEQ ID NO: 1738 - protein, 7 aa, Artificial Sequence
  Description of Artificial Sequence: Synthetic peptide
  XENP019924 vlCDR2
GAFSRAT

SEQ ID NO: 1739 - protein, 9 aa, Artificial Sequence
  Description of Artificial Sequence: Synthetic peptide
  XENP019924 vlCDR3
QQYGSSPWT

SEQ ID NO: 1740 - protein, 246 aa, Artificial Sequence
  Description of Artificial Sequence: Synthetic polypeptide
  XENP019925 [CTLA-4]_H0_L0.37_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSLLAWYQQKPGQAPRLLIYGAFSRATGIPDRFSGSGSGTDFTLTISRLEPEDFAVYYCQQYGSSPWTFGQGTKVEIK

SEQ ID NO: 1741 - protein, 118 aa, Artificial Sequence; identical to SEQ ID NO: 22
  Description of Artificial Sequence: Synthetic polypeptide
  VH of XENP019925

SEQ ID NO: 1742 - protein, 108 aa, Artificial Sequence
  Description of Artificial Sequence: Synthetic polypeptide
  VL of XENP019925
EIVLTQSPGTLSLSPGERATLSCRASQSVGSSLLAWYQQKPGQAPRLLIYGAFSRATGIPDRFSGSGSGTDFTLTISRLEPEDFAVYYCQQYGSSPWTFGQGTKVEIK

SEQ ID NO: 1743 - protein, 5 aa, Artificial Sequence
  Description of Artificial Sequence: Synthetic peptide
  XENP019925 vhCDR1
SYTMH

SEQ ID NO: 1744 - protein, 17 aa, Artificial Sequence
  Description of Artificial Sequence: Synthetic peptide
  XENP019925 vhCDR2
FISYDGNNKYYADSVKG

SEQ ID NO: 1745 - protein, 9 aa, Artificial Sequence
  Description of Artificial Sequence: Synthetic peptide
  XENP019925 vhCDR3
TGWLGPFDY

SEQ ID NO: 1746 - protein, 12 aa, Artificial Sequence
  Description of Artificial Sequence: Synthetic peptide
  XENP019925 vlCDR1
RASQSVGSSLLA

SEQ ID NO: 1747 - protein, 7 aa, Artificial Sequence
  Description of Artificial Sequence: Synthetic peptide
  XENP019925 vlCDR2
GAFSRAT

SEQ ID NO: 1748 - protein, 9 aa, Artificial Sequence
  Description of Artificial Sequence: Synthetic peptide
  XENP019925 vlCDR3
QQYGSSPWT

SEQ ID NO: 1749 - protein, 246 aa, Artificial Sequence
  Description of Artificial Sequence: Synthetic polypeptide
  XENP019926 [CTLA-4]_H0_L0.38_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSNLAWYQQKPGQAPRLLIYGAFSRATGIPDRFSGSGSGTDFTLTISRLEPEDFAVYYCQQYGSSPWTFGQGTKVEIK

SEQ ID NO: 1750 - protein, 118 aa, Artificial Sequence; identical to SEQ ID NO: 22
  Description of Artificial Sequence: Synthetic polypeptide
  VH of XENP019926

SEQ ID NO: 1751 - protein, 108 aa, Artificial Sequence
  Description of Artificial Sequence: Synthetic polypeptide
  VL of XENP019926
EIVLTQSPGTLSLSPGERATLSCRASQSVGSSNLAWYQQKPGQAPRLLIYGAFSRATGIPDRFSGSGSGTDFTLTISRLEPEDFAVYYCQQYGSSPWTFGQGTKVEIK

SEQ ID NO: 1752 - protein, 5 aa, Artificial Sequence
  Description of Artificial Sequence: Synthetic peptide
  XENP019926 vhCDR1
SYTMH

SEQ ID NO: 1753 - protein, 17 aa, Artificial Sequence
  Description of Artificial Sequence: Synthetic peptide
  XENP019926 vhCDR2
FISYDGNNKYYADSVKG

SEQ ID NO: 1754 - protein, 9 aa, Artificial Sequence
  Description of Artificial Sequence: Synthetic peptide
  XENP019926 vhCDR3
TGWLGPFDY

SEQ ID NO: 1755 - protein, 12 aa, Artificial Sequence
  Description of Artificial Sequence: Synthetic peptide
  XENP019926 vlCDR1
RASQSVGSSNLA

SEQ ID NO: 1756 - protein, 7 aa, Artificial Sequence
  Description of Artificial Sequence: Synthetic peptide
  XENP019926 vlCDR2
GAFSRAT

SEQ ID NO: 1757 - protein, 9 aa, Artificial Sequence
  Description of Artificial Sequence: Synthetic peptide
  XENP019926 vlCDR3
QQYGSSPWT

SEQ ID NO: 1758 - protein, 246 aa, Artificial Sequence
  Description of Artificial Sequence: Synthetic polypeptide
  XENP019927 [CTLA-4]_H0_L0.39_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSSLAWYQQKPGQAPRLLIYGAFSRATGIPDRFSGSGSGTDFTLTISRLEPEDFAVYYCQQYGSSPWTFGQGTKVEIK

SEQ ID NO: 1759 - protein, 118 aa, Artificial Sequence; identical to SEQ ID NO: 22
  Description of Artificial Sequence: Synthetic polypeptide
  VH of XENP019927

SEQ ID NO: 1760 - protein, 108 aa, Artificial Sequence
  Description of Artificial Sequence: Synthetic polypeptide
  VL of XENP019927
EIVLTQSPGTLSLSPGERATLSCRASQSVGSSSLAWYQQKPGQAPRLLIYGAFSRATGIPDRFSGSGSGTDFTLTISRLEPEDFAVYYCQQYGSSPWTFGQGTKVEIK

SEQ ID NO: 1761 - protein, 5 aa, Artificial Sequence
  Description of Artificial Sequence: Synthetic peptide
  XENP019927 vhCDR1
SYTMH

SEQ ID NO: 1762 - protein, 17 aa, Artificial Sequence
  Description of Artificial Sequence: Synthetic peptide
  XENP019927 vhCDR2
FISYDGNNKYYADSVKG

SEQ ID NO: 1763 - protein, 9 aa, Artificial Sequence
  Description of Artificial Sequence: Synthetic peptide
  XENP019927 vhCDR3
TGWLGPFDY

SEQ ID NO: 1764 - protein, 12 aa, Artificial Sequence
  Description of Artificial Sequence: Synthetic peptide
  XENP019927 vlCDR1
RASQSVGSSSLA

SEQ ID NO: 1765 - protein, 7 aa, Artificial Sequence
  Description of Artificial Sequence: Synthetic peptide
  XENP019927 vlCDR2
GAFSRAT

SEQ ID NO: 1766 - protein, 9 aa, Artificial Sequence
  Description of Artificial Sequence: Synthetic peptide
  XENP019927 vlCDR3
QQYGSSPWT

SEQ ID NO: 1767 - protein, 246 aa, Artificial Sequence
  Description of Artificial Sequence: Synthetic polypeptide
  XENP019928 [CTLA-4]_H0_L0.40_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSVLAWYQQKPGQAPRLLIYGAFSRATGIPDRFSGSGSGTDFTLTISRLEPEDFAVYYCQQYGSSPWTFGQGTKVEIK

SEQ ID NO: 1768 - protein, 118 aa, Artificial Sequence; identical to SEQ ID NO: 22
  Description of Artificial Sequence: Synthetic polypeptide
  VH of XENP019928

SEQ ID NO: 1769 - protein, 108 aa, Artificial Sequence
  Description of Artificial Sequence: Synthetic polypeptide
  VL of XENP019928
EIVLTQSPGTLSLSPGERATLSCRASQSVGSSVLAWYQQKPGQAPRLLIYGAFSRATGIPDRFSGSGSGTDFTLTISRLEPEDFAVYYCQQYGSSPWTFGQGTKVEIK

SEQ ID NO: 1770 - protein, 5 aa, Artificial Sequence
  Description of Artificial Sequence: Synthetic peptide
  XENP019928 vhCDR1
SYTMH

SEQ ID NO: 1771 - protein, 17 aa, Artificial Sequence
  Description of Artificial Sequence: Synthetic peptide
  XENP019928 vhCDR2
FISYDGNNKYYADSVKG

SEQ ID NO: 1772 - protein, 9 aa, Artificial Sequence
  Description of Artificial Sequence: Synthetic peptide
  XENP019928 vhCDR3
TGWLGPFDY

SEQ ID NO: 1773 - protein, 12 aa, Artificial Sequence
  Description of Artificial Sequence: Synthetic peptide
  XENP019928 vlCDR1
RASQSVGSSVLA

SEQ ID NO: 1774 - protein, 7 aa, Artificial Sequence
  Description of Artificial Sequence: Synthetic peptide
  XENP019928 vlCDR2
GAFSRAT

SEQ ID NO: 1775 - protein, 9 aa, Artificial Sequence
  Description of Artificial Sequence: Synthetic peptide
  XENP019928 vlCDR3
QQYGSSPWT

SEQ ID NO: 1776 - protein, 246 aa, Artificial Sequence
  Description of Artificial Sequence: Synthetic polypeptide
  XENP019929 [CTLA-4]_H0_L0.41_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYMAWYQQKPGQAPRLLIYGAFSRATGIPDRFSGSGSGTDFTLTISRLEPEDFAVYYCQQYGSSPWTFGQGTKVEIK

SEQ ID NO: 1777 - protein, 118 aa, Artificial Sequence; identical to SEQ ID NO: 22
  Description of Artificial Sequence: Synthetic polypeptide
  VH of XENP019929

SEQ ID NO: 1778 - protein, 108 aa, Artificial Sequence
  Description of Artificial Sequence: Synthetic polypeptide
  VL of XENP019929
EIVLTQSPGTLSLSPGERATLSCRASQSVGSSYMAWYQQKPGQAPRLLIYGAFSRATGIPDRFSGSGSGTDFTLTISRLEPEDFAVYYCQQYGSSPWTFGQGTKVEIK

SEQ ID NO: 1779 - protein, 5 aa, Artificial Sequence
  Description of Artificial Sequence: Synthetic peptide
  XENP019929 vhCDR1
SYTMH

SEQ ID NO: 1780 - protein, 17 aa, Artificial Sequence
  Description of Artificial Sequence: Synthetic peptide
  XENP019929 vhCDR2
FISYDGNNKYYADSVKG

SEQ ID NO: 1781 - protein, 9 aa, Artificial Sequence
  Description of Artificial Sequence: Synthetic peptide
  XENP019929 vhCDR3
TGWLGPFDY

SEQ ID NO: 1782 - protein, 12 aa, Artificial Sequence
  Description of Artificial Sequence: Synthetic peptide
  XENP019929 vlCDR1
RASQSVGSSYMA

SEQ ID NO: 1783 - protein, 7 aa, Artificial Sequence
  Description of Artificial Sequence: Synthetic peptide
  XENP019929 vlCDR2
GAFSRAT

SEQ ID NO: 1784 - protein, 9 aa, Artificial Sequence
  Description of Artificial Sequence: Synthetic peptide
  XENP019929 vlCDR3
QQYGSSPWT

SEQ ID NO: 1785 - protein, 246 aa, Artificial Sequence
  Description of Artificial Sequence: Synthetic polypeptide
  XENP019930 [CTLA-4]_H0_L0.42_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLDWYQQKPGQAPRLLIYGAFSRATGIPDRFSGSGSGTDFTLTISRLEPEDFAVYYCQQYGSSPWTFGQGTKVEIK

SEQ ID NO: 1786 - protein, 118 aa, Artificial Sequence; identical to SEQ ID NO: 22
  Description of Artificial Sequence: Synthetic polypeptide
  VH of XENP019930

SEQ ID NO: 1787 - protein, 108 aa, Artificial Sequence
  Description of Artificial Sequence: Synthetic polypeptide
  VL of XENP019930
EIVLTQSPGTLSLSPGERATLSCRASQSVGSSYLDWYQQKPGQAPRLLIYGAFSRATGIPDRFSGSGSGTDFTLTISRLEPEDFAVYYCQQYGSSPWTFGQGTKVEIK

SEQ ID NO: 1788 - protein, 5 aa, Artificial Sequence
  Description of Artificial Sequence: Synthetic peptide
  XENP019930 vhCDR1
SYTMH

SEQ ID NO: 1789 - protein, 17 aa, Artificial Sequence
  Description of Artificial Sequence: Synthetic peptide
  XENP019930 vhCDR2
FISYDGNNKYYADSVKG

SEQ ID NO: 1790 - protein, 9 aa, Artificial Sequence
  Description of Artificial Sequence: Synthetic peptide
  XENP019930 vhCDR3
TGWLGPFDY

SEQ ID NO: 1791 - protein, 12 aa, Artificial Sequence
  Description of Artificial Sequence: Synthetic peptide
  XENP019930 vlCDR1
RASQSVGSSYLD

SEQ ID NO: 1792 - protein, 7 aa, Artificial Sequence
  Description of Artificial Sequence: Synthetic peptide
  XENP019930 vlCDR2
GAFSRAT

SEQ ID NO: 1793 - protein, 9 aa, Artificial Sequence
  Description of Artificial Sequence: Synthetic peptide
  XENP019930 vlCDR3
QQYGSSPWT

SEQ ID NO: 1794 - protein, 246 aa, Artificial Sequence
  Description of Artificial Sequence: Synthetic polypeptide
  XENP019931 [CTLA-4]_H0_L0.43_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLDWYQQKPGQAPRLLIYGAFSRATGIPDRFSGSGSGTDFTLTISRLEPEDFAVYYCKQYGSSPWTFGQGTKVEIK

SEQ ID NO: 1795 - protein, 118 aa, Artificial Sequence; identical to SEQ ID NO: 22
  Description of Artificial Sequence: Synthetic polypeptide
  VH of XENP019931

SEQ ID NO: 1796 - protein, 108 aa, Artificial Sequence
  Description of Artificial Sequence: Synthetic polypeptide
  VL of XENP019931
EIVLTQSPGTLSLSPGERATLSCRASQSVGSSYLDWYQQKPGQAPRLLIYGAFSRATGIPDRFSGSGSGTDFTLTISRLEPEDFAVYYCKQYGSSPWTFGQGTKVEIK

SEQ ID NO: 1797 - protein, 5 aa, Artificial Sequence
  Description of Artificial Sequence: Synthetic peptide
  XENP019931 vhCDR1
SYTMH

SEQ ID NO: 1798 - protein, 17 aa, Artificial Sequence
  Description of Artificial Sequence: Synthetic peptide
  XENP019931 vhCDR2
FISYDGNNKYYADSVKG

SEQ ID NO: 1799 - protein, 9 aa, Artificial Sequence
  Description of Artificial Sequence: Synthetic peptide
  XENP019931 vhCDR3
TGWLGPFDY

SEQ ID NO: 1800 - protein, 12 aa, Artificial Sequence
  Description of Artificial Sequence: Synthetic peptide
  XENP019931 vlCDR1
RASQSVGSSYLD

SEQ ID NO: 1801 - protein, 7 aa, Artificial Sequence
  Description of Artificial Sequence: Synthetic peptide
  XENP019931 vlCDR2
GAFSRAT

SEQ ID NO: 1802 - protein, 9 aa, Artificial Sequence
  Description of Artificial Sequence: Synthetic peptide
  XENP019931 vlCDR3
KQYGSSPWT

SEQ ID NO: 1803 - protein, 246 aa, Artificial Sequence
  Description of Artificial Sequence: Synthetic polypeptide
  XENP019932 [CTLA-4]_H0_L0.44_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLSWYQQKPGQAPRLLIYGAFSRATGIPDRFSGSGSGTDFTLTISRLEPEDFAVYYCQQYGSSPWTFGQGTKVEIK

SEQ ID NO: 1804 - protein, 118 aa, Artificial Sequence; identical to SEQ ID NO: 22
  Description of Artificial Sequence: Synthetic polypeptide
  VH of XENP019932

SEQ ID NO: 1805 - protein, 108 aa, Artificial Sequence
  Description of Artificial Sequence: Synthetic polypeptide
  VL of XENP019932
EIVLTQSPGTLSLSPGERATLSCRASQSVGSSYLSWYQQKPGQAPRLLIYGAFSRATGIPDRFSGSGSGTDFTLTISRLEPEDFAVYYCQQYGSSPWTFGQGTKVEIK

SEQ ID NO: 1806 - protein, 5 aa, Artificial Sequence
  Description of Artificial Sequence: Synthetic peptide
  XENP019932 vhCDR1
SYTMH

SEQ ID NO: 1807 - protein, 17 aa, Artificial Sequence
  Description of Artificial Sequence: Synthetic peptide
  XENP019932 vhCDR2
FISYDGNNKYYADSVKG

SEQ ID NO: 1808 - protein, 9 aa, Artificial Sequence
  Description of Artificial Sequence: Synthetic peptide
  XENP019932 vhCDR3
TGWLGPFDY

SEQ ID NO: 1809 - protein, 12 aa, Artificial Sequence
  Description of Artificial Sequence: Synthetic peptide
  XENP019932 vlCDR1
RASQSVGSSYLS

SEQ ID NO: 1810 - protein, 7 aa, Artificial Sequence
  Description of Artificial Sequence: Synthetic peptide
  XENP019932 vlCDR2
GAFSRAT

SEQ ID NO: 1811 - protein, 9 aa, Artificial Sequence
  Description of Artificial Sequence: Synthetic peptide
  XENP019932 vlCDR3
QQYGSSPWT

SEQ ID NO: 1812 - protein, 246 aa, Artificial Sequence
  Description of Artificial Sequence: Synthetic polypeptide
  XENP019933 [CTLA-4]_H0_L0.45_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLTWYQQKPGQAPRLLIYGAFSRATGIPDRFSGSGSGTDFTLTISRLEPEDFAVYYCQQYGSSPWTFGQGTKVEIK

SEQ ID NO: 1813 - protein, 118 aa, Artificial Sequence; identical to SEQ ID NO: 22
  Description of Artificial Sequence: Synthetic polypeptide
  VH of XENP019933

SEQ ID NO: 1814 - protein, 108 aa, Artificial Sequence
  Description of Artificial Sequence: Synthetic polypeptide
  VL of XENP019933
EIVLTQSPGTLSLSPGERATLSCRASQSVGSSYLTWYQQKPGQAPRLLIYGAFSRATGIPDRFSGSGSGTDFTLTISRLEPEDFAVYYCQQYGSSPWTFGQGTKVEIK

SEQ ID NO: 1815 - protein, 5 aa, Artificial Sequence
  Description of Artificial Sequence: Synthetic peptide
  XENP019933 vhCDR1
SYTMH

SEQ ID NO: 1816 - protein, 17 aa, Artificial Sequence
  Description of Artificial Sequence: Synthetic peptide
  XENP019933 vhCDR2
FISYDGNNKYYADSVKG

SEQ ID NO: 1817 - protein, 9 aa, Artificial Sequence
  Description of Artificial Sequence: Synthetic peptide
  XENP019933 vhCDR3
TGWLGPFDY

SEQ ID NO: 1818 - protein, 12 aa, Artificial Sequence
  Description of Artificial Sequence: Synthetic peptide
  XENP019933 vlCDR1
RASQSVGSSYLT

SEQ ID NO: 1819 - protein, 7 aa, Artificial Sequence
  Description of Artificial Sequence: Synthetic peptide
  XENP019933 vlCDR2
GAFSRAT

SEQ ID NO: 1820 - protein, 9 aa, Artificial Sequence
  Description of Artificial Sequence: Synthetic peptide
  XENP019933 vlCDR3
QQYGSSPWT

SEQ ID NO: 1821 - protein, 246 aa, Artificial Sequence
  Description of Artificial Sequence: Synthetic polypeptide
  XENP019934 [CTLA-4]_H0_L0.46_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYEQKPGQAPRLLIYGAFSRATGIPDRFSGSGSGTDFTLTISRLEPEDFAVYYCQQYGSSPWTFGQGTKVEIK

SEQ ID NO: 1822 - protein, 118 aa, Artificial Sequence; identical to SEQ ID NO: 22
  Description of Artificial Sequence: Synthetic polypeptide
  VH of XENP019934

SEQ ID NO: 1823 - protein, 108 aa, Artificial Sequence
  Description of Artificial Sequence: Synthetic polypeptide
  VL of XENP019934
EIVLTQSPGTLSLSPGERATLSCRASQSVGSSYLAWYEQKPGQAPRLLIYGAFSRATGIPDRFSGSGSGTDFTLTISRLEPEDFAVYYCQQYGSSPWTFGQGTKVEIK

SEQ ID NO: 1824 - protein, 5 aa, Artificial Sequence
  Description of Artificial Sequence: Synthetic peptide
  XENP019934 vhCDR1
SYTMH

SEQ ID NO: 1825 - protein, 17 aa, Artificial Sequence
  Description of Artificial Sequence: Synthetic peptide
  XENP019934 vhCDR2
FISYDGNNKYYADSVKG

SEQ ID NO: 1826 - protein, 9 aa, Artificial Sequence
  Description of Artificial Sequence: Synthetic peptide
  XENP019934 vhCDR3
TGWLGPFDY

SEQ ID NO: 1827 - protein, 12 aa, Artificial Sequence
  Description of Artificial Sequence: Synthetic peptide
  XENP019934 vlCDR1
RASQSVGSSYLA

SEQ ID NO: 1828 - protein, 7 aa, Artificial Sequence
  Description of Artificial Sequence: Synthetic peptide
  XENP019934 vlCDR2
GAFSRAT

SEQ ID NO: 1829 - protein, 9 aa, Artificial Sequence
  Description of Artificial Sequence: Synthetic peptide
  XENP019934 vlCDR3
QQYGSSPWT

SEQ ID NO: 1830 - protein, 246 aa, Artificial Sequence
  Description of Artificial Sequence: Synthetic polypeptide
  XENP019935 [CTLA-4]_H0_L0.47_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYLQKPGQAPRLLIYGAFSRATGIPDRFSGSGSGTDFTLTISRLEPEDFAVYYCQQYGSSPWTFGQGTKVEIK

SEQ ID NO: 1831 - protein, 118 aa, Artificial Sequence; identical to SEQ ID NO: 22
  Description of Artificial Sequence: Synthetic polypeptide
  VH of XENP019935

SEQ ID NO: 1832 - protein, 108 aa, Artificial Sequence
  Description of Artificial Sequence: Synthetic polypeptide
  VL of XENP019935
EIVLTQSPGTLSLSPGERATLSCRASQSVGSSYLAWYLQKPGQAPRLLIYGAFSRATGIPDRFSGSGSGTDFTLTISRLEPEDFAVYYCQQYGSSPWTFGQGTKVEIK

SEQ ID NO: 1833 - protein, 5 aa, Artificial Sequence
  Description of Artificial Sequence: Synthetic peptide
  XENP019935 vhCDR1
SYTMH

SEQ ID NO: 1834 - protein, 17 aa, Artificial Sequence
  Description of Artificial Sequence: Synthetic peptide
  XENP019935 vhCDR2
FISYDGNNKYYADSVKG

SEQ ID NO: 1835 - protein, 9 aa, Artificial Sequence
  Description of Artificial Sequence: Synthetic peptide
  XENP019935 vhCDR3
TGWLGPFDY

SEQ ID NO: 1836 - protein, 12 aa, Artificial Sequence
  Description of Artificial Sequence: Synthetic peptide
  XENP019935 vlCDR1
RASQSVGSSYLA

SEQ ID NO: 1837 - protein, 7 aa, Artificial Sequence
  Description of Artificial Sequence: Synthetic peptide
  XENP019935 vlCDR2
GAFSRAT

SEQ ID NO: 1838 - protein, 9 aa, Artificial Sequence
  Description of Artificial Sequence: Synthetic peptide
  XENP019935 vlCDR3
QQYGSSPWT

SEQ ID NO: 1839 - protein, 246 aa, Artificial Sequence
  Description of Artificial Sequence: Synthetic polypeptide
  XENP019936 [CTLA-4]_H0_L0.48_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYRQKPGQAPRLLIYGAFSRATGIPDRFSGSGSGTDFTLTISRLEPEDFAVYYCQQYGSSPWTFGQGTKVEIK

SEQ ID NO: 1840 - protein, 118 aa, Artificial Sequence; identical to SEQ ID NO: 22
  Description of Artificial Sequence: Synthetic polypeptide
  VH of XENP019936

SEQ ID NO: 1841 - protein, 108 aa, Artificial Sequence
  Description of Artificial Sequence: Synthetic polypeptide
  VL of XENP019936
EIVLTQSPGTLSLSPGERATLSCRASQSVGSSYLAWYRQKPGQAPRLLIYGAFSRATGIPDRFSGSGSGTDFTLTISRLEPEDFAVYYCQQYGSSPWTFGQGTKVEIK

SEQ ID NO: 1842 - protein, 5 aa, Artificial Sequence
  Description of Artificial Sequence: Synthetic peptide
  XENP019936 vhCDR1
SYTMH

SEQ ID NO: 1843 - protein, 17 aa, Artificial Sequence
  Description of Artificial Sequence: Synthetic peptide
  XENP019936 vhCDR2
FISYDGNNKYYADSVKG

SEQ ID NO: 1844 - protein, 9 aa, Artificial Sequence
  Description of Artificial Sequence: Synthetic peptide
  XENP019936 vhCDR3
TGWLGPFDY

SEQ ID NO: 1845 - protein, 12 aa, Artificial Sequence
  Description of Artificial Sequence: Synthetic peptide
  XENP019936 vlCDR1
RASQSVGSSYLA

SEQ ID NO: 1846 - protein, 7 aa, Artificial Sequence
  Description of Artificial Sequence: Synthetic peptide
  XENP019936 vlCDR2
GAFSRAT

SEQ ID NO: 1847 - protein, 9 aa, Artificial Sequence
  Description of Artificial Sequence: Synthetic peptide
  XENP019936 vlCDR3
QQYGSSPWT

SEQ ID NO: 1848 - protein, 246 aa, Artificial Sequence
  Description of Artificial Sequence: Synthetic polypeptide
  XENP019937 [CTLA-4]_H0_L0.49_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYRQKPGQAPELLIYGAFSRATGIPDRFSGSGSGTDFTLTISRLEPEDFAVYYCQQYGSSPWTFGQGTKVEIK

SEQ ID NO: 1849 - protein, 118 aa, Artificial Sequence; identical to SEQ ID NO: 22
  Description of Artificial Sequence: Synthetic polypeptide
  VH of XENP019937

SEQ ID NO: 1850 - protein, 108 aa, Artificial Sequence
  Description of Artificial Sequence: Synthetic polypeptide
  VL of XENP019937
EIVLTQSPGTLSLSPGERATLSCRASQSVGSSYLAWYRQKPGQAPELLIYGAFSRATGIPDRFSGSGSGTDFTLTISRLEPEDFAVYYCQQYGSSPWTFGQGTKVEIK

SEQ ID NO: 1851 - protein, 5 aa, Artificial Sequence
  Description of Artificial Sequence: Synthetic peptide
  XENP019937 vhCDR1
SYTMH

SEQ ID NO: 1852 - protein, 17 aa, Artificial Sequence
  Description of Artificial Sequence: Synthetic peptide
  XENP019937 vhCDR2
FISYDGNNKYYADSVKG

SEQ ID NO: 1853 - protein, 9 aa, Artificial Sequence
  Description of Artificial Sequence: Synthetic peptide
  XENP019937 vhCDR3
TGWLGPFDY

SEQ ID NO: 1854 - protein, 12 aa, Artificial Sequence
  Description of Artificial Sequence: Synthetic peptide
  XENP019937 vlCDR1
RASQSVGSSYLA

SEQ ID NO: 1855 - protein, 7 aa, Artificial Sequence
  Description of Artificial Sequence: Synthetic peptide
  XENP019937 vlCDR2
GAFSRAT

SEQ ID NO: 1856 - protein, 9 aa, Artificial Sequence
  Description of Artificial Sequence: Synthetic peptide
  XENP019937 vlCDR3
QQYGSSPWT

SEQ ID NO: 1857 - protein, 246 aa, Artificial Sequence
  Description of Artificial Sequence: Synthetic polypeptide
  XENP019938 [CTLA-4]_H0_L0.50_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIK

SEQ ID NO: 1858 - protein, 118 aa, Artificial Sequence; identical to SEQ ID NO: 22
  Description of Artificial Sequence: Synthetic polypeptide
  VH of XENP019938

SEQ ID NO: 1859 - protein, 108 aa, Artificial Sequence; identical to SEQ ID NO: 32
  Description of Artificial Sequence: Synthetic polypeptide
  VL of XENP019938

SEQ ID NO: 1860 - protein, 5 aa, Artificial Sequence
  Description of Artificial Sequence: Synthetic peptide
  XENP019938 vhCDR1
SYTMH

SEQ ID NO: 1861 - protein, 17 aa, Artificial Sequence
  Description of Artificial Sequence: Synthetic peptide
  XENP019938 vhCDR2
FISYDGNNKYYADSVKG

SEQ ID NO: 1862 - protein, 9 aa, Artificial Sequence
  Description of Artificial Sequence: Synthetic peptide
  XENP019938 vhCDR3
TGWLGPFDY

SEQ ID NO: 1863 - protein, 12 aa, Artificial Sequence
  Description of Artificial Sequence: Synthetic peptide
  XENP019938 vlCDR1
RASQSVGSSYLA

SEQ ID NO: 1864 - protein, 7 aa, Artificial Sequence
  Description of Artificial Sequence: Synthetic peptide
  XENP019938 vlCDR2
GAFSRAT

SEQ ID NO: 1865 - protein, 9 aa, Artificial Sequence
  Description of Artificial Sequence: Synthetic peptide
  XENP019938 vlCDR3
QQYGSSPWT

SEQ ID NO: 1866 - protein, 246 aa, Artificial Sequence
  Description of Artificial Sequence: Synthetic polypeptide
  XENP019939 [CTLA-4]_H0_L0.51_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPDQAPRLLIYGAFSRATGIPDRFSGSGSGTDFTLTISRLEPEDFAVYYCQQYGSSPWTFGQGTKVEIK

SEQ ID NO: 1867 - protein, 118 aa, Artificial Sequence; identical to SEQ ID NO: 22
  Description of Artificial Sequence: Synthetic polypeptide
  VH of XENP019939

SEQ ID NO: 1868 - protein, 108 aa, Artificial Sequence; identical to SEQ ID NO: 41
  Description of Artificial Sequence: Synthetic polypeptide
  VL of XENP019939

SEQ ID NO: 1869 - protein, 5 aa, Artificial Sequence
  Description of Artificial Sequence: Synthetic peptide
  XENP019939 vhCDR1
SYTMH

SEQ ID NO: 1870 - protein, 17 aa, Artificial Sequence
  Description of Artificial Sequence: Synthetic peptide
  XENP019939 vhCDR2
FISYDGNNKYYADSVKG

SEQ ID NO: 1871 - protein, 9 aa, Artificial Sequence
  Description of Artificial Sequence: Synthetic peptide
  XENP019939 vhCDR3
TGWLGPFDY

SEQ ID NO: 1872 - protein, 12 aa, Artificial Sequence
  Description of Artificial Sequence: Synthetic peptide
  XENP019939 vlCDR1
RASQSVGSSYLA

SEQ ID NO: 1873 - protein, 7 aa, Artificial Sequence
  Description of Artificial Sequence: Synthetic peptide
  XENP019939 vlCDR2
GAFSRAT

SEQ ID NO: 1874 - protein, 9 aa, Artificial Sequence
  Description of Artificial Sequence: Synthetic peptide
  XENP019939 vlCDR3
QQYGSSPWT

SEQ ID NO: 1875 - protein, 246 aa, Artificial Sequence
  Description of Artificial Sequence: Synthetic polypeptide
  XENP019940 [CTLA-4]_H0_L0.52_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPEQAPRLLIYGAFSRATGIPDRFSGSGSGTDFTLTISRLEPEDFAVYYCQQYGSSPWTFGQGTKVEIK

SEQ ID NO: 1876 - protein, 118 aa, Artificial Sequence; identical to SEQ ID NO: 22
  Description of Artificial Sequence: Synthetic polypeptide
  VH of XENP019940

SEQ ID NO: 1877 - protein, 108 aa, Artificial Sequence
  Description of Artificial Sequence: Synthetic polypeptide
  VL of XENP019940
EIVLTQSPGTLSLSPGERATLSCRASQSVGSSYLAWYQQKPEQAPRLLIYGAFSRATGIPDRFSGSGSGTDFTLTISRLEPEDFAVYYCQQYGSSPWTFGQGTKVEIK

SEQ ID NO: 1878 - protein, 5 aa, Artificial Sequence
  Description of Artificial Sequence: Synthetic peptide
  XENP019940 vhCDR1
SYTMH

SEQ ID NO: 1879 - protein, 17 aa, Artificial Sequence
  Description of Artificial Sequence: Synthetic peptide
  XENP019940 vhCDR2
FISYDGNNKYYADSVKG

SEQ ID NO: 1880 - protein, 9 aa, Artificial Sequence
  Description of Artificial Sequence: Synthetic peptide
  XENP019940 vhCDR3
TGWLGPFDY

SEQ ID NO: 1881 - protein, 12 aa, Artificial Sequence
  Description of Artificial Sequence: Synthetic peptide
  XENP019940 vlCDR1
RASQSVGSSYLA

SEQ ID NO: 1882 - protein, 7 aa, Artificial Sequence
  Description of Artificial Sequence: Synthetic peptide
  XENP019940 vlCDR2
GAFSRAT

SEQ ID NO: 1883 - protein, 9 aa, Artificial Sequence
  Description of Artificial Sequence: Synthetic peptide
  XENP019940 vlCDR3
QQYGSSPWT

SEQ ID NO: 1884 - protein, 246 aa, Artificial Sequence
  Description of Artificial Sequence: Synthetic polypeptide
  XENP019941 [CTLA-4]_H0_L0.53_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGEAPRLLIYGAFSRATGIPDRFSGSGSGTDFTLTISRLEPEDFAVYYCQQYGSSPWTFGQGTKVEIK

SEQ ID NO: 1885 - protein, 118 aa, Artificial Sequence; identical to SEQ ID NO: 22
  Description of Artificial Sequence: Synthetic polypeptide
  VH of XENP019941

SEQ ID NO: 1886 - protein, 108 aa, Artificial Sequence; identical to SEQ ID NO: 77
  Description of Artificial Sequence: Synthetic polypeptide
  VL of XENP019941

SEQ ID NO: 1887 - protein, 5 aa, Artificial Sequence
  Description of Artificial Sequence: Synthetic peptide
  XENP019941 vhCDR1
SYTMH

SEQ ID NO: 1888 - protein, 17 aa, Artificial Sequence
  Description of Artificial Sequence: Synthetic peptide
  XENP019941 vhCDR2
FISYDGNNKYYADSVKG

SEQ ID NO: 1889 - protein, 9 aa, Artificial Sequence
  Description of Artificial Sequence: Synthetic peptide
  XENP019941 vhCDR3
TGWLGPFDY

SEQ ID NO: 1890 - protein, 12 aa, Artificial Sequence
  Description of Artificial Sequence: Synthetic peptide
  XENP019941 vlCDR1
RASQSVGSSYLA

SEQ ID NO: 1891 - protein, 7 aa, Artificial Sequence
  Description of Artificial Sequence: Synthetic peptide
  XENP019941 vlCDR2
GAFSRAT

SEQ ID NO: 1892 - protein, 9 aa, Artificial Sequence
  Description of Artificial Sequence: Synthetic peptide
  XENP019941 vlCDR3
QQYGSSPWT

SEQ ID NO: 1893 - protein, 246 aa, Artificial Sequence
  Description of Artificial Sequence: Synthetic polypeptide
  XENP019942 [CTLA-4]_H0_L0.54_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGKAPRLLIYGAFSRATGIPDRFSGSGSGTDFTLTISRLEPEDFAVYYCQQYGSSPWTFGQGTKVEIK

SEQ ID NO: 1894 - protein, 118 aa, Artificial Sequence; identical to SEQ ID NO: 22
  Description of Artificial Sequence: Synthetic polypeptide
  VH of XENP019942

SEQ ID NO: 1895 - protein, 108 aa, Artificial Sequence
  Description of Artificial Sequence: Synthetic polypeptide
  VL of XENP019942
EIVLTQSPGTLSLSPGERATLSCRASQSVGSSYLAWYQQKPGKAPRLLIYGAFSRATGIPDRFSGSGSGTDFTLTISRLEPEDFAVYYCQQYGSSPWTFGQGTKVEIK

SEQ ID NO: 1896 - protein, 5 aa, Artificial Sequence
  Description of Artificial Sequence: Synthetic peptide
  XENP019942 vhCDR1
SYTMH

SEQ ID NO: 1897 - protein, 17 aa, Artificial Sequence
  Description of Artificial Sequence: Synthetic peptide
  XENP019942 vhCDR2
FISYDGNNKYYADSVKG

SEQ ID NO: 1898 - protein, 9 aa, Artificial Sequence
  Description of Artificial Sequence: Synthetic peptide
  XENP019942 vhCDR3
TGWLGPFDY

SEQ ID NO: 1899 - protein, 12 aa, Artificial Sequence
  Description of Artificial Sequence: Synthetic peptide
  XENP019942 vlCDR1
RASQSVGSSYLA

SEQ ID NO: 1900 - protein, 7 aa, Artificial Sequence
  Description of Artificial Sequence: Synthetic peptide
  XENP019942 vlCDR2
GAFSRAT

SEQ ID NO: 1901 - protein, 9 aa, Artificial Sequence
  Description of Artificial Sequence: Synthetic peptide
  XENP019942 vlCDR3
QQYGSSPWT

SEQ ID NO: 1902 - protein, 246 aa, Artificial Sequence
  Description of Artificial Sequence: Synthetic polypeptide
  XENP019943 [CTLA-4]_H0_L0.55_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGKSPRLLIYGAFSRATGIPDRFSGSGSGTDFTLTISRLEPEDFAVYYCQQYGSSPWTFGQGTKVEIK

SEQ ID NO: 1903 - protein, 118 aa, Artificial Sequence; identical to SEQ ID NO: 22
  Description of Artificial Sequence: Synthetic polypeptide
  VH of XENP019943

SEQ ID NO: 1904 - protein, 108 aa, Artificial Sequence
  Description of Artificial Sequence: Synthetic polypeptide
  VL of XENP019943
EIVLTQSPGTLSLSPGERATLSCRASQSVGSSYLAWYQQKPGKSPRLLIYGAFSRATGIPDRFSGSGSGTDFTLTISRLEPEDFAVYYCQQYGSSPWTFGQGTKVEIK

SEQ ID NO: 1905 - protein, 5 aa, Artificial Sequence
  Description of Artificial Sequence: Synthetic peptide
  XENP019943 vhCDR1
SYTMH

SEQ ID NO: 1906 - protein, 17 aa, Artificial Sequence
  Description of Artificial Sequence: Synthetic peptide
  XENP019943 vhCDR2
FISYDGNNKYYADSVKG

SEQ ID NO: 1907 - protein, 9 aa, Artificial Sequence
  Description of Artificial Sequence: Synthetic peptide
  XENP019943 vhCDR3
TGWLGPFDY

SEQ ID NO: 1908 - protein, 12 aa, Artificial Sequence
  Description of Artificial Sequence: Synthetic peptide
  XENP019943 vlCDR1
RASQSVGSSYLA

SEQ ID NO: 1909 - protein, 7 aa, Artificial Sequence
  Description of Artificial Sequence: Synthetic peptide
  XENP019943 vlCDR2
GAFSRAT

SEQ ID NO: 1910 - protein, 9 aa, Artificial Sequence
  Description of Artificial Sequence: Synthetic peptide
  XENP019943 vlCDR3
QQYGSSPWT

SEQ ID NO: 1911 - protein, 246 aa, Artificial Sequence
  Description of Artificial Sequence: Synthetic polypeptide
  XENP019944 [CTLA-4]_H0_L0.56_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQSPRLLIYGAFSRATGIPDRFSGSGSGTDFTLTISRLEPEDFAVYYCQQYGSSPWTFGQGTKVEIK

SEQ ID NO: 1912 - protein, 118 aa, Artificial Sequence; identical to SEQ ID NO: 22
  Description of Artificial Sequence: Synthetic polypeptide
  VH of XENP019944

SEQ ID NO: 1913 - protein, 108 aa, Artificial Sequence
  Description of Artificial Sequence: Synthetic polypeptide
  VL of XENP019944
EIVLTQSPGTLSLSPGERATLSCRASQSVGSSYLAWYQQKPGQSPRLLIYGAFSRATGIPDRFSGSGSGTDFTLTISRLEPEDFAVYYCQQYGSSPWTFGQGTKVEIK

SEQ ID NO: 1914 - protein, 5 aa, Artificial Sequence
  Description of Artificial Sequence: Synthetic peptide
  XENP019944 vhCDR1
SYTMH

SEQ ID NO: 1915 - protein, 17 aa, Artificial Sequence
  Description of Artificial Sequence: Synthetic peptide
  XENP019944 vhCDR2
FISYDGNNKYYADSVKG

SEQ ID NO: 1916 - protein, 9 aa, Artificial Sequence
  Description of Artificial Sequence: Synthetic peptide
  XENP019944 vhCDR3
TGWLGPFDY

SEQ ID NO: 1917 - protein, 12 aa, Artificial Sequence
  Description of Artificial Sequence: Synthetic peptide
  XENP019944 vlCDR1
RASQSVGSSYLA

SEQ ID NO: 1918 - protein, 7 aa, Artificial Sequence
  Description of Artificial Sequence: Synthetic peptide
  XENP019944 vlCDR2
GAFSRAT

SEQ ID NO: 1919 - protein, 9 aa, Artificial Sequence
  Description of Artificial Sequence: Synthetic peptide
  XENP019944 vlCDR3
QQYGSSPWT

SEQ ID NO: 1920 - protein, 246 aa, Artificial Sequence
  Description of Artificial Sequence: Synthetic polypeptide
  XENP019945 [CTLA-4]_H0_L0.57_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPELLIYGAFSRATGIPDRFSGSGSGTDFTLTISRLEPEDFAVYYCQQYGSSPWTFGQGTKVEIK

SEQ ID NO: 1921 - protein, 118 aa, Artificial Sequence; identical to SEQ ID NO: 22
  Description of Artificial Sequence: Synthetic polypeptide
  VH of XENP019945

SEQ ID NO: 1922 - protein, 108 aa, Artificial Sequence; identical to SEQ ID NO: 86
  Description of Artificial Sequence: Synthetic polypeptide
  VL of XENP019945

SEQ ID NO: 1923 - protein, 5 aa, Artificial Sequence
  Description of Artificial Sequence: Synthetic peptide
  XENP019945 vhCDR1
SYTMH

SEQ ID NO: 1924 - protein, 17 aa, Artificial Sequence
  Description of Artificial Sequence: Synthetic peptide
  XENP019945 vhCDR2
FISYDGNNKYYADSVKG

SEQ ID NO: 1925 - protein, 9 aa, Artificial Sequence
  Description of Artificial Sequence: Synthetic peptide
  XENP019945 vhCDR3
TGWLGPFDY

SEQ ID NO: 1926 - protein, 12 aa, Artificial Sequence
  Description of Artificial Sequence: Synthetic peptide
  XENP019945 vlCDR1
RASQSVGSSYLA

SEQ ID NO: 1927 - protein, 7 aa, Artificial Sequence
  Description of Artificial Sequence: Synthetic peptide
  XENP019945 vlCDR2
GAFSRAT

SEQ ID NO: 1928 - protein, 9 aa, Artificial Sequence
  Description of Artificial Sequence: Synthetic peptide
  XENP019945 vlCDR3
QQYGSSPWT

SEQ ID NO: 1929 - protein, 246 aa, Artificial Sequence
  Description of Artificial Sequence: Synthetic polypeptide
  XENP019946 [CTLA-4]_H0_L0.58_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPELLIYGAFSRATGIPDRFSGSGSGTDFTLTISRLEPQDFAVYYCQQYGSSPWTFGQGTKVEIK

SEQ ID NO: 1930 - protein, 118 aa, Artificial Sequence; identical to SEQ ID NO: 22
  Description of Artificial Sequence: Synthetic polypeptide
  VH of XENP019946

SEQ ID NO: 1931 - protein, 108 aa, Artificial Sequence
  Description of Artificial Sequence: Synthetic polypeptide
  VL of XENP019946
EIVLTQSPGTLSLSPGERATLSCRASQSVGSSYLAWYQQKPGQAPELLIYGAFSRATGIPDRFSGSGSGTDFTLTISRLEPQDFAVYYCQQYGSSPWTFGQGTKVEIK

SEQ ID NO: 1932 - protein, 5 aa, Artificial Sequence
  Description of Artificial Sequence: Synthetic peptide
  XENP019946 vhCDR1
SYTMH

SEQ ID NO: 1933 - protein, 17 aa, Artificial Sequence
  Description of Artificial Sequence: Synthetic peptide
  XENP019946 vhCDR2
FISYDGNNKYYADSVKG

SEQ ID NO: 1934 - protein, 9 aa, Artificial Sequence
  Description of Artificial Sequence: Synthetic peptide
  XENP019946 vhCDR3
TGWLGPFDY

SEQ ID NO: 1935 - protein, 12 aa, Artificial Sequence
  Description of Artificial Sequence: Synthetic peptide
  XENP019946 vlCDR1
RASQSVGSSYLA

SEQ ID NO: 1936 - protein, 7 aa, Artificial Sequence
  Description of Artificial Sequence: Synthetic peptide
  XENP019946 vlCDR2
GAFSRAT

SEQ ID NO: 1937 - protein, 9 aa, Artificial Sequence
  Description of Artificial Sequence: Synthetic peptide
  XENP019946 vlCDR3
QQYGSSPWT

SEQ ID NO: 1938 - protein, 246 aa, Artificial Sequence
  Description of Artificial Sequence: Synthetic polypeptide
  XENP019947 [CTLA-4]_H0_L0.59_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPKLLIYGAFSRATGIPDRFSGSGSGTDFTLTISRLEPEDFAVYYCQQYGSSPWTFGQGTKVEIK

SEQ ID NO: 1939 - protein, 118 aa, Artificial Sequence; identical to SEQ ID NO: 22
  Description of Artificial Sequence: Synthetic polypeptide
  VH of XENP019947

SEQ ID NO: 1940 - protein, 108 aa, Artificial Sequence
  Description of Artificial Sequence: Synthetic polypeptide
  VL of XENP019947
EIVLTQSPGTLSLSPGERATLSCRASQSVGSSYLAWYQQKPGQAPKLLIYGAFSRATGIPDRFSGSGSGTDFTLTISRLEPEDFAVYYCQQYGSSPWTFGQGTKVEIK

SEQ ID NO: 1941 - protein, 5 aa, Artificial Sequence
  Description of Artificial Sequence: Synthetic peptide
  XENP019947 vhCDR1
SYTMH

SEQ ID NO: 1942 - protein, 17 aa, Artificial Sequence
  Description of Artificial Sequence: Synthetic peptide
  XENP019947 vhCDR2
FISYDGNNKYYADSVKG

SEQ ID NO: 1943 - protein, 9 aa, Artificial Sequence
  Description of Artificial Sequence: Synthetic peptide
  XENP019947 vhCDR3
TGWLGPFDY

SEQ ID NO: 1944 - protein, 12 aa, Artificial Sequence
  Description of Artificial Sequence: Synthetic peptide
  XENP019947 vlCDR1
RASQSVGSSYLA

SEQ ID NO: 1945 - protein, 7 aa, Artificial Sequence
  Description of Artificial Sequence: Synthetic peptide
  XENP019947 vlCDR2
GAFSRAT

SEQ ID NO: 1946 - protein, 9 aa, Artificial Sequence
  Description of Artificial Sequence: Synthetic peptide
  XENP019947 vlCDR3
QQYGSSPWT

SEQ ID NO: 1947 - protein, 246 aa, Artificial Sequence
  Description of Artificial Sequence: Synthetic polypeptide
  XENP019948 [CTLA-4]_H0_L0.60_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRRLIYGAFSRATGIPDRFSGSGSGTDFTLTISRLEPEDFAVYYCQQYGSSPWTFGQGTKVEIK

SEQ ID NO: 1948 - protein, 118 aa, Artificial Sequence; identical to SEQ ID NO: 22
  Description of Artificial Sequence: Synthetic polypeptide
  VH of XENP019948

SEQ ID NO: 1949 - protein, 108 aa, Artificial Sequence
  Description of Artificial Sequence: Synthetic polypeptide
  VL of XENP019948
EIVLTQSPGTLSLSPGERATLSCRASQSVGSSYLAWYQQKPGQAPRRLIYGAFSRATGIPDRFSGSGSGTDFTLTISRLEPEDFAVYYCQQYGSSPWTFGQGTKVEIK

SEQ ID NO: 1950 - protein, 5 aa, Artificial Sequence
  Description of Artificial Sequence: Synthetic peptide
  XENP019948 vhCDR1
SYTMH

SEQ ID NO: 1951 - protein, 17 aa, Artificial Sequence
  Description of Artificial Sequence: Synthetic peptide
  XENP019948 vhCDR2
FISYDGNNKYYADSVKG

SEQ ID NO: 1952 - protein, 9 aa, Artificial Sequence
  Description of Artificial Sequence: Synthetic peptide
  XENP019948 vhCDR3
TGWLGPFDY

SEQ ID NO: 1953 - protein, 12 aa, Artificial Sequence
  Description of Artificial Sequence: Synthetic peptide
  XENP019948 vlCDR1
RASQSVGSSYLA

SEQ ID NO: 1954 - protein, 7 aa, Artificial Sequence
  Description of Artificial Sequence: Synthetic peptide
  XENP019948 vlCDR2
GAFSRAT

SEQ ID NO: 1955 - protein, 9 aa, Artificial Sequence
  Description of Artificial Sequence: Synthetic peptide
  XENP019948 vlCDR3
QQYGSSPWT

SEQ ID NO: 1956 - protein, 246 aa, Artificial Sequence
  Description of Artificial Sequence: Synthetic polypeptide
  XENP019949 [CTLA-4]_H0_L0.61_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRRLIYGAFSRDTGIPDRFSGSGSGTDFTLTISRLEPEDFAVYYCQQYGSSPWTFGQGTKVEIK

SEQ ID NO: 1957 - protein, 118 aa, Artificial Sequence; identical to SEQ ID NO: 22
  Description of Artificial Sequence: Synthetic polypeptide
  VH of XENP019949

SEQ ID NO: 1958 - protein, 108 aa, Artificial Sequence
  Description of Artificial Sequence: Synthetic polypeptide
  VL of XENP019949
EIVLTQSPGTLSLSPGERATLSCRASQSVGSSYLAWYQQKPGQAPRRLIYGAFSRDTGIPDRFSGSGSGTDFTLTISRLEPEDFAVYYCQQYGSSPWTFGQGTKVEIK

SEQ ID NO: 1959 - protein, 5 aa, Artificial Sequence
  Description of Artificial Sequence: Synthetic peptide
  XENP019949 vhCDR1
SYTMH

SEQ ID NO: 1960 - protein, 17 aa, Artificial Sequence
  Description of Artificial Sequence: Synthetic peptide
  XENP019949 vhCDR2
FISYDGNNKYYADSVKG

SEQ ID NO: 1961 - protein, 9 aa, Artificial Sequence
  Description of Artificial Sequence: Synthetic peptide
  XENP019949 vhCDR3
TGWLGPFDY

SEQ ID NO: 1962 - protein, 12 aa, Artificial Sequence
  Description of Artificial Sequence: Synthetic peptide
  XENP019949 vlCDR1
RASQSVGSSYLA

SEQ ID NO: 1963 - protein, 7 aa, Artificial Sequence
  Description of Artificial Sequence: Synthetic peptide
  XENP019949 vlCDR2
GAFSRDT

SEQ ID NO: 1964 - protein, 9 aa, Artificial Sequence
  Description of Artificial Sequence: Synthetic peptide
  XENP019949 vlCDR3
QQYGSSPWT

SEQ ID NO: 1965 - protein, 246 aa, Artificial Sequence
  Description of Artificial Sequence: Synthetic polypeptide
  XENP019950 [CTLA-4]_H0_L0.62_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIAGAFSRATGIPDRFSGSGSGTDFTLTISRLEPEDFAVYYCQQYGSSPWTFGQGTKVEIK

SEQ ID NO: 1966 - protein, 118 aa, Artificial Sequence; identical to SEQ ID NO: 22
  Description of Artificial Sequence: Synthetic polypeptide
  VH of XENP019950

SEQ ID NO: 1967 - protein, 108 aa, Artificial Sequence
  Description of Artificial Sequence: Synthetic polypeptide
  VL of XENP019950
EIVLTQSPGTLSLSPGERATLSCRASQSVGSSYLAWYQQKPGQAPRLLIAGAFSRATGIPDRFSGSGSGTDFTLTISRLEPEDFAVYYCQQYGSSPWTFGQGTKVEIK

SEQ ID NO: 1968 - protein, 5 aa, Artificial Sequence
  Description of Artificial Sequence: Synthetic peptide
  XENP019950 vhCDR1
SYTMH

SEQ ID NO: 1969 - protein, 17 aa, Artificial Sequence
  Description of Artificial Sequence: Synthetic peptide
  XENP019950 vhCDR2
FISYDGNNKYYADSVKG

SEQ ID NO: 1970 - protein, 9 aa, Artificial Sequence
  Description of Artificial Sequence: Synthetic peptide
  XENP019950 vhCDR3
TGWLGPFDY

SEQ ID NO: 1971 - protein, 12 aa, Artificial Sequence
  Description of Artificial Sequence: Synthetic peptide
  XENP019950 vlCDR1
RASQSVGSSYLA

SEQ ID NO: 1972 - protein, 7 aa, Artificial Sequence
  Description of Artificial Sequence: Synthetic peptide
  XENP019950 vlCDR2
GAFSRAT

SEQ ID NO: 1973 - protein, 9 aa, Artificial Sequence
  Description of Artificial Sequence: Synthetic peptide
  XENP019950 vlCDR3
QQYGSSPWT

SEQ ID NO: 1974 - protein, 246 aa, Artificial Sequence
  Description of Artificial Sequence: Synthetic polypeptide
  XENP019951 [CTLA-4]_H0_L0.63_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIFGAFSRATGIPDRFSGSGSGTDFTLTISRLEPEDFAVYYCQQYGSSPWTFGQGTKVEIK

SEQ ID NO: 1975 - protein, 118 aa, Artificial Sequence; identical to SEQ ID NO: 22
  Description of Artificial Sequence: Synthetic polypeptide
  VH of XENP019951

SEQ ID NO: 1976 - protein, 108 aa, Artificial Sequence
  Description of Artificial Sequence: Synthetic polypeptide
  VL of XENP019951
EIVLTQSPGTLSLSPGERATLSCRASQSVGSSYLAWYQQKPGQAPRLLIFGAFSRATGIPDRFSGSGSGTDFTLTISRLEPEDFAVYYCQQYGSSPWTFGQGTKVEIK

SEQ ID NO: 1977 - protein, 5 aa, Artificial Sequence
  Description of Artificial Sequence: Synthetic peptide
  XENP019951 vhCDR1
SYTMH

SEQ ID NO: 1978 - protein, 17 aa, Artificial Sequence
  Description of Artificial Sequence: Synthetic peptide
  XENP019951 vhCDR2
FISYDGNNKYYADSVKG

SEQ ID NO: 1979 - protein, 9 aa, Artificial Sequence
  Description of Artificial Sequence: Synthetic peptide
  XENP019951 vhCDR3
TGWLGPFDY

SEQ ID NO: 1980 - protein, 12 aa, Artificial Sequence
  Description of Artificial Sequence: Synthetic peptide
  XENP019951 vlCDR1
RASQSVGSSYLA

SEQ ID NO: 1981 - protein, 7 aa, Artificial Sequence
  Description of Artificial Sequence: Synthetic peptide
  XENP019951 vlCDR2
GAFSRAT

SEQ ID NO: 1982 - protein, 9 aa, Artificial Sequence
  Description of Artificial Sequence: Synthetic peptide
  XENP019951 vlCDR3
QQYGSSPWT

SEQ ID NO: 1983 - protein, 246 aa, Artificial Sequence
  Description of Artificial Sequence: Synthetic polypeptide
  XENP019952 [CTLA-4]_H0_L0.64_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIHGAFSRATGIPDRFSGSGSGTDFTLTISRLEPEDFAVYYCQQYGSSPWTFGQGTKVEIK

SEQ ID NO: 1984 - protein, 118 aa, Artificial Sequence; identical to SEQ ID NO: 22
  Description of Artificial Sequence: Synthetic polypeptide
  VH of XENP019952

SEQ ID NO: 1985 - protein, 108 aa, Artificial Sequence
  Description of Artificial Sequence: Synthetic polypeptide
  VL of XENP019952
EIVLTQSPGTLSLSPGERATLSCRASQSVGSSYLAWYQQKPGQAPRLLIHGAFSRATGIPDRFSGSGSGTDFTLTISRLEPEDFAVYYCQQYGSSPWTFGQGTKVEIK

SEQ ID NO: 1986 - protein, 5 aa, Artificial Sequence
  Description of Artificial Sequence: Synthetic peptide
  XENP019952 vhCDR1
SYTMH

SEQ ID NO: 1987 - protein, 17 aa, Artificial Sequence
  Description of Artificial Sequence: Synthetic peptide
  XENP019952 vhCDR2
FISYDGNNKYYADSVKG

SEQ ID NO: 1988 - protein, 9 aa, Artificial Sequence
  Description of Artificial Sequence: Synthetic peptide
  XENP019952 vhCDR3
TGWLGPFDY

SEQ ID NO: 1989 - protein, 12 aa, Artificial Sequence
  Description of Artificial Sequence: Synthetic peptide
  XENP019952 vlCDR1
RASQSVGSSYLA

SEQ ID NO: 1990 - protein, 7 aa, Artificial Sequence
  Description of Artificial Sequence: Synthetic peptide
  XENP019952 vlCDR2
GAFSRAT

SEQ ID NO: 1991 - protein, 9 aa, Artificial Sequence
  Description of Artificial Sequence: Synthetic peptide
  XENP019952 vlCDR3
QQYGSSPWT

SEQ ID NO: 1992 - protein, 246 aa, Artificial Sequence
  Description of Artificial Sequence: Synthetic polypeptide
  XENP019953 [CTLA-4]_H0_L0.65_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLILGAFSRATGIPDRFSGSGSGTDFTLTISRLEPEDFAVYYCQQYGSSPWTFGQGTKVEIK

SEQ ID NO: 1993 - protein, 118 aa, Artificial Sequence; identical to SEQ ID NO: 22
  Description of Artificial Sequence: Synthetic polypeptide
  VH of XENP019953

SEQ ID NO: 1994 - protein, 108 aa, Artificial Sequence
  Description of Artificial Sequence: Synthetic polypeptide
  VL of XENP019953
EIVLTQSPGTLSLSPGERATLSCRASQSVGSSYLAWYQQKPGQAPRLLILGAFSRATGIPDRFSGSGSGTDFTLTISRLEPEDFAVYYCQQYGSSPWTFGQGTKVEIK

SEQ ID NO: 1995 - protein, 5 aa, Artificial Sequence
  Description of Artificial Sequence: Synthetic peptide
  XENP019953 vhCDR1
SYTMH

SEQ ID NO: 1996 - protein, 17 aa, Artificial Sequence
  Description of Artificial Sequence: Synthetic peptide
  XENP019953 vhCDR2
FISYDGNNKYYADSVKG

SEQ ID NO: 1997 - protein, 9 aa, Artificial Sequence
  Description of Artificial Sequence: Synthetic peptide
  XENP019953 vhCDR3
TGWLGPFDY

SEQ ID NO: 1998 - protein, 12 aa, Artificial Sequence
  Description of Artificial Sequence: Synthetic peptide
  XENP019953 vlCDR1
RASQSVGSSYLA

SEQ ID NO: 1999 - protein, 7 aa, Artificial Sequence
  Description of Artificial Sequence: Synthetic peptide
  XENP019953 vlCDR2
GAFSRAT

SEQ ID NO: 2000 - protein, 9 aa, Artificial Sequence
  Description of Artificial Sequence: Synthetic peptide
  XENP019953 vlCDR3
QQYGSSPWT

SEQ ID NO: 2001 - protein, 246 aa, Artificial Sequence
  Description of Artificial Sequence: Synthetic polypeptide
  XENP019954 [CTLA-4]_H0_L0.66_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIVGAFSRATGIPDRFSGSGSGTDFTLTISRLEPEDFAVYYCQQYGSSPWTFGQGTKVEIK

SEQ ID NO: 2002 - protein, 118 aa, Artificial Sequence; identical to SEQ ID NO: 22
  Description of Artificial Sequence: Synthetic polypeptide
  VH of XENP019954

SEQ ID NO: 2003 - protein, 108 aa, Artificial Sequence
  Description of Artificial Sequence: Synthetic polypeptide
  VL of XENP019954
EIVLTQSPGTLSLSPGERATLSCRASQSVGSSYLAWYQQKPGQAPRLLIVGAFSRATGIPDRFSGSGSGTDFTLTISRLEPEDFAVYYCQQYGSSPWTFGQGTKVEIK

SEQ ID NO: 2004 - protein, 5 aa, Artificial Sequence
  Description of Artificial Sequence: Synthetic peptide
  XENP019954 vhCDR1
SYTMH

SEQ ID NO: 2005 - protein, 17 aa, Artificial Sequence
  Description of Artificial Sequence: Synthetic peptide
  XENP019954 vhCDR2
FISYDGNNKYYADSVKG

SEQ ID NO: 2006 - protein, 9 aa, Artificial Sequence
  Description of Artificial Sequence: Synthetic peptide
  XENP019954 vhCDR3
TGWLGPFDY

SEQ ID NO: 2007 - protein, 12 aa, Artificial Sequence
  Description of Artificial Sequence: Synthetic peptide
  XENP019954 vlCDR1
RASQSVGSSYLA

SEQ ID NO: 2008 - protein, 7 aa, Artificial Sequence
  Description of Artificial Sequence: Synthetic peptide
  XENP019954 vlCDR2
GAFSRAT

SEQ ID NO: 2009 - protein, 9 aa, Artificial Sequence
  Description of Artificial Sequence: Synthetic peptide
  XENP019954 vlCDR3
QQYGSSPWT

SEQ ID NO: 2010 - protein, 246 aa, Artificial Sequence
  Description of Artificial Sequence: Synthetic polypeptide
  XENP019955 [CTLA-4]_H0_L0.67_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYDAFSRATGIPDRFSGSGSGTDFTLTISRLEPEDFAVYYCQQYGSSPWTFGQGTKVEIK

SEQ ID NO: 2011 - protein, 118 aa, Artificial Sequence; identical to SEQ ID NO: 22
  Description of Artificial Sequence: Synthetic polypeptide
  VH of XENP019955

SEQ ID NO: 2012 - protein, 108 aa, Artificial Sequence
  Description of Artificial Sequence: Synthetic polypeptide
  VL of XENP019955
EIVLTQSPGTLSLSPGERATLSCRASQSVGSSYLAWYQQKPGQAPRLLIYDAFSRATGIPDRFSGSGSGTDFTLTISRLEPEDFAVYYCQQYGSSPWTFGQGTKVEIK

SEQ ID NO: 2013 - protein, 5 aa, Artificial Sequence
  Description of Artificial Sequence: Synthetic peptide
  XENP019955 vhCDR1
SYTMH

SEQ ID NO: 2014 - protein, 17 aa, Artificial Sequence
  Description of Artificial Sequence: Synthetic peptide
  XENP019955 vhCDR2
FISYDGNNKYYADSVKG

SEQ ID NO: 2015 - protein, 9 aa, Artificial Sequence
  Description of Artificial Sequence: Synthetic peptide
  XENP019955 vhCDR3
TGWLGPFDY

SEQ ID NO: 2016 - protein, 12 aa, Artificial Sequence
  Description of Artificial Sequence: Synthetic peptide
  XENP019955 vlCDR1
RASQSVGSSYLA

SEQ ID NO: 2017 - protein, 7 aa, Artificial Sequence
  Description of Artificial Sequence: Synthetic peptide
  XENP019955 vlCDR2
DAFSRAT

SEQ ID NO: 2018 - protein, 9 aa, Artificial Sequence
  Description of Artificial Sequence: Synthetic peptide
  XENP019955 vlCDR3
QQYGSSPWT

SEQ ID NO: 2019 - protein, 246 aa, Artificial Sequence
  Description of Artificial Sequence: Synthetic polypeptide
  XENP019956 [CTLA-4]_H0_L0.68_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYSAFSRATGIPDRFSGSGSGTDFTLTISRLEPEDFAVYYCQQYGSSPWTFGQGTKVEIK

SEQ ID NO: 2020 - protein, 118 aa, Artificial Sequence; identical to SEQ ID NO: 22
  Description of Artificial Sequence: Synthetic polypeptide
  VH of XENP019956

SEQ ID NO: 2021 - protein, 108 aa, Artificial Sequence
  Description of Artificial Sequence: Synthetic polypeptide
  VL of XENP019956
EIVLTQSPGTLSLSPGERATLSCRASQSVGSSYLAWYQQKPGQAPRLLIYSAFSRATGIPDRFSGSGSGTDFTLTISRLEPEDFAVYYCQQYGSSPWTFGQGTKVEIK

SEQ ID NO: 2022 - protein, 5 aa, Artificial Sequence
  Description of Artificial Sequence: Synthetic peptide
  XENP019956 vhCDR1
SYTMH

SEQ ID NO: 2023 - protein, 17 aa, Artificial Sequence
  Description of Artificial Sequence: Synthetic peptide
  XENP019956 vhCDR2
FISYDGNNKYYADSVKG

SEQ ID NO: 2024 - protein, 9 aa, Artificial Sequence
  Description of Artificial Sequence: Synthetic peptide
  XENP019956 vhCDR3
TGWLGPFDY

SEQ ID NO: 2025 - protein, 12 aa, Artificial Sequence
  Description of Artificial Sequence: Synthetic peptide
  XENP019956 vlCDR1
RASQSVGSSYLA

SEQ ID NO: 2026 - protein, 7 aa, Artificial Sequence
  Description of Artificial Sequence: Synthetic peptide
  XENP019956 vlCDR2
SAFSRAT

SEQ ID NO: 2027 - protein, 9 aa, Artificial Sequence
  Description of Artificial Sequence: Synthetic peptide
  XENP019956 vlCDR3
QQYGSSPWT

SEQ ID NO: 2028 - protein, 246 aa, Artificial Sequence
  Description of Artificial Sequence: Synthetic polypeptide
  XENP019957 [CTLA-4]_H0_L0.69_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGVFSRATGIPDRFSGSGSGTDFTLTISRLEPEDFAVYYCQQYGSSPWTFGQGTKVEIK

SEQ ID NO: 2029 - protein, 118 aa, Artificial Sequence; identical to SEQ ID NO: 22
  Description of Artificial Sequence: Synthetic polypeptide
  VH of XENP019957

SEQ ID NO: 2030 - protein, 108 aa, Artificial Sequence
  Description of Artificial Sequence: Synthetic polypeptide
  VL of XENP019957
EIVLTQSPGTLSLSPGERATLSCRASQSVGSSYLAWYQQKPGQAPRLLIYGVFSRATGIPDRFSGSGSGTDFTLTISRLEPEDFAVYYCQQYGSSPWTFGQGTKVEIK

SEQ ID NO: 2031 - protein, 5 aa, Artificial Sequence
  Description of Artificial Sequence: Synthetic peptide
  XENP019957 vhCDR1
SYTMH

SEQ ID NO: 2032 - protein, 17 aa, Artificial Sequence
  Description of Artificial Sequence: Synthetic peptide
  XENP019957 vhCDR2
FISYDGNNKYYADSVKG

SEQ ID NO: 2033 - protein, 9 aa, Artificial Sequence
  Description of Artificial Sequence: Synthetic peptide
  XENP019957 vhCDR3
TGWLGPFDY

SEQ ID NO: 2034 - protein, 12 aa, Artificial Sequence
  Description of Artificial Sequence: Synthetic peptide
  XENP019957 vlCDR1
RASQSVGSSYLA

SEQ ID NO: 2035 - protein, 7 aa, Artificial Sequence
  Description of Artificial Sequence: Synthetic peptide
  XENP019957 vlCDR2
GVFSRAT

SEQ ID NO: 2036 - protein, 9 aa, Artificial Sequence
  Description of Artificial Sequence: Synthetic peptide
  XENP019957 vlCDR3
QQYGSSPWT

SEQ ID NO: 2037 - protein, 246 aa, Artificial Sequence
  Description of Artificial Sequence: Synthetic polypeptide
  XENP019958 [CTLA-4]_H0_L0.70_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAHSRATGIPDRFSGSGSGTDFTLTISRLEPEDFAVYYCQQYGSSPWTFGQGTKVEIK

SEQ ID NO: 2038 - protein, 118 aa, Artificial Sequence; identical to SEQ ID NO: 22
  Description of Artificial Sequence: Synthetic polypeptide
  VH of XENP019958

SEQ ID NO: 2039 - protein, 108 aa, Artificial Sequence
  Description of Artificial Sequence: Synthetic polypeptide
  VL of XENP019958
EIVLTQSPGTLSLSPGERATLSCRASQSVGSSYLAWYQQKPGQAPRLLIYGAHSRATGIPDRFSGSGSGTDFTLTISRLEPEDFAVYYCQQYGSSPWTFGQGTKVEIK

SEQ ID NO: 2040 - protein, 5 aa, Artificial Sequence
  Description of Artificial Sequence: Synthetic peptide
  XENP019958 vhCDR1
SYTMH

SEQ ID NO: 2041 - protein, 17 aa, Artificial Sequence
  Description of Artificial Sequence: Synthetic peptide
  XENP019958 vhCDR2
FISYDGNNKYYADSVKG

SEQ ID NO: 2042 - protein, 9 aa, Artificial Sequence
  Description of Artificial Sequence: Synthetic peptide
  XENP019958 vhCDR3
TGWLGPFDY

SEQ ID NO: 2043 - protein, 12 aa, Artificial Sequence
  Description of Artificial Sequence: Synthetic peptide
  XENP019958 vlCDR1
RASQSVGSSYLA

SEQ ID NO: 2044 - protein, 7 aa, Artificial Sequence
  Description of Artificial Sequence: Synthetic peptide
  XENP019958 vlCDR2
GAHSRAT

SEQ ID NO: 2045 - protein, 9 aa, Artificial Sequence
  Description of Artificial Sequence: Synthetic peptide
  XENP019958 vlCDR3
QQYGSSPWT

SEQ ID NO: 2046 - protein, 246 aa, Artificial Sequence
  Description of Artificial Sequence: Synthetic polypeptide
  XENP019959 [CTLA-4]_H0_L0.71_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAISRATGIPDRFSGSGSGTDFTLTISRLEPEDFAVYYCQQYGSSPWTFGQGTKVEIK

SEQ ID NO: 2047 - protein, 118 aa, Artificial Sequence; identical to SEQ ID NO: 22
  Description of Artificial Sequence: Synthetic polypeptide
  VH of XENP019959

SEQ ID NO: 2048 - protein, 108 aa, Artificial Sequence
  Description of Artificial Sequence: Synthetic polypeptide
  VL of XENP019959
EIVLTQSPGTLSLSPGERATLSCRASQSVGSSYLAWYQQKPGQAPRLLIYGAISRATGIPDRFSGSGSGTDFTLTISRLEPEDFAVYYCQQYGSSPWTFGQGTKVEIK

SEQ ID NO: 2049 - protein, 5 aa, Artificial Sequence
  Description of Artificial Sequence: Synthetic peptide
  XENP019959 vhCDR1
SYTMH

SEQ ID NO: 2050 - protein, 17 aa, Artificial Sequence
  Description of Artificial Sequence: Synthetic peptide
  XENP019959 vhCDR2
FISYDGNNKYYADSVKG

SEQ ID NO: 2051 - protein, 9 aa, Artificial Sequence
  Description of Artificial Sequence: Synthetic peptide
  XENP019959 vhCDR3
TGWLGPFDY

SEQ ID NO: 2052 - protein, 12 aa, Artificial Sequence
  Description of Artificial Sequence: Synthetic peptide
  XENP019959 vlCDR1
RASQSVGSSYLA

SEQ ID NO: 2053 - protein, 7 aa, Artificial Sequence
  Description of Artificial Sequence: Synthetic peptide
  XENP019959 vlCDR2
GAISRAT

SEQ ID NO: 2054 - protein, 9 aa, Artificial Sequence
  Description of Artificial Sequence: Synthetic peptide
  XENP019959 vlCDR3
QQYGSSPWT

SEQ ID NO: 2055 - protein, 246 aa, Artificial Sequence
  Description of Artificial Sequence: Synthetic polypeptide
  XENP019960 [CTLA-4]_H0_L0.72_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGALSRATGIPDRFSGSGSGTDFTLTISRLEPEDFAVYYCQQYGSSPWTFGQGTKVEIK

SEQ ID NO: 2056 - protein, 118 aa, Artificial Sequence; identical to SEQ ID NO: 22
  Description of Artificial Sequence: Synthetic polypeptide
  VH of XENP019960

SEQ ID NO: 2057 - protein, 108 aa, Artificial Sequence
  Description of Artificial Sequence: Synthetic polypeptide
  VL of XENP019960
EIVLTQSPGTLSLSPGERATLSCRASQSVGSSYLAWYQQKPGQAPRLLIYGALSRATGIPDRFSGSGSGTDFTLTISRLEPEDFAVYYCQQYGSSPWTFGQGTKVEIK

SEQ ID NO: 2058 - protein, 5 aa, Artificial Sequence
  Description of Artificial Sequence: Synthetic peptide
  XENP019960 vhCDR1
SYTMH

SEQ ID NO: 2059 - protein, 17 aa, Artificial Sequence
  Description of Artificial Sequence: Synthetic peptide
  XENP019960 vhCDR2
FISYDGNNKYYADSVKG

SEQ ID NO: 2060 - protein, 9 aa, Artificial Sequence
  Description of Artificial Sequence: Synthetic peptide
  XENP019960 vhCDR3
TGWLGPFDY

SEQ ID NO: 2061 - protein, 12 aa, Artificial Sequence
  Description of Artificial Sequence: Synthetic peptide
  XENP019960 vlCDR1
RASQSVGSSYLA

SEQ ID NO: 2062 - protein, 7 aa, Artificial Sequence
  Description of Artificial Sequence: Synthetic peptide
  XENP019960 vlCDR2
GALSRAT

SEQ ID NO: 2063 - protein, 9 aa, Artificial Sequence
  Description of Artificial Sequence: Synthetic peptide
  XENP019960 vlCDR3
QQYGSSPWT

SEQ ID NO: 2064 - protein, 246 aa, Artificial Sequence
  Description of Artificial Sequence: Synthetic polypeptide
  XENP019961 [CTLA-4]_H0_L0.73_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2065 - protein, 118 aa, Artificial Sequence; identical to SEQ ID NO: 22
  Description of Artificial Sequence: Synthetic polypeptide
  VH of XENP019961

SEQ ID NO: 2066 - protein, 108 aa, Artificial Sequence
  Description of Artificial Sequence: Synthetic polypeptide
  VL of XENP019961
EIVLTQSPGTLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2067 - protein, 5 aa, Artificial Sequence
  Description of Artificial Sequence: Synthetic peptide
  XENP019961 vhCDR1
SYTMH

SEQ ID NO: 2068 - protein, 17 aa, Artificial Sequence
  Description of Artificial Sequence: Synthetic peptide
  XENP019961 vhCDR2
FISYDGNNKYYADSVKG

SEQ ID NO: 2069 - protein, 9 aa, Artificial Sequence
  Description of Artificial Sequence: Synthetic peptide
  XENP019961 vhCDR3
TGWLGPFDY

SEQ ID NO: 2070 - protein, 12 aa, Artificial Sequence
  Description of Artificial Sequence: Synthetic peptide
  XENP019961 vlCDR1
RASQSVGSSYLA

SEQ ID NO: 2071 - protein, 7 aa, Artificial Sequence
  Description of Artificial Sequence: Synthetic peptide
  XENP019961 vlCDR2
GASSRAT

SEQ ID NO: 2072 - protein, 9 aa, Artificial Sequence
  Description of Artificial Sequence: Synthetic peptide
  XENP019961 vlCDR3
QQYGSSPWT

SEQ ID NO: 2073 - protein, 246 aa, Artificial Sequence
  Description of Artificial Sequence: Synthetic polypeptide
  XENP019962 [CTLA-4]_H0_L0.74_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIK

SEQ ID NO: 2074 - protein, 118 aa, Artificial Sequence; identical to SEQ ID NO: 22
  Description of Artificial Sequence: Synthetic polypeptide
  VH of XENP019962

SEQ ID NO: 2075 - protein, 108 aa, Artificial Sequence
  Description of Artificial Sequence: Synthetic polypeptide
  VL of XENP019962
EIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIK

SEQ ID NO: 2076 - protein, 5 aa, Artificial Sequence
  Description of Artificial Sequence: Synthetic peptide
  XENP019962 vhCDR1
SYTMH

SEQ ID NO: 2077 - protein, 17 aa, Artificial Sequence
  Description of Artificial Sequence: Synthetic peptide
  XENP019962 vhCDR2
FISYDGNNKYYADSVKG

SEQ ID NO: 2078 - protein, 9 aa, Artificial Sequence
  Description of Artificial Sequence: Synthetic peptide
  XENP019962 vhCDR3
TGWLGPFDY

SEQ ID NO: 2079 - protein, 12 aa, Artificial Sequence
  Description of Artificial Sequence: Synthetic peptide
  XENP019962 vlCDR1
RASQSVGSSYLA

SEQ ID NO: 2080 - protein, 7 aa, Artificial Sequence
  Description of Artificial Sequence: Synthetic peptide
  XENP019962 vlCDR2
GAYSRAT

SEQ ID NO: 2081 - protein, 9 aa, Artificial Sequence
  Description of Artificial Sequence: Synthetic peptide
  XENP019962 vlCDR3
QQYGSSPWT

SEQ ID NO: 2082 - protein, 246 aa, Artificial Sequence
  Description of Artificial Sequence: Synthetic polypeptide
  XENP019963 [CTLA-4]_H0_L0.75_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFARATGIPDRFSGSGSGTDFTLTISRLEPEDFAVYYCQQYGSSPWTFGQGTKVEIK

SEQ ID NO: 2083 - protein, 118 aa, Artificial Sequence; identical to SEQ ID NO: 22
  Description of Artificial Sequence: Synthetic polypeptide
  VH of XENP019963

SEQ ID NO: 2084 - protein, 108 aa, Artificial Sequence
  Description of Artificial Sequence: Synthetic polypeptide
  VL of XENP019963
EIVLTQSPGTLSLSPGERATLSCRASQSVGSSYLAWYQQKPGQAPRLLIYGAFARATGIPDRFSGSGSGTDFTLTISRLEPEDFAVYYCQQYGSSPWTFGQGTKVEIK

SEQ ID NO: 2085 - protein, 5 aa, Artificial Sequence
  Description of Artificial Sequence: Synthetic peptide
  XENP019963 vhCDR1
SYTMH

SEQ ID NO: 2086 - protein, 17 aa, Artificial Sequence
  Description of Artificial Sequence: Synthetic peptide
  XENP019963 vhCDR2
FISYDGNNKYYADSVKG

SEQ ID NO: 2087 - protein, 9 aa, Artificial Sequence
  Description of Artificial Sequence: Synthetic peptide
  XENP019963 vhCDR3
TGWLGPFDY

SEQ ID NO: 2088 - protein, 12 aa, Artificial Sequence
  Description of Artificial Sequence: Synthetic peptide
  XENP019963 vlCDR1
RASQSVGSSYLA

SEQ ID NO: 2089 - protein, 7 aa, Artificial Sequence
  Description of Artificial Sequence: Synthetic peptide
  XENP019963 vlCDR2
GAFARAT

SEQ ID NO: 2090 - protein, 9 aa, Artificial Sequence
  Description of Artificial Sequence: Synthetic peptide
  XENP019963 vlCDR3
QQYGSSPWT

SEQ ID NO: 2091 - protein, 246 aa, Artificial Sequence
  Description of Artificial Sequence: Synthetic polypeptide
  XENP019964 [CTLA-4]_H0_L0.76_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFGRATGIPDRFSGSGSGTDFTLTISRLEPEDFAVYYCQQYGSSPWTFGQGTKVEIK

SEQ ID NO: 2092 - protein, 118 aa, Artificial Sequence; identical to SEQ ID NO: 22
  Description of Artificial Sequence: Synthetic polypeptide
  VH of XENP019964

SEQ ID NO: 2093 - protein, 108 aa, Artificial Sequence
  Description of Artificial Sequence: Synthetic polypeptide
  VL of XENP019964
EIVLTQSPGTLSLSPGERATLSCRASQSVGSSYLAWYQQKPGQAPRLLIYGAFGRATGIPDRFSGSGSGTDFTLTISRLEPEDFAVYYCQQYGSSPWTFGQGTKVEIK

SEQ ID NO: 2094 - protein, 5 aa, Artificial Sequence
  Description of Artificial Sequence: Synthetic peptide
  XENP019964 vhCDR1
SYTMH

SEQ ID NO: 2095 - protein, 17 aa, Artificial Sequence
  Description of Artificial Sequence: Synthetic peptide
  XENP019964 vhCDR2
FISYDGNNKYYADSVKG

SEQ ID NO: 2096 - protein, 9 aa, Artificial Sequence
  Description of Artificial Sequence: Synthetic peptide
  XENP019964 vhCDR3
TGWLGPFDY

SEQ ID NO: 2097 - protein, 12 aa, Artificial Sequence
  Description of Artificial Sequence: Synthetic peptide
  XENP019964 vlCDR1
RASQSVGSSYLA

SEQ ID NO: 2098 - protein, 7 aa, Artificial Sequence
  Description of Artificial Sequence: Synthetic peptide
  XENP019964 vlCDR2
GAFGRAT

SEQ ID NO: 2099 - protein, 9 aa, Artificial Sequence
  Description of Artificial Sequence: Synthetic peptide
  XENP019964 vlCDR3
QQYGSSPWT

SEQ ID NO: 2100 - protein, 246 aa, Artificial Sequence
  Description of Artificial Sequence: Synthetic polypeptide
  XENP019965 [CTLA-4]_H0_L0.77_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFNRATGIPDRFSGSGSGTDFTLTISRLEPEDFAVYYCQQYGSSPWTFGQGTKVEIK

SEQ ID NO: 2101 - protein, 118 aa, Artificial Sequence; identical to SEQ ID NO: 22
  Description of Artificial Sequence: Synthetic polypeptide
  VH of XENP019965

SEQ ID NO: 2102 - protein, 108 aa, Artificial Sequence
  Description of Artificial Sequence: Synthetic polypeptide
  VL of XENP019965
EIVLTQSPGTLSLSPGERATLSCRASQSVGSSYLAWYQQKPGQAPRLLIYGAFNRATGIPDRFSGSGSGTDFTLTISRLEPEDFAVYYCQQYGSSPWTFGQGTKVEIK

SEQ ID NO: 2103 - protein, 5 aa, Artificial Sequence
  Description of Artificial Sequence: Synthetic peptide
  XENP019965 vhCDR1
SYTMH

SEQ ID NO: 2104 - protein, 17 aa, Artificial Sequence
  Description of Artificial Sequence: Synthetic peptide
  XENP019965 vhCDR2
FISYDGNNKYYADSVKG

SEQ ID NO: 2105 - protein, 9 aa, Artificial Sequence
  Description of Artificial Sequence: Synthetic peptide
  XENP019965 vhCDR3
TGWLGPFDY

SEQ ID NO: 2106 - protein, 12 aa, Artificial Sequence
  Description of Artificial Sequence: Synthetic peptide
  XENP019965 vlCDR1
RASQSVGSSYLA

SEQ ID NO: 2107 - protein, 7 aa, Artificial Sequence
  Description of Artificial Sequence: Synthetic peptide
  XENP019965 vlCDR2
GAFNRAT

SEQ ID NO: 2108 - protein, 9 aa, Artificial Sequence
  Description of Artificial Sequence: Synthetic peptide
  XENP019965 vlCDR3
QQYGSSPWT

SEQ ID NO: 2109 - protein, 246 aa, Artificial Sequence
  Description of Artificial Sequence: Synthetic polypeptide
  XENP019966 [CTLA-4]_H0_L0.78_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFQRATGIPDRFSGSGSGTDFTLTISRLEPEDFAVYYCQQYGSSPWTFGQGTKVEIK

SEQ ID NO: 2110 - protein, 118 aa, Artificial Sequence; identical to SEQ ID NO: 22
  Description of Artificial Sequence: Synthetic polypeptide
  VH of XENP019966

SEQ ID NO: 2111 - protein, 108 aa, Artificial Sequence
  Description of Artificial Sequence: Synthetic polypeptide
  VL of XENP019966
EIVLTQSPGTLSLSPGERATLSCRASQSVGSSYLAWYQQKPGQAPRLLIYGAFQRATGIPDRFSGSGSGTDFTLTISRLEPEDFAVYYCQQYGSSPWTFGQGTKVEIK

SEQ ID NO: 2112 - protein, 5 aa, Artificial Sequence
  Description of Artificial Sequence: Synthetic peptide
  XENP019966 vhCDR1
SYTMH

SEQ ID NO: 2113 - protein, 17 aa, Artificial Sequence
  Description of Artificial Sequence: Synthetic peptide
  XENP019966 vhCDR2
FISYDGNNKYYADSVKG

SEQ ID NO: 2114 - protein, 9 aa, Artificial Sequence
  Description of Artificial Sequence: Synthetic peptide
  XENP019966 vhCDR3
TGWLGPFDY

SEQ ID NO: 2115 - protein, 12 aa, Artificial Sequence
  Description of Artificial Sequence: Synthetic peptide
  XENP019966 vlCDR1
RASQSVGSSYLA

SEQ ID NO: 2116 - protein, 7 aa, Artificial Sequence
  Description of Artificial Sequence: Synthetic peptide
  XENP019966 vlCDR2
GAFQRAT

SEQ ID NO: 2117 - protein, 9 aa, Artificial Sequence
  Description of Artificial Sequence: Synthetic peptide
  XENP019966 vlCDR3
QQYGSSPWT

SEQ ID NO: 2118 - protein, 246 aa, Artificial Sequence
  Description of Artificial Sequence: Synthetic polypeptide
  XENP019967 [CTLA-4]_H0_L0.79_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFTRATGIPDRFSGSGSGTDFTLTISRLEPEDFAVYYCQQYGSSPWTFGQGTKVEIK

SEQ ID NO: 2119 - protein, 118 aa, Artificial Sequence; identical to SEQ ID NO: 22
  Description of Artificial Sequence: Synthetic polypeptide
  VH of XENP019967

SEQ ID NO: 2120 - protein, 108 aa, Artificial Sequence
  Description of Artificial Sequence: Synthetic polypeptide
  VL of XENP019967
EIVLTQSPGTLSLSPGERATLSCRASQSVGSSYLAWYQQKPGQAPRLLIYGAFTRATGIPDRFSGSGSGTDFTLTISRLEPEDFAVYYCQQYGSSPWTFGQGTKVEIK

SEQ ID NO: 2121 - protein, 5 aa, Artificial Sequence
  Description of Artificial Sequence: Synthetic peptide
  XENP019967 vhCDR1
SYTMH

SEQ ID NO: 2122 - protein, 17 aa, Artificial Sequence
  Description of Artificial Sequence: Synthetic peptide
  XENP019967 vhCDR2
FISYDGNNKYYADSVKG

SEQ ID NO: 2123 - protein, 9 aa, Artificial Sequence
  Description of Artificial Sequence: Synthetic peptide
  XENP019967 vhCDR3
TGWLGPFDY

SEQ ID NO: 2124 - protein, 12 aa, Artificial Sequence
  Description of Artificial Sequence: Synthetic peptide
  XENP019967 vlCDR1
RASQSVGSSYLA

SEQ ID NO: 2125 - protein, 7 aa, Artificial Sequence
  Description of Artificial Sequence: Synthetic peptide
  XENP019967 vlCDR2
GAFTRAT

SEQ ID NO: 2126 - protein, 9 aa, Artificial Sequence
  Description of Artificial Sequence: Synthetic peptide
  XENP019967 vlCDR3
QQYGSSPWT

SEQ ID NO: 2127 - protein, 246 aa, Artificial Sequence
  Description of Artificial Sequence: Synthetic polypeptide
  XENP019968 [CTLA-4]_H0_L0.80_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRDTGIPDRFSGSGSGTDFTLTISRLEPEDFAVYYCQQYGSSPWTFGQGTKVEIK

SEQ ID NO: 2128 - protein, 118 aa, Artificial Sequence; identical to SEQ ID NO: 22
  Description of Artificial Sequence: Synthetic polypeptide
  VH of XENP019968

SEQ ID NO: 2129 - protein, 108 aa, Artificial Sequence
  Description of Artificial Sequence: Synthetic polypeptide
  VL of XENP019968
EIVLTQSPGTLSLSPGERATLSCRASQSVGSSYLAWYQQKPGQAPRLLIYGAFSRDTGIPDRFSGSGSGTDFTLTISRLEPEDFAVYYCQQYGSSPWTFGQGTKVEIK

SEQ ID NO: 2130 - protein, 5 aa, Artificial Sequence
  Description of Artificial Sequence: Synthetic peptide
  XENP019968 vhCDR1
SYTMH

SEQ ID NO: 2131 - protein, 17 aa, Artificial Sequence
  Description of Artificial Sequence: Synthetic peptide
  XENP019968 vhCDR2
FISYDGNNKYYADSVKG

SEQ ID NO: 2132 - protein, 9 aa, Artificial Sequence
  Description of Artificial Sequence: Synthetic peptide
  XENP019968 vhCDR3
TGWLGPFDY

SEQ ID NO: 2133 - protein, 12 aa, Artificial Sequence
  Description of Artificial Sequence: Synthetic peptide
  XENP019968 vlCDR1
RASQSVGSSYLA

SEQ ID NO: 2134 - protein, 7 aa, Artificial Sequence
  Description of Artificial Sequence: Synthetic peptide
  XENP019968 vlCDR2
GAFSRDT

SEQ ID NO: 2135 - protein, 9 aa, Artificial Sequence
  Description of Artificial Sequence: Synthetic peptide
  XENP019968 vlCDR3
QQYGSSPWT

SEQ ID NO: 2136 - protein, 246 aa, Artificial Sequence
  Description of Artificial Sequence: Synthetic polypeptide
  XENP019969 [CTLA-4]_H0_L0.81_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRASGIPDRFSGSGSGTDFTLTISRLEPEDFAVYYCQQYGSSPWTFGQGTKVEIK

SEQ ID NO: 2137 - protein, 118 aa, Artificial Sequence; identical to SEQ ID NO: 22
  Description of Artificial Sequence: Synthetic polypeptide
  VH of XENP019969

SEQ ID NO: 2138 - protein, 108 aa, Artificial Sequence
  Description of Artificial Sequence: Synthetic polypeptide
  VL of XENP019969
EIVLTQSPGTLSLSPGERATLSCRASQSVGSSYLAWYQQKPGQAPRLLIYGAFSRASGIPDRFSGSGSGTDFTLTISRLEPEDFAVYYCQQYGSSPWTFGQGTKVEIK

SEQ ID NO: 2139 - protein, 5 aa, Artificial Sequence
  Description of Artificial Sequence: Synthetic peptide
  XENP019969 vhCDR1
SYTMH

SEQ ID NO: 2140 - protein, 17 aa, Artificial Sequence
  Description of Artificial Sequence: Synthetic peptide
  XENP019969 vhCDR2
FISYDGNNKYYADSVKG

SEQ ID NO: 2141 - protein, 9 aa, Artificial Sequence
  Description of Artificial Sequence: Synthetic peptide
  XENP019969 vhCDR3
TGWLGPFDY

SEQ ID NO: 2142 - protein, 12 aa, Artificial Sequence
  Description of Artificial Sequence: Synthetic peptide
  XENP019969 vlCDR1
RASQSVGSSYLA

SEQ ID NO: 2143 - protein, 7 aa, Artificial Sequence
  Description of Artificial Sequence: Synthetic peptide
  XENP019969 vlCDR2
GAFSRAS

SEQ ID NO: 2144 - protein, 9 aa, Artificial Sequence
  Description of Artificial Sequence: Synthetic peptide
  XENP019969 vlCDR3
QQYGSSPWT

SEQ ID NO: 2145 - protein, 246 aa, Artificial Sequence
  Description of Artificial Sequence: Synthetic polypeptide
  XENP019970 [CTLA-4]_H0_L0.82_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGVPDRFSGSGSGTDFTLTISRLEPEDFAVYYCQQYGSSPWTFGQGTKVEIK

SEQ ID NO: 2146 - protein, 118 aa, Artificial Sequence; identical to SEQ ID NO: 22
  Description of Artificial Sequence: Synthetic polypeptide
  VH of XENP019970

SEQ ID NO: 2147 - protein, 108 aa, Artificial Sequence
  Description of Artificial Sequence: Synthetic polypeptide
  VL of XENP019970
EIVLTQSPGTLSLSPGERATLSCRASQSVGSSYLAWYQQKPGQAPRLLIYGAFSRATGVPDRFSGSGSGTDFTLTISRLEPEDFAVYYCQQYGSSPWTFGQGTKVEIK

SEQ ID NO: 2148 - protein, 5 aa, Artificial Sequence
  Description of Artificial Sequence: Synthetic peptide
  XENP019970 vhCDR1
SYTMH

SEQ ID NO: 2149 - protein, 17 aa, Artificial Sequence
  Description of Artificial Sequence: Synthetic peptide
  XENP019970 vhCDR2
FISYDGNNKYYADSVKG

SEQ ID NO: 2150 - protein, 9 aa, Artificial Sequence
  Description of Artificial Sequence: Synthetic peptide
  XENP019970 vhCDR3
TGWLGPFDY

SEQ ID NO: 2151 - protein, 12 aa, Artificial Sequence
  Description of Artificial Sequence: Synthetic peptide
  XENP019970 vlCDR1
RASQSVGSSYLA

SEQ ID NO: 2152 - protein, 7 aa, Artificial Sequence
  Description of Artificial Sequence: Synthetic peptide
  XENP019970 vlCDR2
GAFSRAT

SEQ ID NO: 2153 - protein, 9 aa, Artificial Sequence
  Description of Artificial Sequence: Synthetic peptide
  XENP019970 vlCDR3
QQYGSSPWT

SEQ ID NO: 2154 - protein, 246 aa, Artificial Sequence
  Description of Artificial Sequence: Synthetic polypeptide
  XENP019971 [CTLA-4]_H0_L0.83_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPARFSGSGSGTDFTLTISRLEPEDFAVYYCQQYGSSPWTFGQGTKVEIK

SEQ ID NO: 2155 - protein, 118 aa, Artificial Sequence; identical to SEQ ID NO: 22
  Description of Artificial Sequence: Synthetic polypeptide
  VH of XENP019971

SEQ ID NO: 2156 - protein, 108 aa, Artificial Sequence
  Description of Artificial Sequence: Synthetic polypeptide
  VL of XENP019971
EIVLTQSPGTLSLSPGERATLSCRASQSVGSSYLAWYQQKPGQAPRLLIYGAFSRATGIPARFSGSGSGTDFTLTISRLEPEDFAVYYCQQYGSSPWTFGQGTKVEIK

SEQ ID NO: 2157 - protein, 5 aa, Artificial Sequence
  Description of Artificial Sequence: Synthetic peptide
  XENP019971 vhCDR1
SYTMH

SEQ ID NO: 2158 - protein, 17 aa, Artificial Sequence
  Description of Artificial Sequence: Synthetic peptide
  XENP019971 vhCDR2
FISYDGNNKYYADSVKG

SEQ ID NO: 2159 - protein, 9 aa, Artificial Sequence
  Description of Artificial Sequence: Synthetic peptide
  XENP019971 vhCDR3
TGWLGPFDY

SEQ ID NO: 2160 - protein, 12 aa, Artificial Sequence
  Description of Artificial Sequence: Synthetic peptide
  XENP019971 vlCDR1
RASQSVGSSYLA

SEQ ID NO: 2161 - protein, 7 aa, Artificial Sequence
  Description of Artificial Sequence: Synthetic peptide
  XENP019971 vlCDR2
GAFSRAT

SEQ ID NO: 2162 - protein, 9 aa, Artificial Sequence
  Description of Artificial Sequence: Synthetic peptide
  XENP019971 vlCDR3
QQYGSSPWT

SEQ ID NO: 2163 - protein, 246 aa, Artificial Sequence
  Description of Artificial Sequence: Synthetic polypeptide
  XENP019972 [CTLA-4]_H0_L0.84_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSRTDFTLTISRLEPEDFAVYYCQQYGSSPWTFGQGTKVEIK

SEQ ID NO: 2164 - protein, 118 aa, Artificial Sequence; identical to SEQ ID NO: 22
  Description of Artificial Sequence: Synthetic polypeptide
  VH of XENP019972

SEQ ID NO: 2165 - protein, 108 aa, Artificial Sequence
  Description of Artificial Sequence: Synthetic polypeptide
  VL of XENP019972
EIVLTQSPGTLSLSPGERATLSCRASQSVGSSYLAWYQQKPGQAPRLLIYGAFSRATGIPDRFSGSGSRTDFTLTISRLEPEDFAVYYCQQYGSSPWTFGQGTKVEIK

SEQ ID NO: 2166 - protein, 5 aa, Artificial Sequence
  Description of Artificial Sequence: Synthetic peptide
  XENP019972 vhCDR1
SYTMH

SEQ ID NO: 2167 - protein, 17 aa, Artificial Sequence
  Description of Artificial Sequence: Synthetic peptide
  XENP019972 vhCDR2
FISYDGNNKYYADSVKG

SEQ ID NO: 2168 - protein, 9 aa, Artificial Sequence
  Description of Artificial Sequence: Synthetic peptide
  XENP019972 vhCDR3
TGWLGPFDY

SEQ ID NO: 2169 - protein, 12 aa, Artificial Sequence
  Description of Artificial Sequence: Synthetic peptide
  XENP019972 vlCDR1
RASQSVGSSYLA

SEQ ID NO: 2170 - protein, 7 aa, Artificial Sequence
  Description of Artificial Sequence: Synthetic peptide
  XENP019972 vlCDR2
GAFSRAT

SEQ ID NO: 2171 - protein, 9 aa, Artificial Sequence
  Description of Artificial Sequence: Synthetic peptide
  XENP019972 vlCDR3
QQYGSSPWT

SEQ ID NO: 2172 - protein, 246 aa, Artificial Sequence
  Description of Artificial Sequence: Synthetic polypeptide
  XENP019973 [CTLA-4]_H0_L0.85_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTEFTLTISRLEPEDFAVYYCQQYGSSPWTFGQGTKVEIK

SEQ ID NO: 2173 - protein, 118 aa, Artificial Sequence; identical to SEQ ID NO: 22
  Description of Artificial Sequence: Synthetic polypeptide
  VH of XENP019973

SEQ ID NO: 2174 - protein, 108 aa, Artificial Sequence
  Description of Artificial Sequence: Synthetic polypeptide
  VL of XENP019973
EIVLTQSPGTLSLSPGERATLSCRASQSVGSSYLAWYQQKPGQAPRLLIYGAFSRATGIPDRFSGSGSGTEFTLTISRLEPEDFAVYYCQQYGSSPWTFGQGTKVEIK

SEQ ID NO: 2175 - protein, 5 aa, Artificial Sequence
  Description of Artificial Sequence: Synthetic peptide
  XENP019973 vhCDR1
SYTMH

SEQ ID NO: 2176 - protein, 17 aa, Artificial Sequence
  Description of Artificial Sequence: Synthetic peptide
  XENP019973 vhCDR2
FISYDGNNKYYADSVKG

SEQ ID NO: 2177 - protein, 9 aa, Artificial Sequence
  Description of Artificial Sequence: Synthetic peptide
  XENP019973 vhCDR3
TGWLGPFDY

SEQ ID NO: 2178 - protein, 12 aa, Artificial Sequence
  Description of Artificial Sequence: Synthetic peptide
  XENP019973 vlCDR1
RASQSVGSSYLA

SEQ ID NO: 2179 - protein, 7 aa, Artificial Sequence
  Description of Artificial Sequence: Synthetic peptide
  XENP019973 vlCDR2
GAFSRAT

SEQ ID NO: 2180 - protein, 9 aa, Artificial Sequence
  Description of Artificial Sequence: Synthetic peptide
  XENP019973 vlCDR3
QQYGSSPWT

SEQ ID NO: 2181 - protein, 246 aa, Artificial Sequence
  Description of Artificial Sequence: Synthetic polypeptide
  XENP019974 [CTLA-4]_H0_L0.86_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLKISRLEPEDFAVYYCQQYGSSPWTFGQGTKVEIK

SEQ ID NO: 2182 - protein, 118 aa, Artificial Sequence; identical to SEQ ID NO: 22
  Description of Artificial Sequence: Synthetic polypeptide
  VH of XENP019974

SEQ ID NO: 2183 - protein, 108 aa, Artificial Sequence
  Description of Artificial Sequence: Synthetic polypeptide
  VL of XENP019974
EIVLTQSPGTLSLSPGERATLSCRASQSVGSSYLAWYQQKPGQAPRLLIYGAFSRATGIPDRFSGSGSGTDFTLKISRLEPEDFAVYYCQQYGSSPWTFGQGTKVEIK

SEQ ID NO: 2184 - protein, 5 aa, Artificial Sequence
  Description of Artificial Sequence: Synthetic peptide
  XENP019974 vhCDR1
SYTMH

SEQ ID NO: 2185 - protein, 17 aa, Artificial Sequence
  Description of Artificial Sequence: Synthetic peptide
  XENP019974 vhCDR2
FISYDGNNKYYADSVKG

SEQ ID NO: 2186 - protein, 9 aa, Artificial Sequence
  Description of Artificial Sequence: Synthetic peptide
  XENP019974 vhCDR3
TGWLGPFDY

SEQ ID NO: 2187 - protein, 12 aa, Artificial Sequence
  Description of Artificial Sequence: Synthetic peptide
  XENP019974 vlCDR1
RASQSVGSSYLA

SEQ ID NO: 2188 - protein, 7 aa, Artificial Sequence
  Description of Artificial Sequence: Synthetic peptide
  XENP019974 vlCDR2
GAFSRAT

SEQ ID NO: 2189 - protein, 9 aa, Artificial Sequence
  Description of Artificial Sequence: Synthetic peptide
  XENP019974 vlCDR3
QQYGSSPWT

SEQ ID NO: 2190 - protein, 246 aa, Artificial Sequence
  Description of Artificial Sequence: Synthetic polypeptide
  XENP019975 [CTLA-4]_H0_L0.87_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISSLEPEDFAVYYCQQYGSSPWTFGQGTKVEIK

SEQ ID NO: 2191 - protein, 118 aa, Artificial Sequence; identical to SEQ ID NO: 22
  Description of Artificial Sequence: Synthetic polypeptide
  VH of XENP019975

SEQ ID NO: 2192 - protein, 108 aa, Artificial Sequence
  Description of Artificial Sequence: Synthetic polypeptide
  VL of XENP019975
EIVLTQSPGTLSLSPGERATLSCRASQSVGSSYLAWYQQKPGQAPRLLIYGAFSRATGIPDRFSGSGSGTDFTLTISSLEPEDFAVYYCQQYGSSPWTFGQGTKVEIK

SEQ ID NO: 2193 - protein, 5 aa, Artificial Sequence
  Description of Artificial Sequence: Synthetic peptide
  XENP019975 vhCDR1
SYTMH

SEQ ID NO: 2194 - protein, 17 aa, Artificial Sequence
  Description of Artificial Sequence: Synthetic peptide
  XENP019975 vhCDR2
FISYDGNNKYYADSVKG

SEQ ID NO: 2195 - protein, 9 aa, Artificial Sequence
  Description of Artificial Sequence: Synthetic peptide
  XENP019975 vhCDR3
TGWLGPFDY

SEQ ID NO: 2196 - protein, 12 aa, Artificial Sequence
  Description of Artificial Sequence: Synthetic peptide
  XENP019975 vlCDR1
RASQSVGSSYLA

SEQ ID NO: 2197 - protein, 7 aa, Artificial Sequence
  Description of Artificial Sequence: Synthetic peptide
  XENP019975 vlCDR2
GAFSRAT

SEQ ID NO: 2198 - protein, 9 aa, Artificial Sequence
  Description of Artificial Sequence: Synthetic peptide
  XENP019975 vlCDR3
QQYGSSPWT

SEQ ID NO: 2199 - protein, 246 aa, Artificial Sequence
  Description of Artificial Sequence: Synthetic polypeptide
  XENP019976 [CTLA-4]_H0_L0.88_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISSLQSEDFAVYYCQQYGSSPWTFGQGTKVEIK

SEQ ID NO: 2200 - protein, 118 aa, Artificial Sequence; identical to SEQ ID NO: 22
  Description of Artificial Sequence: Synthetic polypeptide
  VH of XENP019976

SEQ ID NO: 2201 - protein, 108 aa, Artificial Sequence
  Description of Artificial Sequence: Synthetic polypeptide
  VL of XENP019976
EIVLTQSPGTLSLSPGERATLSCRASQSVGSSYLAWYQQKPGQAPRLLIYGAFSRATGIPDRFSGSGSGTDFTLTISSLQSEDFAVYYCQQYGSSPWTFGQGTKVEIK

SEQ ID NO: 2202 - protein, 5 aa, Artificial Sequence
  Description of Artificial Sequence: Synthetic peptide
  XENP019976 vhCDR1
SYTMH

SEQ ID NO: 2203 - protein, 17 aa, Artificial Sequence
  Description of Artificial Sequence: Synthetic peptide
  XENP019976 vhCDR2
FISYDGNNKYYADSVKG

SEQ ID NO: 2204 - protein, 9 aa, Artificial Sequence
  Description of Artificial Sequence: Synthetic peptide
  XENP019976 vhCDR3
TGWLGPFDY

SEQ ID NO: 2205 - protein, 12 aa, Artificial Sequence
  Description of Artificial Sequence: Synthetic peptide
  XENP019976 vlCDR1
RASQSVGSSYLA

SEQ ID NO: 2206 - protein, 7 aa, Artificial Sequence
  Description of Artificial Sequence: Synthetic peptide
  XENP019976 vlCDR2
GAFSRAT

SEQ ID NO: 2207 - protein, 9 aa, Artificial Sequence
  Description of Artificial Sequence: Synthetic peptide
  XENP019976 vlCDR3
QQYGSSPWT

SEQ ID NO: 2208 - protein, 246 aa, Artificial Sequence
  Description of Artificial Sequence: Synthetic polypeptide
  XENP019977 [CTLA-4]_H0_L0.89_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRVEPEDFAVYYCQQYGSSPWTFGQGTKVEIK

SEQ ID NO: 2209 - protein, 118 aa, Artificial Sequence; identical to SEQ ID NO: 22
  Description of Artificial Sequence: Synthetic polypeptide
  VH of XENP019977

SEQ ID NO: 2210 - protein, 108 aa, Artificial Sequence
  Description of Artificial Sequence: Synthetic polypeptide
  VL of XENP019977
EIVLTQSPGTLSLSPGERATLSCRASQSVGSSYLAWYQQKPGQAPRLLIYGAFSRATGIPDRFSGSGSGTDFTLTISRVEPEDFAVYYCQQYGSSPWTFGQGTKVEIK

SEQ ID NO: 2211 - protein, 5 aa, Artificial Sequence
  Description of Artificial Sequence: Synthetic peptide
  XENP019977 vhCDR1
SYTMH

SEQ ID NO: 2212 - protein, 17 aa, Artificial Sequence
  Description of Artificial Sequence: Synthetic peptide
  XENP019977 vhCDR2
FISYDGNNKYYADSVKG

SEQ ID NO: 2213 - protein, 9 aa, Artificial Sequence
  Description of Artificial Sequence: Synthetic peptide
  XENP019977 vhCDR3
TGWLGPFDY

SEQ ID NO: 2214 - protein, 12 aa, Artificial Sequence
  Description of Artificial Sequence: Synthetic peptide
  XENP019977 vlCDR1
RASQSVGSSYLA

SEQ ID NO: 2215 - protein, 7 aa, Artificial Sequence
  Description of Artificial Sequence: Synthetic peptide
  XENP019977 vlCDR2
GAFSRAT

SEQ ID NO: 2216 - protein, 9 aa, Artificial Sequence
  Description of Artificial Sequence: Synthetic peptide
  XENP019977 vlCDR3
QQYGSSPWT

SEQ ID NO: 2217 - protein, 246 aa, Artificial Sequence
  Description of Artificial Sequence: Synthetic polypeptide
  XENP019978 [CTLA-4]_H0_L0.90_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLQPEDFAVYYCQQYGSSPWTFGQGTKVEIK

SEQ ID NO: 2218 - protein, 118 aa, Artificial Sequence; identical to SEQ ID NO: 22
  Description of Artificial Sequence: Synthetic polypeptide
  VH of XENP019978

SEQ ID NO: 2219 - protein, 108 aa, Artificial Sequence
  Description of Artificial Sequence: Synthetic polypeptide
  VL of XENP019978
EIVLTQSPGTLSLSPGERATLSCRASQSVGSSYLAWYQQKPGQAPRLLIYGAFSRATGIPDRFSGSGSGTDFTLTISRLQPEDFAVYYCQQYGSSPWTFGQGTKVEIK

SEQ ID NO: 2220 - protein, 5 aa, Artificial Sequence
  Description of Artificial Sequence: Synthetic peptide
  XENP019978 vhCDR1
SYTMH

SEQ ID NO: 2221 - protein, 17 aa, Artificial Sequence
  Description of Artificial Sequence: Synthetic peptide
  XENP019978 vhCDR2
FISYDGNNKYYADSVKG

SEQ ID NO: 2222 - protein, 9 aa, Artificial Sequence
  Description of Artificial Sequence: Synthetic peptide
  XENP019978 vhCDR3
TGWLGPFDY

SEQ ID NO: 2223 - protein, 12 aa, Artificial Sequence
  Description of Artificial Sequence: Synthetic peptide
  XENP019978 vlCDR1
RASQSVGSSYLA

SEQ ID NO: 2224 - protein, 7 aa, Artificial Sequence
  Description of Artificial Sequence: Synthetic peptide
  XENP019978 vlCDR2
GAFSRAT

SEQ ID NO: 2225 - protein, 9 aa, Artificial Sequence
  Description of Artificial Sequence: Synthetic peptide
  XENP019978 vlCDR3
QQYGSSPWT

SEQ ID NO: 2226 - protein, 246 aa, Artificial Sequence
  Description of Artificial Sequence: Synthetic polypeptide
  XENP019979 [CTLA-4]_H0_L0.91_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLESEDFAVYYCQQYGSSPWTFGQGTKVEIK

SEQ ID NO: 2227 - protein, 118 aa, Artificial Sequence; identical to SEQ ID NO: 22
  Description of Artificial Sequence: Synthetic polypeptide
  VH of XENP019979

SEQ ID NO: 2228 - protein, 108 aa, Artificial Sequence
  Description of Artificial Sequence: Synthetic polypeptide
  VL of XENP019979
EIVLTQSPGTLSLSPGERATLSCRASQSVGSSYLAWYQQKPGQAPRLLIYGAFSRATGIPDRFSGSGSGTDFTLTISRLESEDFAVYYCQQYGSSPWTFGQGTKVEIK

SEQ ID NO: 2229 - protein, 5 aa, Artificial Sequence
  Description of Artificial Sequence: Synthetic peptide
  XENP019979 vhCDR1
SYTMH

SEQ ID NO: 2230 - protein, 17 aa, Artificial Sequence
  Description of Artificial Sequence: Synthetic peptide
  XENP019979 vhCDR2
FISYDGNNKYYADSVKG

SEQ ID NO: 2231 - protein, 9 aa, Artificial Sequence
  Description of Artificial Sequence: Synthetic peptide
  XENP019979 vhCDR3
TGWLGPFDY

SEQ ID NO: 2232 - protein, 12 aa, Artificial Sequence
  Description of Artificial Sequence: Synthetic peptide
  XENP019979 vlCDR1
RASQSVGSSYLA

SEQ ID NO: 2233 - protein, 7 aa, Artificial Sequence
  Description of Artificial Sequence: Synthetic peptide
  XENP019979 vlCDR2
GAFSRAT

SEQ ID NO: 2234 - protein, 9 aa, Artificial Sequence
  Description of Artificial Sequence: Synthetic peptide
  XENP019979 vlCDR3
QQYGSSPWT

SEQ ID NO: 2235 - protein, 246 aa, Artificial Sequence
  Description of Artificial Sequence: Synthetic polypeptide
  XENP019980 [CTLA-4]_H0_L0.92_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPQDFAVYYCQQYGSSPWTFGQGTKVEIK

SEQ ID NO: 2236 - protein, 118 aa, Artificial Sequence; identical to SEQ ID NO: 22
  Description of Artificial Sequence: Synthetic polypeptide
  VH of XENP019980

SEQ ID NO: 2237 - protein, 108 aa, Artificial Sequence
  Description of Artificial Sequence: Synthetic polypeptide
  VL of XENP019980
EIVLTQSPGTLSLSPGERATLSCRASQSVGSSYLAWYQQKPGQAPRLLIYGAFSRATGIPDRFSGSGSGTDFTLTISRLEPQDFAVYYCQQYGSSPWTFGQGTKVEIK

SEQ ID NO: 2238 - protein, 5 aa, Artificial Sequence
  Description of Artificial Sequence: Synthetic peptide
  XENP019980 vhCDR1
SYTMH

SEQ ID NO: 2239 - protein, 17 aa, Artificial Sequence
  Description of Artificial Sequence: Synthetic peptide
  XENP019980 vhCDR2
FISYDGNNKYYADSVKG

SEQ ID NO: 2240 - protein, 9 aa, Artificial Sequence
  Description of Artificial Sequence: Synthetic peptide
  XENP019980 vhCDR3
TGWLGPFDY

SEQ ID NO: 2241 - protein, 12 aa, Artificial Sequence
  Description of Artificial Sequence: Synthetic peptide
  XENP019980 vlCDR1
RASQSVGSSYLA

SEQ ID NO: 2242 - protein, 7 aa, Artificial Sequence
  Description of Artificial Sequence: Synthetic peptide
  XENP019980 vlCDR2
GAFSRAT

SEQ ID NO: 2243 - protein, 9 aa, Artificial Sequence
  Description of Artificial Sequence: Synthetic peptide
  XENP019980 vlCDR3
QQYGSSPWT

SEQ ID NO: 2244 - protein, 246 aa, Artificial Sequence
  Description of Artificial Sequence: Synthetic polypeptide
  XENP019981 [CTLA-4]_H0_L0.93_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCKQYGSSPWTFGQGTKVEIK

SEQ ID NO: 2245 - protein, 118 aa, Artificial Sequence; identical to SEQ ID NO: 22
  Description of Artificial Sequence: Synthetic polypeptide
  VH of XENP019981

SEQ ID NO: 2246 - protein, 108 aa, Artificial Sequence
  Description of Artificial Sequence: Synthetic polypeptide
  VL of XENP019981
EIVLTQSPGTLSLSPGERATLSCRASQSVGSSYLAWYQQKPGQAPRLLIYGAFSRATGIPDRFSGSGSGTDFTLTISRLEPEDFAVYYCKQYGSSPWTFGQGTKVEIK

SEQ ID NO: 2247 - protein, 5 aa, Artificial Sequence
  Description of Artificial Sequence: Synthetic peptide
  XENP019981 vhCDR1
SYTMH

SEQ ID NO: 2248 - protein, 17 aa, Artificial Sequence
  Description of Artificial Sequence: Synthetic peptide
  XENP019981 vhCDR2
FISYDGNNKYYADSVKG

SEQ ID NO: 2249 - protein, 9 aa, Artificial Sequence
  Description of Artificial Sequence: Synthetic peptide
  XENP019981 vhCDR3
TGWLGPFDY

SEQ ID NO: 2250 - protein, 12 aa, Artificial Sequence
  Description of Artificial Sequence: Synthetic peptide
  XENP019981 vlCDR1
RASQSVGSSYLA

SEQ ID NO: 2251 - protein, 7 aa, Artificial Sequence
  Description of Artificial Sequence: Synthetic peptide
  XENP019981 vlCDR2
GAFSRAT

SEQ ID NO: 2252 - protein, 9 aa, Artificial Sequence
  Description of Artificial Sequence: Synthetic peptide
  XENP019981 vlCDR3
KQYGSSPWT

SEQ ID NO: 2253 - protein, 246 aa, Artificial Sequence
  Description of Artificial Sequence: Synthetic polypeptide
  XENP019982 [CTLA-4]_H0_L0.94_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCLQYGSSPWTFGQGTKVEIK

SEQ ID NO: 2254 - protein, 118 aa, Artificial Sequence; identical to SEQ ID NO: 22
  Description of Artificial Sequence: Synthetic polypeptide
  VH of XENP019982

SEQ ID NO: 2255 - protein, 108 aa, Artificial Sequence
  Description of Artificial Sequence: Synthetic polypeptide
  VL of XENP019982
EIVLTQSPGTLSLSPGERATLSCRASQSVGSSYLAWYQQKPGQAPRLLIYGAFSRATGIPDRFSGSGSGTDFTLTISRLEPEDFAVYYCLQYGSSPWTFGQGTKVEIK

SEQ ID NO: 2256 - protein, 5 aa, Artificial Sequence
  Description of Artificial Sequence: Synthetic peptide
  XENP019982 vhCDR1
SYTMH

SEQ ID NO: 2257 - protein, 17 aa, Artificial Sequence
  Description of Artificial Sequence: Synthetic peptide
  XENP019982 vhCDR2
FISYDGNNKYYADSVKG

SEQ ID NO: 2258 - protein, 9 aa, Artificial Sequence
  Description of Artificial Sequence: Synthetic peptide
  XENP019982 vhCDR3
TGWLGPFDY

SEQ ID NO: 2259 - protein, 12 aa, Artificial Sequence
  Description of Artificial Sequence: Synthetic peptide
  XENP019982 vlCDR1
RASQSVGSSYLA

SEQ ID NO: 2260 - protein, 7 aa, Artificial Sequence
  Description of Artificial Sequence: Synthetic peptide
  XENP019982 vlCDR2
GAFSRAT

SEQ ID NO: 2261 - protein, 9 aa, Artificial Sequence
  Description of Artificial Sequence: Synthetic peptide
  XENP019982 vlCDR3
LQYGSSPWT

SEQ ID NO: 2262 - protein, 246 aa, Artificial Sequence
  Description of Artificial Sequence: Synthetic polypeptide
  XENP019983 [CTLA-4]_H0_L0.95_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCMQYGSSPWTFGQGTKVEIK

SEQ ID NO: 2263 - protein, 118 aa, Artificial Sequence; identical to SEQ ID NO: 22
  Description of Artificial Sequence: Synthetic polypeptide
  VH of XENP019983

SEQ ID NO: 2264 - protein, 108 aa, Artificial Sequence
  Description of Artificial Sequence: Synthetic polypeptide
  VL of XENP019983
EIVLTQSPGTLSLSPGERATLSCRASQSVGSSYLAWYQQKPGQAPRLLIYGAFSRATGIPDRFSGSGSGTDFTLTISRLEPEDFAVYYCMQYGSSPWTFGQGTKVEIK

SEQ ID NO: 2265 - protein, 5 aa, Artificial Sequence
  Description of Artificial Sequence: Synthetic peptide
  XENP019983 vhCDR1
SYTMH

SEQ ID NO: 2266 - protein, 17 aa, Artificial Sequence
  Description of Artificial Sequence: Synthetic peptide
  XENP019983 vhCDR2
FISYDGNNKYYADSVKG

SEQ ID NO: 2267 - protein, 9 aa, Artificial Sequence
  Description of Artificial Sequence: Synthetic peptide
  XENP019983 vhCDR3
TGWLGPFDY

SEQ ID NO: 2268 - protein, 12 aa, Artificial Sequence
  Description of Artificial Sequence: Synthetic peptide
  XENP019983 vlCDR1
RASQSVGSSYLA

SEQ ID NO: 2269 - protein, 7 aa, Artificial Sequence
  Description of Artificial Sequence: Synthetic peptide
  XENP019983 vlCDR2
GAFSRAT

SEQ ID NO: 2270 - protein, 9 aa, Artificial Sequence
  Description of Artificial Sequence: Synthetic peptide
  XENP019983 vlCDR3
MQYGSSPWT

SEQ ID NO: 2271 - protein, 246 aa, Artificial Sequence
  Description of Artificial Sequence: Synthetic polypeptide
  XENP019984 [CTLA-4]_H0_L0.96_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQSYGSSPWTFGQGTKVEIK

SEQ ID NO: 2272 - protein, 118 aa, Artificial Sequence; identical to SEQ ID NO: 22
  Description of Artificial Sequence: Synthetic polypeptide
  VH of XENP019984

SEQ ID NO: 2273 - protein, 108 aa, Artificial Sequence
  Description of Artificial Sequence: Synthetic polypeptide
  VL of XENP019984
EIVLTQSPGTLSLSPGERATLSCRASQSVGSSYLAWYQQKPGQAPRLLIYGAFSRATGIPDRFSGSGSGTDFTLTISRLEPEDFAVYYCQSYGSSPWTFGQGTKVEIK

SEQ ID NO: 2274 - protein, 5 aa, Artificial Sequence
  Description of Artificial Sequence: Synthetic peptide
  XENP019984 vhCDR1
SYTMH

SEQ ID NO: 2275 - protein, 17 aa, Artificial Sequence
  Description of Artificial Sequence: Synthetic peptide
  XENP019984 vhCDR2
FISYDGNNKYYADSVKG

SEQ ID NO: 2276 - protein, 9 aa, Artificial Sequence
  Description of Artificial Sequence: Synthetic peptide
  XENP019984 vhCDR3
TGWLGPFDY

SEQ ID NO: 2277 - protein, 12 aa, Artificial Sequence
  Description of Artificial Sequence: Synthetic peptide
  XENP019984 vlCDR1
RASQSVGSSYLA

SEQ ID NO: 2278 - protein, 7 aa, Artificial Sequence
  Description of Artificial Sequence: Synthetic peptide
  XENP019984 vlCDR2
GAFSRAT

SEQ ID NO: 2279 - protein, 9 aa, Artificial Sequence
  Description of Artificial Sequence: Synthetic peptide
  XENP019984 vlCDR3
QSYGSSPWT

SEQ ID NO: 2280 - protein, 246 aa, Artificial Sequence
  Description of Artificial Sequence: Synthetic polypeptide
  XENP019985 [CTLA-4]_H0_L0.97_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQAGSSPWTFGQGTKVEIK

SEQ ID NO: 2281 - protein, 118 aa, Artificial Sequence; identical to SEQ ID NO: 22
  Description of Artificial Sequence: Synthetic polypeptide
  VH of XENP019985

SEQ ID NO: 2282 - protein, 108 aa, Artificial Sequence
  Description of Artificial Sequence: Synthetic polypeptide
  VL of XENP019985
EIVLTQSPGTLSLSPGERATLSCRASQSVGSSYLAWYQQKPGQAPRLLIYGAFSRATGIPDRFSGSGSGTDFTLTISRLEPEDFAVYYCQQAGSSPWTFGQGTKVEIK

SEQ ID NO: 2283 - protein, 5 aa, Artificial Sequence
  Description of Artificial Sequence: Synthetic peptide
  XENP019985 vhCDR1
SYTMH

SEQ ID NO: 2284 - protein, 17 aa, Artificial Sequence
  Description of Artificial Sequence: Synthetic peptide
  XENP019985 vhCDR2
FISYDGNNKYYADSVKG

SEQ ID NO: 2285 - protein, 9 aa, Artificial Sequence
  Description of Artificial Sequence: Synthetic peptide
  XENP019985 vhCDR3
TGWLGPFDY

SEQ ID NO: 2286 - protein, 12 aa, Artificial Sequence
  Description of Artificial Sequence: Synthetic peptide
  XENP019985 vlCDR1
RASQSVGSSYLA

SEQ ID NO: 2287 - protein, 7 aa, Artificial Sequence
  Description of Artificial Sequence: Synthetic peptide
  XENP019985 vlCDR2
GAFSRAT

SEQ ID NO: 2288 - protein, 9 aa, Artificial Sequence
  Description of Artificial Sequence: Synthetic peptide
  XENP019985 vlCDR3
QQAGSSPWT

SEQ ID NO: 2289 - protein, 246 aa, Artificial Sequence
  Description of Artificial Sequence: Synthetic polypeptide
  XENP019986 [CTLA-4]_H0_L0.98_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQFGSSPWTFGQGTKVEIK

SEQ ID NO: 2290 - protein, 118 aa, Artificial Sequence; identical to SEQ ID NO: 22
  Description of Artificial Sequence: Synthetic polypeptide
  VH of XENP019986

SEQ ID NO: 2291 - protein, 108 aa, Artificial Sequence
  Description of Artificial Sequence: Synthetic polypeptide
  VL of XENP019986
EIVLTQSPGTLSLSPGERATLSCRASQSVGSSYLAWYQQKPGQAPRLLIYGAFSRATGIPDRFSGSGSGTDFTLTISRLEPEDFAVYYCQQFGSSPWTFGQGTKVEIK

SEQ ID NO: 2292 - protein, 5 aa, Artificial Sequence
  Description of Artificial Sequence: Synthetic peptide
  XENP019986 vhCDR1
SYTMH

SEQ ID NO: 2293 - protein, 17 aa, Artificial Sequence
  Description of Artificial Sequence: Synthetic peptide
  XENP019986 vhCDR2
FISYDGNNKYYADSVKG

SEQ ID NO: 2294 - protein, 9 aa, Artificial Sequence
  Description of Artificial Sequence: Synthetic peptide
  XENP019986 vhCDR3
TGWLGPFDY

SEQ ID NO: 2295 - protein, 12 aa, Artificial Sequence
  Description of Artificial Sequence: Synthetic peptide
  XENP019986 vlCDR1
RASQSVGSSYLA

SEQ ID NO: 2296 - protein, 7 aa, Artificial Sequence
  Description of Artificial Sequence: Synthetic peptide
  XENP019986 vlCDR2
GAFSRAT

SEQ ID NO: 2297 - protein, 9 aa, Artificial Sequence
  Description of Artificial Sequence: Synthetic peptide
  XENP019986 vlCDR3
QQFGSSPWT

SEQ ID NO: 2298 - protein, 246 aa, Artificial Sequence
  Description of Artificial Sequence: Synthetic polypeptide
  XENP019987 [CTLA-4]_H0_L0.99_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQHGSSPWTFGQGTKVEIK

SEQ ID NO: 2299 - protein, 118 aa, Artificial Sequence; identical to SEQ ID NO: 22
  Description of Artificial Sequence: Synthetic polypeptide
  VH of XENP019987

SEQ ID NO: 2300 - protein, 108 aa, Artificial Sequence
  Description of Artificial Sequence: Synthetic polypeptide
  VL of XENP019987
EIVLTQSPGTLSLSPGERATLSCRASQSVGSSYLAWYQQKPGQAPRLLIYGAFSRATGIPDRFSGSGSGTDFTLTISRLEPEDFAVYYCQQHGSSPWTFGQGTKVEIK

SEQ ID NO: 2301 - protein, 5 aa, Artificial Sequence
  Description of Artificial Sequence: Synthetic peptide
  XENP019987 vhCDR1
SYTMH

SEQ ID NO: 2302 - protein, 17 aa, Artificial Sequence
  Description of Artificial Sequence: Synthetic peptide
  XENP019987 vhCDR2
FISYDGNNKYYADSVKG

SEQ ID NO: 2303 - protein, 9 aa, Artificial Sequence
  Description of Artificial Sequence: Synthetic peptide
  XENP019987 vhCDR3
TGWLGPFDY

SEQ ID NO: 2304 - protein, 12 aa, Artificial Sequence
  Description of Artificial Sequence: Synthetic peptide
  XENP019987 vlCDR1
RASQSVGSSYLA

SEQ ID NO: 2305 - protein, 7 aa, Artificial Sequence
  Description of Artificial Sequence: Synthetic peptide
  XENP019987 vlCDR2
GAFSRAT

SEQ ID NO: 2306 - protein, 9 aa, Artificial Sequence
  Description of Artificial Sequence: Synthetic peptide
  XENP019987 vlCDR3
QQHGSSPWT

SEQ ID NO: 2307 - protein, 246 aa, Artificial Sequence
  Description of Artificial Sequence: Synthetic polypeptide
  XENP019988 [CTLA-4]_H0_L0.100_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQLGSSPWTFGQGTKVEIK

SEQ ID NO: 2308 - protein, 118 aa, Artificial Sequence; identical to SEQ ID NO: 22
  Description of Artificial Sequence: Synthetic polypeptide
  VH of XENP019988

SEQ ID NO: 2309 - protein, 108 aa, Artificial Sequence
  Description of Artificial Sequence: Synthetic polypeptide
  VL of XENP019988
EIVLTQSPGTLSLSPGERATLSCRASQSVGSSYLAWYQQKPGQAPRLLIYGAFSRATGIPDRFSGSGSGTDFTLTISRLEPEDFAVYYCQQLGSSPWTFGQGTKVEIK

SEQ ID NO: 2310 - protein, 5 aa, Artificial Sequence
  Description of Artificial Sequence: Synthetic peptide
  XENP019988 vhCDR1
SYTMH

SEQ ID NO: 2311 - protein, 17 aa, Artificial Sequence
  Description of Artificial Sequence: Synthetic peptide
  XENP019988 vhCDR2
FISYDGNNKYYADSVKG

SEQ ID NO: 2312 - protein, 9 aa, Artificial Sequence
  Description of Artificial Sequence: Synthetic peptide
  XENP019988 vhCDR3
TGWLGPFDY

SEQ ID NO: 2313 - protein, 12 aa, Artificial Sequence
  Description of Artificial Sequence: Synthetic peptide
  XENP019988 vlCDR1
RASQSVGSSYLA

SEQ ID NO: 2314 - protein, 7 aa, Artificial Sequence
  Description of Artificial Sequence: Synthetic peptide
  XENP019988 vlCDR2
GAFSRAT

SEQ ID NO: 2315 - protein, 9 aa, Artificial Sequence
  Description of Artificial Sequence: Synthetic peptide
  XENP019988 vlCDR3
QQLGSSPWT

SEQ ID NO: 2316 - protein, 246 aa, Artificial Sequence
  Description of Artificial Sequence: Synthetic polypeptide
  XENP019989 [CTLA-4]_H0_L0.101_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQVGSSPWTFGQGTKVEIK

SEQ ID NO: 2317 - protein, 118 aa, Artificial Sequence; identical to SEQ ID NO: 22
  Description of Artificial Sequence: Synthetic polypeptide
  VH of XENP019989

SEQ ID NO: 2318 - protein, 108 aa, Artificial Sequence
  Description of Artificial Sequence: Synthetic polypeptide
  VL of XENP019989
EIVLTQSPGTLSLSPGERATLSCRASQSVGSSYLAWYQQKPGQAPRLLIYGAFSRATGIPDRFSGSGSGTDFTLTISRLEPEDFAVYYCQQVGSSPWTFGQGTKVEIK

SEQ ID NO: 2319 - protein, 5 aa, Artificial Sequence
  Description of Artificial Sequence: Synthetic peptide
  XENP019989 vhCDR1
SYTMH

SEQ ID NO: 2320 - protein, 17 aa, Artificial Sequence
  Description of Artificial Sequence: Synthetic peptide
  XENP019989 vhCDR2
FISYDGNNKYYADSVKG

SEQ ID NO: 2321 - protein, 9 aa, Artificial Sequence
  Description of Artificial Sequence: Synthetic peptide
  XENP019989 vhCDR3
TGWLGPFDY

SEQ ID NO: 2322 - protein, 12 aa, Artificial Sequence
  Description of Artificial Sequence: Synthetic peptide
  XENP019989 vlCDR1
RASQSVGSSYLA

SEQ ID NO: 2323 - protein, 7 aa, Artificial Sequence
  Description of Artificial Sequence: Synthetic peptide
  XENP019989 vlCDR2
GAFSRAT

SEQ ID NO: 2324 - protein, 9 aa, Artificial Sequence
  Description of Artificial Sequence: Synthetic peptide
  XENP019989 vlCDR3
QQVGSSPWT

SEQ ID NO: 2325 - protein, 246 aa, Artificial Sequence
  Description of Artificial Sequence: Synthetic polypeptide
  XENP019990 [CTLA-4]_H0_L0.102_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGESPWTFGQGTKVEIK

SEQ ID NO: 2326 - protein, 118 aa, Artificial Sequence; identical to SEQ ID NO: 22
  Description of Artificial Sequence: Synthetic polypeptide
  VH of XENP019990

SEQ ID NO: 2327 - protein, 108 aa, Artificial Sequence
  Description of Artificial Sequence: Synthetic polypeptide
  VL of XENP019990
EIVLTQSPGTLSLSPGERATLSCRASQSVGSSYLAWYQQKPGQAPRLLIYGAFSRATGIPDRFSGSGSGTDFTLTISRLEPEDFAVYYCQQYGESPWTFGQGTKVEIK

SEQ ID NO: 2328 - protein, 5 aa, Artificial Sequence
  Description of Artificial Sequence: Synthetic peptide
  XENP019990 vhCDR1
SYTMH

SEQ ID NO: 2329 - protein, 17 aa, Artificial Sequence
  Description of Artificial Sequence: Synthetic peptide
  XENP019990 vhCDR2
FISYDGNNKYYADSVKG

SEQ ID NO: 2330 - protein, 9 aa, Artificial Sequence
  Description of Artificial Sequence: Synthetic peptide
  XENP019990 vhCDR3
TGWLGPFDY

SEQ ID NO: 2331 - protein, 12 aa, Artificial Sequence
  Description of Artificial Sequence: Synthetic peptide
  XENP019990 vlCDR1
RASQSVGSSYLA

SEQ ID NO: 2332 - protein, 7 aa, Artificial Sequence
  Description of Artificial Sequence: Synthetic peptide
  XENP019990 vlCDR2
GAFSRAT

SEQ ID NO: 2333 - protein, 9 aa, Artificial Sequence
  Description of Artificial Sequence: Synthetic peptide
  XENP019990 vlCDR3
QQYGESPWT

SEQ ID NO: 2334 - protein, 246 aa, Artificial Sequence
  Description of Artificial Sequence: Synthetic polypeptide
  XENP019991 [CTLA-4]_H0_L0.103_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGKSPWTFGQGTKVEIK

SEQ ID NO: 2335 - protein, 118 aa, Artificial Sequence; identical to SEQ ID NO: 22
  Description of Artificial Sequence: Synthetic polypeptide
  VH of XENP019991

SEQ ID NO: 2336 - protein, 108 aa, Artificial Sequence
  Description of Artificial Sequence: Synthetic polypeptide
  VL of XENP019991
EIVLTQSPGTLSLSPGERATLSCRASQSVGSSYLAWYQQKPGQAPRLLIYGAFSRATGIPDRFSGSGSGTDFTLTISRLEPEDFAVYYCQQYGKSPWTFGQGTKVEIK

SEQ ID NO: 2337 - protein, 5 aa, Artificial Sequence
  Description of Artificial Sequence: Synthetic peptide
  XENP019991 vhCDR1
SYTMH

SEQ ID NO: 2338 - protein, 17 aa, Artificial Sequence
  Description of Artificial Sequence: Synthetic peptide
  XENP019991 vhCDR2
FISYDGNNKYYADSVKG

SEQ ID NO: 2339 - protein, 9 aa, Artificial Sequence
  Description of Artificial Sequence: Synthetic peptide
  XENP019991 vhCDR3
TGWLGPFDY

SEQ ID NO: 2340 - protein, 12 aa, Artificial Sequence
  Description of Artificial Sequence: Synthetic peptide
  XENP019991 vlCDR1
RASQSVGSSYLA

SEQ ID NO: 2341 - protein, 7 aa, Artificial Sequence
  Description of Artificial Sequence: Synthetic peptide
  XENP019991 vlCDR2
GAFSRAT

SEQ ID NO: 2342 - protein, 9 aa, Artificial Sequence
  Description of Artificial Sequence: Synthetic peptide
  XENP019991 vlCDR3
QQYGKSPWT

SEQ ID NO: 2343 - protein, 246 aa, Artificial Sequence
  Description of Artificial Sequence: Synthetic polypeptide
  XENP019992 [CTLA-4]_H0_L0.104_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSYPWTFGQGTKVEIK

SEQ ID NO: 2344 - protein, 118 aa, Artificial Sequence; identical to SEQ ID NO: 22
  Description of Artificial Sequence: Synthetic polypeptide
  VH of XENP019992

SEQ ID NO: 2345 - protein, 108 aa, Artificial Sequence
  Description of Artificial Sequence: Synthetic polypeptide
  VL of XENP019992
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSYPWTFGQGTKVEIK

SEQ ID NO: 2346 - protein, 5 aa, Artificial Sequence
  Description of Artificial Sequence: Synthetic peptide
  XENP019992 vhCDR1
SYTMH

SEQ ID NO: 2347 - protein, 17 aa, Artificial Sequence
  Description of Artificial Sequence: Synthetic peptide
  XENP019992 vhCDR2
FISYDGNNKYYADSVKG

SEQ ID NO: 2348 - protein, 9 aa, Artificial Sequence
  Description of Artificial Sequence: Synthetic peptide
  XENP019992 vhCDR3
TGWLGPFDY

SEQ ID NO: 2349 - protein, 12 aa, Artificial Sequence
  Description of Artificial Sequence: Synthetic peptide
  XENP019992 vlCDR1
RASQSVGSSYLA

SEQ ID NO: 2350 - protein, 7 aa, Artificial Sequence
  Description of Artificial Sequence: Synthetic peptide
  XENP019992 vlCDR2
GAFSRAT

SEQ ID NO: 2351 - protein, 9 aa, Artificial Sequence
  Description of Artificial Sequence: Synthetic peptide
  XENP019992 vlCDR3
QQYGSYPWT

SEQ ID NO: 2352 - protein, 246 aa, Artificial Sequence
  Description of Artificial Sequence: Synthetic polypeptide
  XENP019993 [CTLA-4]_H0_L0.105_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSHWTFGQGTKVEIK

SEQ ID NO: 2353 - protein, 118 aa, Artificial Sequence; identical to SEQ ID NO: 22
  Description of Artificial Sequence: Synthetic polypeptide
  VH of XENP019993

SEQ ID NO: 2354 - protein, 108 aa, Artificial Sequence
  Description of Artificial Sequence: Synthetic polypeptide
  VL of XENP019993
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSHWTFGQGTKVEIK

SEQ ID NO: 2355 - protein, 5 aa, Artificial Sequence
  Description of Artificial Sequence: Synthetic peptide
  XENP019993 vhCDR1
SYTMH

SEQ ID NO: 2356 - protein, 17 aa, Artificial Sequence
  Description of Artificial Sequence: Synthetic peptide
  XENP019993 vhCDR2
FISYDGNNKYYADSVKG

SEQ ID NO: 2357 - protein, 9 aa, Artificial Sequence
  Description of Artificial Sequence: Synthetic peptide
  XENP019993 vhCDR3
TGWLGPFDY

SEQ ID NO: 2358 - protein, 12 aa, Artificial Sequence
  Description of Artificial Sequence: Synthetic peptide
  XENP019993 vlCDR1
RASQSVGSSYLA

SEQ ID NO: 2359 - protein, 7 aa, Artificial Sequence
  Description of Artificial Sequence: Synthetic peptide
  XENP019993 vlCDR2
GAFSRAT

SEQ ID NO: 2360 - protein, 9 aa, Artificial Sequence
  Description of Artificial Sequence: Synthetic peptide
  XENP019993 vlCDR3
QQYGSSHWT

SEQ ID NO: 2361 - protein, 246 aa, Artificial Sequence
  Description of Artificial Sequence: Synthetic polypeptide
  XENP019994 [CTLA-4]_H0_L0.106_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPFTFGQGTKVEIK

SEQ ID NO: 2362 - protein, 118 aa, Artificial Sequence; identical to SEQ ID NO: 22
  Description of Artificial Sequence: Synthetic polypeptide
  VH of XENP019994

SEQ ID NO: 2363 - protein, 108 aa, Artificial Sequence
  Description of Artificial Sequence: Synthetic polypeptide
  VL of XENP019994
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPFTFGQGTKVEIK

SEQ ID NO: 2364 - protein, 5 aa, Artificial Sequence
  Description of Artificial Sequence: Synthetic peptide
  XENP019994 vhCDR1
SYTMH

SEQ ID NO: 2365 - protein, 17 aa, Artificial Sequence
  Description of Artificial Sequence: Synthetic peptide
  XENP019994 vhCDR2
FISYDGNNKYYADSVKG

SEQ ID NO: 2366 - protein, 9 aa, Artificial Sequence
  Description of Artificial Sequence: Synthetic peptide
  XENP019994 vhCDR3
TGWLGPFDY

SEQ ID NO: 2367 - protein, 12 aa, Artificial Sequence
  Description of Artificial Sequence: Synthetic peptide
  XENP019994 vlCDR1
RASQSVGSSYLA

SEQ ID NO: 2368 - protein, 7 aa, Artificial Sequence
  Description of Artificial Sequence: Synthetic peptide
  XENP019994 vlCDR2
GAFSRAT

SEQ ID NO: 2369 - protein, 9 aa, Artificial Sequence
  Description of Artificial Sequence: Synthetic peptide
  XENP019994 vlCDR3
QQYGSSPFT

SEQ ID NO: 2370 - protein, 246 aa, Artificial Sequence
  Description of Artificial Sequence: Synthetic polypeptide
  XENP019995 [CTLA-4]_H0_L0.107_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPHTFGQGTKVEIK

SEQ ID NO: 2371 - protein, 118 aa, Artificial Sequence; identical to SEQ ID NO: 22
  Description of Artificial Sequence: Synthetic polypeptide
  VH of XENP019995

SEQ ID NO: 2372 - protein, 108 aa, Artificial Sequence
  Description of Artificial Sequence: Synthetic polypeptide
  VL of XENP019995
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPHTFGQGTKVEIK

SEQ ID NO: 2373 - protein, 5 aa, Artificial Sequence
  Description of Artificial Sequence: Synthetic peptide
  XENP019995 vhCDR1
SYTMH

SEQ ID NO: 2374 - protein, 17 aa, Artificial Sequence
  Description of Artificial Sequence: Synthetic peptide
  XENP019995 vhCDR2
FISYDGNNKYYADSVKG

SEQ ID NO: 2375 - protein, 9 aa, Artificial Sequence
  Description of Artificial Sequence: Synthetic peptide
  XENP019995 vhCDR3
TGWLGPFDY

SEQ ID NO: 2376 - protein, 12 aa, Artificial Sequence
  Description of Artificial Sequence: Synthetic peptide
  XENP019995 vlCDR1
RASQSVGSSYLA

SEQ ID NO: 2377 - protein, 7 aa, Artificial Sequence
  Description of Artificial Sequence: Synthetic peptide
  XENP019995 vlCDR2
GAFSRAT

SEQ ID NO: 2378 - protein, 9 aa, Artificial Sequence
  Description of Artificial Sequence: Synthetic peptide
  XENP019995 vlCDR3
QQYGSSPHT

SEQ ID NO: 2379 - protein, 246 aa, Artificial Sequence
  Description of Artificial Sequence: Synthetic polypeptide
  XENP019996 [CTLA-4]_H0_L0.108_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPITFGQGTKVEIK

SEQ ID NO: 2380 - protein, 118 aa, Artificial Sequence; identical to SEQ ID NO: 22
  Description of Artificial Sequence: Synthetic polypeptide
  VH of XENP019996

SEQ ID NO: 2381 - protein, 108 aa, Artificial Sequence
  Description of Artificial Sequence: Synthetic polypeptide
  VL of XENP019996
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPITFGQGTKVEIK

SEQ ID NO: 2382 - protein, 5 aa, Artificial Sequence
  Description of Artificial Sequence: Synthetic peptide
  XENP019996 vhCDR1
SYTMH

SEQ ID NO: 2383 - protein, 17 aa, Artificial Sequence
  Description of Artificial Sequence: Synthetic peptide
  XENP019996 vhCDR2
FISYDGNNKYYADSVKG

SEQ ID NO: 2384 - protein, 9 aa, Artificial Sequence
  Description of Artificial Sequence: Synthetic peptide
  XENP019996 vhCDR3
TGWLGPFDY

SEQ ID NO: 2385 - protein, 12 aa, Artificial Sequence
  Description of Artificial Sequence: Synthetic peptide
  XENP019996 vlCDR1
RASQSVGSSYLA

SEQ ID NO: 2386 - protein, 7 aa, Artificial Sequence
  Description of Artificial Sequence: Synthetic peptide
  XENP019996 vlCDR2
GAFSRAT

SEQ ID NO: 2387 - protein, 9 aa, Artificial Sequence
  Description of Artificial Sequence: Synthetic peptide
  XENP019996 vlCDR3
QQYGSSPIT

SEQ ID NO: 2388 - protein, 246 aa, Artificial Sequence
  Description of Artificial Sequence: Synthetic polypeptide
  XENP020001 [CTLA-4]_H0_L0.109_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPLTFGQGTKVEIK

SEQ ID NO: 2389 - protein, 118 aa, Artificial Sequence; identical to SEQ ID NO: 22
  Description of Artificial Sequence: Synthetic polypeptide
  VH of XENP020001

SEQ ID NO: 2390 - protein, 108 aa, Artificial Sequence
  Description of Artificial Sequence: Synthetic polypeptide
  VL of XENP020001
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPLTFGQGTKVEIK

SEQ ID NO: 2391 - protein, 5 aa, Artificial Sequence
  Description of Artificial Sequence: Synthetic peptide
  XENP020001 vhCDR1
SYTMH

SEQ ID NO: 2392 - protein, 17 aa, Artificial Sequence
  Description of Artificial Sequence: Synthetic peptide
  XENP020001 vhCDR2
FISYDGNNKYYADSVKG

SEQ ID NO: 2393 - protein, 9 aa, Artificial Sequence
  Description of Artificial Sequence: Synthetic peptide
  XENP020001 vhCDR3
TGWLGPFDY

SEQ ID NO: 2394 - protein, 12 aa, Artificial Sequence
  Description of Artificial Sequence: Synthetic peptide
  XENP020001 vlCDR1
RASQSVGSSYLA

SEQ ID NO: 2395 - protein, 7 aa, Artificial Sequence
  Description of Artificial Sequence: Synthetic peptide
  XENP020001 vlCDR2
GAFSRAT

SEQ ID NO: 2396 - protein, 9 aa, Artificial Sequence
  Description of Artificial Sequence: Synthetic peptide
  XENP020001 vlCDR3
QQYGSSPLT

SEQ ID NO: 2397 - protein, 246 aa, Artificial Sequence
  Description of Artificial Sequence: Synthetic polypeptide
  XENP020002 [CTLA-4]_H0_L0.110_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPYTFGQGTKVEIK

SEQ ID NO: 2398 - protein, 118 aa, Artificial Sequence; identical to SEQ ID NO: 22
  Description of Artificial Sequence: Synthetic polypeptide
  VH of XENP020002

SEQ ID NO: 2399 - protein, 108 aa, Artificial Sequence
  Description of Artificial Sequence: Synthetic polypeptide
  VL of XENP020002
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPYTFGQGTKVEIK

SEQ ID NO: 2400 - protein, 5 aa, Artificial Sequence
  Description of Artificial Sequence: Synthetic peptide
  XENP020002 vhCDR1
SYTMH

SEQ ID NO: 2401 - protein, 17 aa, Artificial Sequence
  Description of Artificial Sequence: Synthetic peptide
  XENP020002 vhCDR2
FISYDGNNKYYADSVKG

SEQ ID NO: 2402 - protein, 9 aa, Artificial Sequence
  Description of Artificial Sequence: Synthetic peptide
  XENP020002 vhCDR3
TGWLGPFDY

SEQ ID NO: 2403 - protein, 12 aa, Artificial Sequence
  Description of Artificial Sequence: Synthetic peptide
  XENP020002 vlCDR1
RASQSVGSSYLA

SEQ ID NO: 2404 - protein, 7 aa, Artificial Sequence
  Description of Artificial Sequence: Synthetic peptide
  XENP020002 vlCDR2
GAFSRAT

SEQ ID NO: 2405 - protein, 9 aa, Artificial Sequence
  Description of Artificial Sequence: Synthetic peptide
  XENP020002 vlCDR3
QQYGSSPYT

SEQ ID NO: 2406 - protein, 246 aa, Artificial Sequence
  Description of Artificial Sequence: Synthetic polypeptide
  XENP020003 [CTLA-4]_H0_L0.111_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWVFGQGTKVEIK

SEQ ID NO: 2407 - protein, 118 aa, Artificial Sequence; identical to SEQ ID NO: 22
  Description of Artificial Sequence: Synthetic polypeptide
  VH of XENP020003

SEQ ID NO: 2408 - protein, 108 aa, Artificial Sequence
  Description of Artificial Sequence: Synthetic polypeptide
  VL of XENP020003
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWVFGQGTKVEIK

SEQ ID NO: 2409 - protein, 5 aa, Artificial Sequence
  Description of Artificial Sequence: Synthetic peptide
  XENP020003 vhCDR1
SYTMH

SEQ ID NO: 2410 - protein, 17 aa, Artificial Sequence
  Description of Artificial Sequence: Synthetic peptide
  XENP020003 vhCDR2
FISYDGNNKYYADSVKG

SEQ ID NO: 2411 - protein, 9 aa, Artificial Sequence
  Description of Artificial Sequence: Synthetic peptide
  XENP020003 vhCDR3
TGWLGPFDY

SEQ ID NO: 2412 - protein, 12 aa, Artificial Sequence
  Description of Artificial Sequence: Synthetic peptide
  XENP020003 vlCDR1
RASQSVGSSYLA

SEQ ID NO: 2413 - protein, 7 aa, Artificial Sequence
  Description of Artificial Sequence: Synthetic peptide
  XENP020003 vlCDR2
GAFSRAT

SEQ ID NO: 2414 - protein, 9 aa, Artificial Sequence
  Description of Artificial Sequence: Synthetic peptide
  XENP020003 vlCDR3
QQYGSSPWV

SEQ ID NO: 2415 - protein, 246 aa, Artificial Sequence
  Description of Artificial Sequence: Synthetic polypeptide
  XENP020004 [CTLA-4]_H0_L0.112_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGGGTKVEIK

SEQ ID NO: 2416 - protein, 118 aa, Artificial Sequence; identical to SEQ ID NO: 22
  Description of Artificial Sequence: Synthetic polypeptide
  VH of XENP020004

SEQ ID NO: 2417 - protein, 108 aa, Artificial Sequence
  Description of Artificial Sequence: Synthetic polypeptide
  VL of XENP020004
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGGGTKVEIK

SEQ ID NO: 2418 - protein, 5 aa, Artificial Sequence
  Description of Artificial Sequence: Synthetic peptide
  XENP020004 vhCDR1
SYTMH

SEQ ID NO: 2419 - protein, 17 aa, Artificial Sequence
  Description of Artificial Sequence: Synthetic peptide
  XENP020004 vhCDR2
FISYDGNNKYYADSVKG

SEQ ID NO: 2420 - protein, 9 aa, Artificial Sequence
  Description of Artificial Sequence: Synthetic peptide
  XENP020004 vhCDR3
TGWLGPFDY

SEQ ID NO: 2421 - protein, 12 aa, Artificial Sequence
  Description of Artificial Sequence: Synthetic peptide
  XENP020004 vlCDR1
RASQSVGSSYLA

SEQ ID NO: 2422 - protein, 7 aa, Artificial Sequence
  Description of Artificial Sequence: Synthetic peptide
  XENP020004 vlCDR2
GAFSRAT

SEQ ID NO: 2423 - protein, 9 aa, Artificial Sequence
  Description of Artificial Sequence: Synthetic peptide
  XENP020004 vlCDR3
QQYGSSPWT

SEQ ID NO: 2424 - protein, 246 aa, Artificial Sequence
  Description of Artificial Sequence: Synthetic polypeptide
  XENP020005 [CTLA-4]_H0_L0.113_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIK

SEQ ID NO: 2425 - protein, 118 aa, Artificial Sequence; identical to SEQ ID NO: 22
  Description of Artificial Sequence: Synthetic polypeptide
  VH of XENP020005

SEQ ID NO: 2426 - protein, 108 aa, Artificial Sequence; identical to SEQ ID NO: 59
  Description of Artificial Sequence: Synthetic polypeptide
  VL of XENP020005

SEQ ID NO: 2427 - protein, 5 aa, Artificial Sequence
  Description of Artificial Sequence: Synthetic peptide
  XENP020005 vhCDR1
SYTMH

SEQ ID NO: 2428 - protein, 17 aa, Artificial Sequence
  Description of Artificial Sequence: Synthetic peptide
  XENP020005 vhCDR2
FISYDGNNKYYADSVKG

SEQ ID NO: 2429 - protein, 9 aa, Artificial Sequence
  Description of Artificial Sequence: Synthetic peptide
  XENP020005 vhCDR3
TGWLGPFDY

SEQ ID NO: 2430 - protein, 12 aa, Artificial Sequence
  Description of Artificial Sequence: Synthetic peptide
  XENP020005 vlCDR1
RASQSVGSSYLA

SEQ ID NO: 2431 - protein, 7 aa, Artificial Sequence
  Description of Artificial Sequence: Synthetic peptide
  XENP020005 vlCDR2
GAFSRAT

SEQ ID NO: 2432 - protein, 9 aa, Artificial Sequence
  Description of Artificial Sequence: Synthetic peptide
  XENP020005 vlCDR3
QQYGSSPWT

SEQ ID NO: 2433 - protein, 246 aa, Artificial Sequence
  Description of Artificial Sequence: Synthetic polypeptide
  XENP020075 [CTLA-4]_H3.1_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2434 - protein, 118 aa, Artificial Sequence
  Description of Artificial Sequence: Synthetic polypeptide
  VH of XENP020075
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGLLGPFDLWGQGTMVTVSS

SEQ ID NO: 2435 - protein, 108 aa, Artificial Sequence; identical to SEQ ID NO: 1517
  Description of Artificial Sequence: Synthetic polypeptide
  VL of XENP020075

SEQ ID NO: 2436 - protein, 5 aa, Artificial Sequence
  Description of Artificial Sequence: Synthetic peptide
  XENP020075 vhCDR1
SYTMH

SEQ ID NO: 2437 - protein, 17 aa, Artificial Sequence
  Description of Artificial Sequence: Synthetic peptide
  XENP020075 vhCDR2
FISYDGNHKYYADSVKG

SEQ ID NO: 2438 - protein, 9 aa, Artificial Sequence
  Description of Artificial Sequence: Synthetic peptide
  XENP020075 vhCDR3
TGLLGPFDL

SEQ ID NO: 2439 - protein, 12 aa, Artificial Sequence
  Description of Artificial Sequence: Synthetic peptide
  XENP020075 vlCDR1
RASQSVGSSYLA

SEQ ID NO: 2440 - protein, 7 aa, Artificial Sequence
  Description of Artificial Sequence: Synthetic peptide
  XENP020075 vlCDR2
GAFSRAT

SEQ ID NO: 2441 - protein, 9 aa, Artificial Sequence
  Description of Artificial Sequence: Synthetic peptide
  XENP020075 vlCDR3
QQYGSSPWT

SEQ ID NO: 2442 - protein, 246 aa, Artificial Sequence
  Description of Artificial Sequence: Synthetic polypeptide
  XENP020076 [CTLA-4]_H3.2_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2443 - protein, 118 aa, Artificial Sequence
  Description of Artificial Sequence: Synthetic polypeptide
  VH of XENP020076
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGLLGPFDLWGQGTMVTVSS

SEQ ID NO: 2444 - protein, 108 aa, Artificial Sequence; identical to SEQ ID NO: 1517
  Description of Artificial Sequence: Synthetic polypeptide
  VL of XENP020076

SEQ ID NO: 2445 - protein, 5 aa, Artificial Sequence
  Description of Artificial Sequence: Synthetic peptide
  XENP020076 vhCDR1
SYTMH

SEQ ID NO: 2446 - protein, 17 aa, Artificial Sequence
  Description of Artificial Sequence: Synthetic peptide
  XENP020076 vhCDR2
FISYDGNTKYYADSVKG

SEQ ID NO: 2447 - protein, 9 aa, Artificial Sequence
  Description of Artificial Sequence: Synthetic peptide
  XENP020076 vhCDR3
TGLLGPFDL

SEQ ID NO: 2448 - protein, 12 aa, Artificial Sequence
  Description of Artificial Sequence: Synthetic peptide
  XENP020076 vlCDR1
RASQSVGSSYLA

SEQ ID NO: 2449 - protein, 7 aa, Artificial Sequence
  Description of Artificial Sequence: Synthetic peptide
  XENP020076 vlCDR2
GAFSRAT

SEQ ID NO: 2450 - protein, 9 aa, Artificial Sequence
  Description of Artificial Sequence: Synthetic peptide
  XENP020076 vlCDR3
QQYGSSPWT

SEQ ID NO: 2451 - protein, 246 aa, Artificial Sequence
  Description of Artificial Sequence: Synthetic polypeptide
  XENP020077 [CTLA-4]_H3.3_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2452 - protein, 118 aa, Artificial Sequence
  Description of Artificial Sequence: Synthetic polypeptide
  VH of XENP020077
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGLLGPFDLWGQGTMVTVSS

SEQ ID NO: 2453 - protein, 108 aa, Artificial Sequence; identical to SEQ ID NO: 1517
  Description of Artificial Sequence: Synthetic polypeptide
  VL of XENP020077

SEQ ID NO: 2454 - protein, 5 aa, Artificial Sequence
  Description of Artificial Sequence: Synthetic peptide
  XENP020077 vhCDR1
SYTMH

SEQ ID NO: 2455 - protein, 17 aa, Artificial Sequence
  Description of Artificial Sequence: Synthetic peptide
  XENP020077 vhCDR2
FISYDGNQKYYADSVKG

SEQ ID NO: 2456 - protein, 9 aa, Artificial Sequence
  Description of Artificial Sequence: Synthetic peptide
  XENP020077 vhCDR3
TGLLGPFDL

SEQ ID NO: 2457 - protein, 12 aa, Artificial Sequence
  Description of Artificial Sequence: Synthetic peptide
  XENP020077 vlCDR1
RASQSVGSSYLA

SEQ ID NO: 2458 - protein, 7 aa, Artificial Sequence
  Description of Artificial Sequence: Synthetic peptide
  XENP020077 vlCDR2
GAFSRAT

SEQ ID NO: 2459 - protein, 9 aa, Artificial Sequence
  Description of Artificial Sequence: Synthetic peptide
  XENP020077 vlCDR3
QQYGSSPWT

SEQ ID NO: 2460 - protein, 246 aa, Artificial Sequence
  Description of Artificial Sequence: Synthetic polypeptide
  XENP020078 [CTLA-4]_H3.4_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2461 - protein, 118 aa, Artificial Sequence
  Description of Artificial Sequence: Synthetic polypeptide
  VH of XENP020078
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS

SEQ ID NO: 2462 - protein, 108 aa, Artificial Sequence; identical to SEQ ID NO: 1517
  Description of Artificial Sequence: Synthetic polypeptide
  VL of XENP020078

SEQ ID NO: 2463 - protein, 5 aa, Artificial Sequence
  Description of Artificial Sequence: Synthetic peptide
  XENP020078 vhCDR1
SYTMH

SEQ ID NO: 2464 - protein, 17 aa, Artificial Sequence
  Description of Artificial Sequence: Synthetic peptide
  XENP020078 vhCDR2
FISYDGNHKYYADSVKG

SEQ ID NO: 2465 - protein, 9 aa, Artificial Sequence
  Description of Artificial Sequence: Synthetic peptide
  XENP020078 vhCDR3
TGHLGPFDL

SEQ ID NO: 2466 - protein, 12 aa, Artificial Sequence
  Description of Artificial Sequence: Synthetic peptide
  XENP020078 vlCDR1
RASQSVGSSYLA

SEQ ID NO: 2467 - protein, 7 aa, Artificial Sequence
  Description of Artificial Sequence: Synthetic peptide
  XENP020078 vlCDR2
GAFSRAT

SEQ ID NO: 2468 - protein, 9 aa, Artificial Sequence
  Description of Artificial Sequence: Synthetic peptide
  XENP020078 vlCDR3
QQYGSSPWT

SEQ ID NO: 2469 - protein, 246 aa, Artificial Sequence
  Description of Artificial Sequence: Synthetic polypeptide
  XENP020079 [CTLA-4]_H3.5_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2470 - protein, 118 aa, Artificial Sequence
  Description of Artificial Sequence: Synthetic polypeptide
  VH of XENP020079
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSS

SEQ ID NO: 2471 - protein, 108 aa, Artificial Sequence; identical to SEQ ID NO: 1517
  Description of Artificial Sequence: Synthetic polypeptide
  VL of XENP020079

SEQ ID NO: 2472 - protein, 5 aa, Artificial Sequence
  Description of Artificial Sequence: Synthetic peptide
  XENP020079 vhCDR1
SYTMH

SEQ ID NO: 2473 - protein, 17 aa, Artificial Sequence
  Description of Artificial Sequence: Synthetic peptide
  XENP020079 vhCDR2
FISYDGNTKYYADSVKG

SEQ ID NO: 2474 - protein, 9 aa, Artificial Sequence
  Description of Artificial Sequence: Synthetic peptide
  XENP020079 vhCDR3
TGHLGPFDL

SEQ ID NO: 2475 - protein, 12 aa, Artificial Sequence
  Description of Artificial Sequence: Synthetic peptide
  XENP020079 vlCDR1
RASQSVGSSYLA

SEQ ID NO: 2476 - protein, 7 aa, Artificial Sequence
  Description of Artificial Sequence: Synthetic peptide
  XENP020079 vlCDR2
GAFSRAT

SEQ ID NO: 2477 - protein, 9 aa, Artificial Sequence
  Description of Artificial Sequence: Synthetic peptide
  XENP020079 vlCDR3
QQYGSSPWT

SEQ ID NO: 2478 - protein, 246 aa, Artificial Sequence
  Description of Artificial Sequence: Synthetic polypeptide
  XENP020080 [CTLA-4]_H3.6_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2479 - protein, 118 aa, Artificial Sequence
  Description of Artificial Sequence: Synthetic polypeptide
  VH of XENP020080
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGHLGPFDLWGQGTMVTVSS

SEQ ID NO: 2480 - protein, 108 aa, Artificial Sequence; identical to SEQ ID NO: 1517
  Description of Artificial Sequence: Synthetic polypeptide
  VL of XENP020080

SEQ ID NO: 2481 - protein, 5 aa, Artificial Sequence
  Description of Artificial Sequence: Synthetic peptide
  XENP020080 vhCDR1
SYTMH

SEQ ID NO: 2482 - protein, 17 aa, Artificial Sequence
  Description of Artificial Sequence: Synthetic peptide
  XENP020080 vhCDR2
FISYDGNQKYYADSVKG

SEQ ID NO: 2483 - protein, 9 aa, Artificial Sequence
  Description of Artificial Sequence: Synthetic peptide
  XENP020080 vhCDR3
TGHLGPFDL

SEQ ID NO: 2484 - protein, 12 aa, Artificial Sequence
  Description of Artificial Sequence: Synthetic peptide
  XENP020080 vlCDR1
RASQSVGSSYLA

SEQ ID NO: 2485 - protein, 7 aa, Artificial Sequence
  Description of Artificial Sequence: Synthetic peptide
  XENP020080 vlCDR2
GAFSRAT

SEQ ID NO: 2486 - protein, 9 aa, Artificial Sequence
  Description of Artificial Sequence: Synthetic peptide
  XENP020080 vlCDR3
QQYGSSPWT

SEQ ID NO: 2487 - protein, 246 aa, Artificial Sequence
  Description of Artificial Sequence: Synthetic polypeptide
  XENP020081 [CTLA-4]_H3.7_L0.12_scFv(GKPGS)4
EVQLVESGGGLVKPGGSLRLSCAASGFTFSSYTMHWVRQAPGKGLEWVCFISYDGNNKYYADSVKGRFTCSRDNAKNSLYLQMNSLRAEDTAVYYCARTGWLGPFDYWGQGTLVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2488 - protein, 118 aa, Artificial Sequence
  Description of Artificial Sequence: Synthetic polypeptide
  VH of XENP020081
EVQLVESGGGLVKPGGSLRLSCAASGFTFSSYTMHWVRQAPGKGLEWVCFISYDGNNKYYADSVKGRFTCSRDNAKNSLYLQMNSLRAEDTAVYYCARTGWLGPFDYWGQGTLVTVSS

SEQ ID NO: 2489 - protein, 108 aa, Artificial Sequence; identical to SEQ ID NO: 1517
  Description of Artificial Sequence: Synthetic polypeptide
  VL of XENP020081

SEQ ID NO: 2490 - protein, 5 aa, Artificial Sequence
  Description of Artificial Sequence: Synthetic peptide
  XENP020081 vhCDR1
SYTMH

SEQ ID NO: 2491 - protein, 17 aa, Artificial Sequence
  Description of Artificial Sequence: Synthetic peptide
  XENP020081 vhCDR2
FISYDGNNKYYADSVKG

SEQ ID NO: 2492 - protein, 9 aa, Artificial Sequence
  Description of Artificial Sequence: Synthetic peptide
  XENP020081 vhCDR3
TGWLGPFDY

SEQ ID NO: 2493 - protein, 12 aa, Artificial Sequence
  Description of Artificial Sequence: Synthetic peptide
  XENP020081 vlCDR1
RASQSVGSSYLA

SEQ ID NO: 2494 - protein, 7 aa, Artificial Sequence
  Description of Artificial Sequence: Synthetic peptide
  XENP020081 vlCDR2
GAFSRAT

SEQ ID NO: 2495 - protein, 9 aa, Artificial Sequence
  Description of Artificial Sequence: Synthetic peptide
  XENP020081 vlCDR3
QQYGSSPWT

SEQ ID NO: 2496 - protein, 246 aa, Artificial Sequence
  Description of Artificial Sequence: Synthetic polypeptide
  XENP020082 [CTLA-4]_H3.8_L0.12_scFv(GKPGS)4
EVQLVESGGGLVKPGGSLRLSCAASGFTFSSYTMHWVRQAPGKCLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2497 - protein, 118 aa, Artificial Sequence
  Description of Artificial Sequence: Synthetic polypeptide
  VH of XENP020082
EVQLVESGGGLVKPGGSLRLSCAASGFTFSSYTMHWVRQAPGKCLEWVSFISYDGNNKYYADSVKGRFTISRDNAKNSLYLQMNSLRAEDTAVYYCARTGWLGPFDYWGQGTLVTVSS

SEQ ID NO: 2498 - protein, 108 aa, Artificial Sequence; identical to SEQ ID NO: 1517
  Description of Artificial Sequence: Synthetic polypeptide
  VL of XENP020082

SEQ ID NO: 2499 - protein, 5 aa, Artificial Sequence
  Description of Artificial Sequence: Synthetic peptide
  XENP020082 vhCDR1
SYTMH

SEQ ID NO: 2500 - protein, 17 aa, Artificial Sequence
  Description of Artificial Sequence: Synthetic peptide
  XENP020082 vhCDR2
FISYDGNNKYYADSVKG

SEQ ID NO: 2501 - protein, 9 aa, Artificial Sequence
  Description of Artificial Sequence: Synthetic peptide
  XENP020082 vhCDR3
TGWLGPFDY

SEQ ID NO: 2502 - protein, 12 aa, Artificial Sequence
  Description of Artificial Sequence: Synthetic peptide
  XENP020082 vlCDR1
RASQSVGSSYLA

SEQ ID NO: 2503 - protein, 7 aa, Artificial Sequence
  Description of Artificial Sequence: Synthetic peptide
  XENP020082 vlCDR2
GAFSRAT

SEQ ID NO: 2504 - protein, 9 aa, Artificial Sequence
  Description of Artificial Sequence: Synthetic peptide
  XENP020082 vlCDR3
QQYGSSPWT

SEQ ID NO: 2505 - protein, 246 aa, Artificial Sequence
  Description of Artificial Sequence: Synthetic polypeptide
  XENP020360 [CTLA-4]_H3.9_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2506 - protein, 118 aa, Artificial Sequence
  Description of Artificial Sequence: Synthetic polypeptide
  VH of XENP020360
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGHLGPFDLWGQGTMVTVSS

SEQ ID NO: 2507 - protein, 108 aa, Artificial Sequence; identical to SEQ ID NO: 1517
  Description of Artificial Sequence: Synthetic polypeptide
  VL of XENP020360

SEQ ID NO: 2508 - protein, 5 aa, Artificial Sequence
  Description of Artificial Sequence: Synthetic peptide
  XENP020360 vhCDR1
SYTMH

SEQ ID NO: 2509 - protein, 17 aa, Artificial Sequence
  Description of Artificial Sequence: Synthetic peptide
  XENP020360 vhCDR2
FISYDGNYKYYADSVKG

SEQ ID NO: 2510 - protein, 9 aa, Artificial Sequence
  Description of Artificial Sequence: Synthetic peptide
  XENP020360 vhCDR3
TGHLGPFDL

SEQ ID NO: 2511 - protein, 12 aa, Artificial Sequence
  Description of Artificial Sequence: Synthetic peptide
  XENP020360 vlCDR1
RASQSVGSSYLA

SEQ ID NO: 2512 - protein, 7 aa, Artificial Sequence
  Description of Artificial Sequence: Synthetic peptide
  XENP020360 vlCDR2
GAFSRAT

SEQ ID NO: 2513 - protein, 9 aa, Artificial Sequence
  Description of Artificial Sequence: Synthetic peptide
  XENP020360 vlCDR3
QQYGSSPWT

SEQ ID NO: 2514 - protein, 246 aa, Artificial Sequence
  Description of Artificial Sequence: Synthetic polypeptide
  XENP020361 [CTLA-4]_H3.10_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2515 - protein, 118 aa, Artificial Sequence
  Description of Artificial Sequence: Synthetic polypeptide
  VH of XENP020361
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGLLGPFDLWGQGTMVTVSS

SEQ ID NO: 2516 - protein, 108 aa, Artificial Sequence; identical to SEQ ID NO: 1517
  Description of Artificial Sequence: Synthetic polypeptide
  VL of XENP020361

SEQ ID NO: 2517 - protein, 5 aa, Artificial Sequence
  Description of Artificial Sequence: Synthetic peptide
  XENP020361 vhCDR1
SYTMH

SEQ ID NO: 2518 - protein, 17 aa, Artificial Sequence
  Description of Artificial Sequence: Synthetic peptide
  XENP020361 vhCDR2
FISYDGNYKYYADSVKG

SEQ ID NO: 2519 - protein, 9 aa, Artificial Sequence
  Description of Artificial Sequence: Synthetic peptide
  XENP020361 vhCDR3
TGLLGPFDL

SEQ ID NO: 2520 - protein, 12 aa, Artificial Sequence
  Description of Artificial Sequence: Synthetic peptide
  XENP020361 vlCDR1
RASQSVGSSYLA

SEQ ID NO: 2521 - protein, 7 aa, Artificial Sequence
  Description of Artificial Sequence: Synthetic peptide
  XENP020361 vlCDR2
GAFSRAT

SEQ ID NO: 2522 - protein, 9 aa, Artificial Sequence
  Description of Artificial Sequence: Synthetic peptide
  XENP020361 vlCDR3
QQYGSSPWT

SEQ ID NO: 2523 - protein, 246 aa, Artificial Sequence
  Description of Artificial Sequence: Synthetic polypeptide
  XENP020362 [CTLA-4]_H3.11_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2524 - protein, 118 aa, Artificial Sequence
  Description of Artificial Sequence: Synthetic polypeptide
  VH of XENP020362
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGHLGPFDLWGQGTMVTVSS

SEQ ID NO: 2525 - protein, 108 aa, Artificial Sequence; identical to SEQ ID NO: 1517
  Description of Artificial Sequence: Synthetic polypeptide
  VL of XENP020362

SEQ ID NO: 2526 - protein, 5 aa, Artificial Sequence
  Description of Artificial Sequence: Synthetic peptide
  XENP020362 vhCDR1
SYTMH

SEQ ID NO: 2527 - protein, 17 aa, Artificial Sequence
  Description of Artificial Sequence: Synthetic peptide
  XENP020362 vhCDR2
FISYDGNHKYYADSVKG

SEQ ID NO: 2528 - protein, 9 aa, Artificial Sequence
  Description of Artificial Sequence: Synthetic peptide
  XENP020362 vhCDR3
GGHLGPFDL

SEQ ID NO: 2529 - protein, 12 aa, Artificial Sequence
  Description of Artificial Sequence: Synthetic peptide
  XENP020362 vlCDR1
RASQSVGSSYLA

SEQ ID NO: 2530 - protein, 7 aa, Artificial Sequence
  Description of Artificial Sequence: Synthetic peptide
  XENP020362 vlCDR2
GAFSRAT

SEQ ID NO: 2531 - protein, 9 aa, Artificial Sequence
  Description of Artificial Sequence: Synthetic peptide
  XENP020362 vlCDR3
QQYGSSPWT

SEQ ID NO: 2532 - protein, 246 aa, Artificial Sequence
  Description of Artificial Sequence: Synthetic polypeptide
  XENP020363 [CTLA-4]_H3.12_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2533 - protein, 118 aa, Artificial Sequence
  Description of Artificial Sequence: Synthetic polypeptide
  VH of XENP020363
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSHLGPFDLWGQGTMVTVSS

SEQ ID NO: 2534 - protein, 108 aa, Artificial Sequence; identical to SEQ ID NO: 1517
  Description of Artificial Sequence: Synthetic polypeptide
  VL of XENP020363

SEQ ID NO: 2535 - protein, 5 aa, Artificial Sequence
  Description of Artificial Sequence: Synthetic peptide
  XENP020363 vhCDR1
SYTMH

SEQ ID NO: 2536 - protein, 17 aa, Artificial Sequence
  Description of Artificial Sequence: Synthetic peptide
  XENP020363 vhCDR2
FISYDGNHKYYADSVKG

SEQ ID NO: 2537 - protein, 9 aa, Artificial Sequence
  Description of Artificial Sequence: Synthetic peptide
  XENP020363 vhCDR3
TSHLGPFDL

SEQ ID NO: 2538 - protein, 12 aa, Artificial Sequence
  Description of Artificial Sequence: Synthetic peptide
  XENP020363 vlCDR1
RASQSVGSSYLA

SEQ ID NO: 2539 - protein, 7 aa, Artificial Sequence
  Description of Artificial Sequence: Synthetic peptide
  XENP020363 vlCDR2
GAFSRAT

SEQ ID NO: 2540 - protein, 9 aa, Artificial Sequence
  Description of Artificial Sequence: Synthetic peptide
  XENP020363 vlCDR3
QQYGSSPWT

SEQ ID NO: 2541 - protein, 246 aa, Artificial Sequence
  Description of Artificial Sequence: Synthetic polypeptide
  XENP020364 [CTLA-4]_H3.13_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2542 - protein, 118 aa, Artificial Sequence
  Description of Artificial Sequence: Synthetic polypeptide
  VH of XENP020364
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGLLGPFDLWGQGTMVTVSS

SEQ ID NO: 2543 - protein, 108 aa, Artificial Sequence; identical to SEQ ID NO: 1517
  Description of Artificial Sequence: Synthetic polypeptide
  VL of XENP020364

SEQ ID NO: 2544 - protein, 5 aa, Artificial Sequence
  Description of Artificial Sequence: Synthetic peptide
  XENP020364 vhCDR1
SYTMH

SEQ ID NO: 2545 - protein, 17 aa, Artificial Sequence
  Description of Artificial Sequence: Synthetic peptide
  XENP020364 vhCDR2
FISYDGNHKYYADSVKG

SEQ ID NO: 2546 - protein, 9 aa, Artificial Sequence
  Description of Artificial Sequence: Synthetic peptide
  XENP020364 vhCDR3
GGLLGPFDL

SEQ ID NO: 2547 - protein, 12 aa, Artificial Sequence
  Description of Artificial Sequence: Synthetic peptide
  XENP020364 vlCDR1
RASQSVGSSYLA

SEQ ID NO: 2548 - protein, 7 aa, Artificial Sequence
  Description of Artificial Sequence: Synthetic peptide
  XENP020364 vlCDR2
GAFSRAT

SEQ ID NO: 2549 - protein, 9 aa, Artificial Sequence
  Description of Artificial Sequence: Synthetic peptide
  XENP020364 vlCDR3
QQYGSSPWT

SEQ ID NO: 2550 - protein, 246 aa, Artificial Sequence
  Description of Artificial Sequence: Synthetic polypeptide
  XENP020365 [CTLA-4]_H3.14_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2551 - protein, 118 aa, Artificial Sequence
  Description of Artificial Sequence: Synthetic polypeptide
  VH of XENP020365
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSLLGPFDLWGQGTMVTVSS

SEQ ID NO: 2552 - protein, 108 aa, Artificial Sequence; identical to SEQ ID NO: 1517
  Description of Artificial Sequence: Synthetic polypeptide
  VL of XENP020365

SEQ ID NO: 2553 - protein, 5 aa, Artificial Sequence
  Description of Artificial Sequence: Synthetic peptide
  XENP020365 vhCDR1
SYTMH

SEQ ID NO: 2554 - protein, 17 aa, Artificial Sequence
  Description of Artificial Sequence: Synthetic peptide
  XENP020365 vhCDR2
FISYDGNHKYYADSVKG

SEQ ID NO: 2555 - protein, 9 aa, Artificial Sequence
  Description of Artificial Sequence: Synthetic peptide
  XENP020365 vhCDR3
TSLLGPFDL

SEQ ID NO: 2556 - protein, 12 aa, Artificial Sequence
  Description of Artificial Sequence: Synthetic peptide
  XENP020365 vlCDR1
RASQSVGSSYLA

SEQ ID NO: 2557 - protein, 7 aa, Artificial Sequence
  Description of Artificial Sequence: Synthetic peptide
  XENP020365 vlCDR2
GAFSRAT

SEQ ID NO: 2558 - protein, 9 aa, Artificial Sequence
  Description of Artificial Sequence: Synthetic peptide
  XENP020365 vlCDR3
QQYGSSPWT

SEQ ID NO: 2559 - protein, 246 aa, Artificial Sequence
  Description of Artificial Sequence: Synthetic polypeptide
  XENP020366 [CTLA-4]_H3.15_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2560 - protein, 118 aa, Artificial Sequence
  Description of Artificial Sequence: Synthetic polypeptide
  VH of XENP020366
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGHLGPFDLWGQGTMVTVSS

SEQ ID NO: 2561 - protein, 108 aa, Artificial Sequence; identical to SEQ ID NO: 1517
  Description of Artificial Sequence: Synthetic polypeptide
  VL of XENP020366

SEQ ID NO: 2562 - protein, 5 aa, Artificial Sequence
  Description of Artificial Sequence: Synthetic peptide
  XENP020366 vhCDR1
SYTMH

SEQ ID NO: 2563 - protein, 17 aa, Artificial Sequence
  Description of Artificial Sequence: Synthetic peptide
  XENP020366 vhCDR2
FISYDGNQKYYADSVKG

SEQ ID NO: 2564 - protein, 9 aa, Artificial Sequence
  Description of Artificial Sequence: Synthetic peptide
  XENP020366 vhCDR3
GGHLGPFDL

SEQ ID NO: 2565 - protein, 12 aa, Artificial Sequence
  Description of Artificial Sequence: Synthetic peptide
  XENP020366 vlCDR1
RASQSVGSSYLA

SEQ ID NO: 2566 - protein, 7 aa, Artificial Sequence
  Description of Artificial Sequence: Synthetic peptide
  XENP020366 vlCDR2
GAFSRAT

SEQ ID NO: 2567 - protein, 9 aa, Artificial Sequence
  Description of Artificial Sequence: Synthetic peptide
  XENP020366 vlCDR3
QQYGSSPWT

SEQ ID NO: 2568 - protein, 246 aa, Artificial Sequence
  Description of Artificial Sequence: Synthetic polypeptide
  XENP020367 [CTLA-4]_H3.16_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2569 - protein, 118 aa, Artificial Sequence
  Description of Artificial Sequence: Synthetic polypeptide
  VH of XENP020367
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSHLGPFDLWGQGTMVTVSS

SEQ ID NO: 2570 - protein, 108 aa, Artificial Sequence; identical to SEQ ID NO: 1517
  Description of Artificial Sequence: Synthetic polypeptide
  VL of XENP020367

SEQ ID NO: 2571 - protein, 5 aa, Artificial Sequence
  Description of Artificial Sequence: Synthetic peptide
  XENP020367 vhCDR1
SYTMH

SEQ ID NO: 2572 - protein, 17 aa, Artificial Sequence
  Description of Artificial Sequence: Synthetic peptide
  XENP020367 vhCDR2
FISYDGNQKYYADSVKG

SEQ ID NO: 2573 - protein, 9 aa, Artificial Sequence
  Description of Artificial Sequence: Synthetic peptide
  XENP020367 vhCDR3
TSHLGPFDL

SEQ ID NO: 2574 - protein, 12 aa, Artificial Sequence
  Description of Artificial Sequence: Synthetic peptide
  XENP020367 vlCDR1
RASQSVGSSYLA

SEQ ID NO: 2575 - protein, 7 aa, Artificial Sequence
  Description of Artificial Sequence: Synthetic peptide
  XENP020367 vlCDR2
GAFSRAT

SEQ ID NO: 2576 - protein, 9 aa, Artificial Sequence
  Description of Artificial Sequence: Synthetic peptide
  XENP020367 vlCDR3
QQYGSSPWT

SEQ ID NO: 2577 - protein, 246 aa, Artificial Sequence
  Description of Artificial Sequence: Synthetic polypeptide
  XENP020368 [CTLA-4]_H3.17_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2578 - protein, 118 aa, Artificial Sequence
  Description of Artificial Sequence: Synthetic polypeptide
  VH of XENP020368
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGLLGPFDLWGQGTMVTVSS

SEQ ID NO: 2579 - protein, 108 aa, Artificial Sequence; identical to SEQ ID NO: 1517
  Description of Artificial Sequence: Synthetic polypeptide
  VL of XENP020368

SEQ ID NO: 2580 - protein, 5 aa, Artificial Sequence
  Description of Artificial Sequence: Synthetic peptide
  XENP020368 vhCDR1
SYTMH

SEQ ID NO: 2581 - protein, 17 aa, Artificial Sequence
  Description of Artificial Sequence: Synthetic peptide
  XENP020368 vhCDR2
FISYDGNQKYYADSVKG

SEQ ID NO: 2582 - protein, 9 aa, Artificial Sequence
  Description of Artificial Sequence: Synthetic peptide
  XENP020368 vhCDR3
GGLLGPFDL

SEQ ID NO: 2583 - protein, 12 aa, Artificial Sequence
  Description of Artificial Sequence: Synthetic peptide
  XENP020368 vlCDR1
RASQSVGSSYLA

SEQ ID NO: 2584 - protein, 7 aa, Artificial Sequence
  Description of Artificial Sequence: Synthetic peptide
  XENP020368 vlCDR2
GAFSRAT

SEQ ID NO: 2585 - protein, 9 aa, Artificial Sequence
  Description of Artificial Sequence: Synthetic peptide
  XENP020368 vlCDR3
QQYGSSPWT

SEQ ID NO: 2586 - protein, 246 aa, Artificial Sequence
  Description of Artificial Sequence: Synthetic polypeptide
  XENP020369 [CTLA-4]_H3.18_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2587 - protein, 118 aa, Artificial Sequence
  Description of Artificial Sequence: Synthetic polypeptide
  VH of XENP020369
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSLLGPFDLWGQGTMVTVSS

SEQ ID NO: 2588 - protein, 108 aa, Artificial Sequence; identical to SEQ ID NO: 1517
  Description of Artificial Sequence: Synthetic polypeptide
  VL of XENP020369

SEQ ID NO: 2589 - protein, 5 aa, Artificial Sequence
  Description of Artificial Sequence: Synthetic peptide
  XENP020369 vhCDR1
SYTMH

SEQ ID NO: 2590 - protein, 17 aa, Artificial Sequence
  Description of Artificial Sequence: Synthetic peptide
  XENP020369 vhCDR2
FISYDGNQKYYADSVKG

SEQ ID NO: 2591 - protein, 9 aa, Artificial Sequence
  Description of Artificial Sequence: Synthetic peptide
  XENP020369 vhCDR3
TSLLGPFDL

SEQ ID NO: 2592 - protein, 12 aa, Artificial Sequence
  Description of Artificial Sequence: Synthetic peptide
  XENP020369 vlCDR1
RASQSVGSSYLA

SEQ ID NO: 2593 - protein, 7 aa, Artificial Sequence
  Description of Artificial Sequence: Synthetic peptide
  XENP020369 vlCDR2
GAFSRAT

SEQ ID NO: 2594 - protein, 9 aa, Artificial Sequence
  Description of Artificial Sequence: Synthetic peptide
  XENP020369 vlCDR3
QQYGSSPWT

SEQ ID NO: 2595 - protein, 246 aa, Artificial Sequence
  Description of Artificial Sequence: Synthetic polypeptide
  XENP020370 [CTLA-4]_H3.19_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2596 - protein, 118 aa, Artificial Sequence
  Description of Artificial Sequence: Synthetic polypeptide
  VH of XENP020370
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGHLGPFDLWGQGTMVTVSS

SEQ ID NO: 2597 - protein, 108 aa, Artificial Sequence; identical to SEQ ID NO: 1517
  Description of Artificial Sequence: Synthetic polypeptide
  VL of XENP020370

SEQ ID NO: 2598 - protein, 5 aa, Artificial Sequence
  Description of Artificial Sequence: Synthetic peptide
  XENP020370 vhCDR1
SYTMH

SEQ ID NO: 2599 - protein, 17 aa, Artificial Sequence
  Description of Artificial Sequence: Synthetic peptide
  XENP020370 vhCDR2
FISYDGNTKYYADSVKG

SEQ ID NO: 2600 - protein, 9 aa, Artificial Sequence
  Description of Artificial Sequence: Synthetic peptide
  XENP020370 vhCDR3
GGHLGPFDL

SEQ ID NO: 2601 - protein, 12 aa, Artificial Sequence
  Description of Artificial Sequence: Synthetic peptide
  XENP020370 vlCDR1
RASQSVGSSYLA

SEQ ID NO: 2602 - protein, 7 aa, Artificial Sequence
  Description of Artificial Sequence: Synthetic peptide
  XENP020370 vlCDR2
GAFSRAT

SEQ ID NO: 2603 - protein, 9 aa, Artificial Sequence
  Description of Artificial Sequence: Synthetic peptide
  XENP020370 vlCDR3
QQYGSSPWT

SEQ ID NO: 2604 - protein, 246 aa, Artificial Sequence
  Description of Artificial Sequence: Synthetic polypeptide
  XENP020371 [CTLA-4]_H3.20_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2605 - protein, 118 aa, Artificial Sequence
  Description of Artificial Sequence: Synthetic polypeptide
  VH of XENP020371
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSHLGPFDLWGQGTMVTVSS

SEQ ID NO: 2606 - protein, 108 aa, Artificial Sequence; identical to SEQ ID NO: 1517
  Description of Artificial Sequence: Synthetic polypeptide
  VL of XENP020371

SEQ ID NO: 2607 - protein, 5 aa, Artificial Sequence
  Description of Artificial Sequence: Synthetic peptide
  XENP020371 vhCDR1
SYTMH

SEQ ID NO: 2608 - protein, 17 aa, Artificial Sequence
  Description of Artificial Sequence: Synthetic peptide
  XENP020371 vhCDR2
FISYDGNTKYYADSVKG

SEQ ID NO: 2609 - protein, 9 aa, Artificial Sequence
  Description of Artificial Sequence: Synthetic peptide
  XENP020371 vhCDR3
TSHLGPFDL

SEQ ID NO: 2610 - protein, 12 aa, Artificial Sequence
  Description of Artificial Sequence: Synthetic peptide
  XENP020371 vlCDR1
RASQSVGSSYLA

SEQ ID NO: 2611 - protein, 7 aa, Artificial Sequence
  Description of Artificial Sequence: Synthetic peptide
  XENP020371 vlCDR2
GAFSRAT

SEQ ID NO: 2612 - protein, 9 aa, Artificial Sequence
  Description of Artificial Sequence: Synthetic peptide
  XENP020371 vlCDR3
QQYGSSPWT

SEQ ID NO: 2613 - protein, 246 aa, Artificial Sequence
  Description of Artificial Sequence: Synthetic polypeptide
  XENP020372 [CTLA-4]_H3.21_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2614 - protein, 118 aa, Artificial Sequence
  Description of Artificial Sequence: Synthetic polypeptide
  VH of XENP020372
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSS

SEQ ID NO: 2615 - protein, 108 aa, Artificial Sequence; identical to SEQ ID NO: 1517
  Description of Artificial Sequence: Synthetic polypeptide
  VL of XENP020372

SEQ ID NO: 2616 - protein, 5 aa, Artificial Sequence
  Description of Artificial Sequence: Synthetic peptide
  XENP020372 vhCDR1
SYTMH

SEQ ID NO: 2617 - protein, 17 aa, Artificial Sequence
  Description of Artificial Sequence: Synthetic peptide
  XENP020372 vhCDR2
FISYDGNTKYYADSVKG

SEQ ID NO: 2618 - protein, 9 aa, Artificial Sequence
  Description of Artificial Sequence: Synthetic peptide
  XENP020372 vhCDR3
GGLLGPFDL

SEQ ID NO: 2619 - protein, 12 aa, Artificial Sequence
  Description of Artificial Sequence: Synthetic peptide
  XENP020372 vlCDR1
RASQSVGSSYLA

SEQ ID NO: 2620 - protein, 7 aa, Artificial Sequence
  Description of Artificial Sequence: Synthetic peptide
  XENP020372 vlCDR2
GAFSRAT

SEQ ID NO: 2621 - protein, 9 aa, Artificial Sequence
  Description of Artificial Sequence: Synthetic peptide
  XENP020372 vlCDR3
QQYGSSPWT

SEQ ID NO: 2622 - protein, 246 aa, Artificial Sequence
  Description of Artificial Sequence: Synthetic polypeptide
  XENP020373 [CTLA-4]_H3.22_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2623 - protein, 118 aa, Artificial Sequence
  Description of Artificial Sequence: Synthetic polypeptide
  VH of XENP020373
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSLLGPFDLWGQGTMVTVSS

SEQ ID NO: 2624 - protein, 108 aa, Artificial Sequence; identical to SEQ ID NO: 1517
  Description of Artificial Sequence: Synthetic polypeptide
  VL of XENP020373

SEQ ID NO: 2625 - protein, 5 aa, Artificial Sequence
  Description of Artificial Sequence: Synthetic peptide
  XENP020373 vhCDR1
SYTMH

SEQ ID NO: 2626 - protein, 17 aa, Artificial Sequence
  Description of Artificial Sequence: Synthetic peptide
  XENP020373 vhCDR2
FISYDGNTKYYADSVKG

SEQ ID NO: 2627 - protein, 9 aa, Artificial Sequence
  Description of Artificial Sequence: Synthetic peptide
  XENP020373 vhCDR3
TSLLGPFDL

SEQ ID NO: 2628 - protein, 12 aa, Artificial Sequence
  Description of Artificial Sequence: Synthetic peptide
  XENP020373 vlCDR1
RASQSVGSSYLA

SEQ ID NO: 2629 - protein, 7 aa, Artificial Sequence
  Description of Artificial Sequence: Synthetic peptide
  XENP020373 vlCDR2
GAFSRAT

SEQ ID NO: 2630 - protein, 9 aa, Artificial Sequence
  Description of Artificial Sequence: Synthetic peptide
  XENP020373 vlCDR3
QQYGSSPWT

SEQ ID NO: 2631 - protein, 246 aa, Artificial Sequence
  Description of Artificial Sequence: Synthetic polypeptide
  XENP020374 [CTLA-4]_H3.23_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2632 - protein, 118 aa, Artificial Sequence
  Description of Artificial Sequence: Synthetic polypeptide
  VH of XENP020374
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSS

SEQ ID NO: 2633 - protein, 108 aa, Artificial Sequence; identical to SEQ ID NO: 1517
  Description of Artificial Sequence: Synthetic polypeptide
  VL of XENP020374

SEQ ID NO: 2634 - protein, 5 aa, Artificial Sequence
  Description of Artificial Sequence: Synthetic peptide
  XENP020374 vhCDR1
SYTMH

SEQ ID NO: 2635 - protein, 17 aa, Artificial Sequence
  Description of Artificial Sequence: Synthetic peptide
  XENP020374 vhCDR2
FISYDGNYKYYADSVKG

SEQ ID NO: 2636 - protein, 9 aa, Artificial Sequence
  Description of Artificial Sequence: Synthetic peptide
  XENP020374 vhCDR3
GGHLGPFDL

SEQ ID NO: 2637 - protein, 12 aa, Artificial Sequence
  Description of Artificial Sequence: Synthetic peptide
  XENP020374 vlCDR1
RASQSVGSSYLA

SEQ ID NO: 2638 - protein, 7 aa, Artificial Sequence
  Description of Artificial Sequence: Synthetic peptide
  XENP020374 vlCDR2
GAFSRAT

SEQ ID NO: 2639 - protein, 9 aa, Artificial Sequence
  Description of Artificial Sequence: Synthetic peptide
  XENP020374 vlCDR3
QQYGSSPWT

SEQ ID NO: 2640 - protein, 246 aa, Artificial Sequence
  Description of Artificial Sequence: Synthetic polypeptide
  XENP020375 [CTLA-4]_H3.24_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2641 - protein, 118 aa, Artificial Sequence
  Description of Artificial Sequence: Synthetic polypeptide
  VH of XENP020375
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSHLGPFDLWGQGTMVTVSS

SEQ ID NO: 2642 - protein, 108 aa, Artificial Sequence; identical to SEQ ID NO: 1517
  Description of Artificial Sequence: Synthetic polypeptide
  VL of XENP020375

SEQ ID NO: 2643 - protein, 5 aa, Artificial Sequence
  Description of Artificial Sequence: Synthetic peptide
  XENP020375 vhCDR1
SYTMH

SEQ ID NO: 2644 - protein, 17 aa, Artificial Sequence
  Description of Artificial Sequence: Synthetic peptide
  XENP020375 vhCDR2
FISYDGNYKYYADSVKG

SEQ ID NO: 2645 - protein, 9 aa, Artificial Sequence
  Description of Artificial Sequence: Synthetic peptide
  XENP020375 vhCDR3
TSHLGPFDL

SEQ ID NO: 2646 - protein, 12 aa, Artificial Sequence
  Description of Artificial Sequence: Synthetic peptide
  XENP020375 vlCDR1
RASQSVGSSYLA

SEQ ID NO: 2647 - protein, 7 aa, Artificial Sequence
  Description of Artificial Sequence: Synthetic peptide
  XENP020375 vlCDR2
GAFSRAT

SEQ ID NO: 2648 - protein, 9 aa, Artificial Sequence
  Description of Artificial Sequence: Synthetic peptide
  XENP020375 vlCDR3
QQYGSSPWT

SEQ ID NO: 2649 - protein, 246 aa, Artificial Sequence
  Description of Artificial Sequence: Synthetic polypeptide
  XENP020376 [CTLA-4]_H3.25_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2650 - protein, 118 aa, Artificial Sequence
  Description of Artificial Sequence: Synthetic polypeptide
  VH of XENP020376
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSS

SEQ ID NO: 2651 - protein, 108 aa, Artificial Sequence; identical to SEQ ID NO: 1517
  Description of Artificial Sequence: Synthetic polypeptide
  VL of XENP020376

SEQ ID NO: 2652 - protein, 5 aa, Artificial Sequence
  Description of Artificial Sequence: Synthetic peptide
  XENP020376 vhCDR1
SYTMH

SEQ ID NO: 2653 - protein, 17 aa, Artificial Sequence
  Description of Artificial Sequence: Synthetic peptide
  XENP020376 vhCDR2
FISYDGNYKYYADSVKG

SEQ ID NO: 2654 - protein, 9 aa, Artificial Sequence
  Description of Artificial Sequence: Synthetic peptide
  XENP020376 vhCDR3
GGLLGPFDL

SEQ ID NO: 2655 - protein, 12 aa, Artificial Sequence
  Description of Artificial Sequence: Synthetic peptide
  XENP020376 vlCDR1
RASQSVGSSYLA

SEQ ID NO: 2656 - protein, 7 aa, Artificial Sequence
  Description of Artificial Sequence: Synthetic peptide
  XENP020376 vlCDR2
GAFSRAT

SEQ ID NO: 2657 - protein, 9 aa, Artificial Sequence
  Description of Artificial Sequence: Synthetic peptide
  XENP020376 vlCDR3
QQYGSSPWT

SEQ ID NO: 2658 - protein, 246 aa, Artificial Sequence
  Description of Artificial Sequence: Synthetic polypeptide
  XENP020377 [CTLA-4]_H3.26_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2659 - protein, 118 aa, Artificial Sequence
  Description of Artificial Sequence: Synthetic polypeptide
  VH of XENP020377
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSLLGPFDLWGQGTMVTVSS

SEQ ID NO: 2660 - protein, 108 aa, Artificial Sequence; identical to SEQ ID NO: 1517
  Description of Artificial Sequence: Synthetic polypeptide
  VL of XENP020377

SEQ ID NO: 2661 - protein, 5 aa, Artificial Sequence
  Description of Artificial Sequence: Synthetic peptide
  XENP020377 vhCDR1
SYTMH

SEQ ID NO: 2662 - protein, 17 aa, Artificial Sequence
  Description of Artificial Sequence: Synthetic peptide
  XENP020377 vhCDR2
FISYDGNYKYYADSVKG

SEQ ID NO: 2663 - protein, 9 aa, Artificial Sequence
  Description of Artificial Sequence: Synthetic peptide
  XENP020377 vhCDR3
TSLLGPFDL

SEQ ID NO: 2664 - protein, 12 aa, Artificial Sequence
  Description of Artificial Sequence: Synthetic peptide
  XENP020377 vlCDR1
RASQSVGSSYLA

SEQ ID NO: 2665 - protein, 7 aa, Artificial Sequence
  Description of Artificial Sequence: Synthetic peptide
  XENP020377 vlCDR2
GAFSRAT

SEQ ID NO: 2666 - protein, 9 aa, Artificial Sequence
  Description of Artificial Sequence: Synthetic peptide
  XENP020377 vlCDR3
QQYGSSPWT

SEQ ID NO: 2667 - protein, 246 aa, Artificial Sequence
  Description of Artificial Sequence: Synthetic polypeptide
  XENP020378 [CTLA-4]_H3.4_L0.118_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2668 - protein, 118 aa, Artificial Sequence; identical to SEQ ID NO: 2461
  Description of Artificial Sequence: Synthetic polypeptide
  VH of XENP020378

SEQ ID NO: 2669 - protein, 108 aa, Artificial Sequence
  Description of Artificial Sequence: Synthetic polypeptide
  VL of XENP020378
EIVLTQSPATLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2670 - protein, 5 aa, Artificial Sequence
  Description of Artificial Sequence: Synthetic peptide
  XENP020378 vhCDR1
SYTMH

SEQ ID NO: 2671 - protein, 17 aa, Artificial Sequence
  Description of Artificial Sequence: Synthetic peptide
  XENP020378 vhCDR2
FISYDGNHKYYADSVKG

SEQ ID NO: 2672 - protein, 9 aa, Artificial Sequence
  Description of Artificial Sequence: Synthetic peptide
  XENP020378 vhCDR3
TGHLGPFDL

SEQ ID NO: 2673 - protein, 12 aa, Artificial Sequence
  Description of Artificial Sequence: Synthetic peptide
  XENP020378 vlCDR1
RASQSVGSSYLA

SEQ ID NO: 2674 - protein, 7 aa, Artificial Sequence
  Description of Artificial Sequence: Synthetic peptide
  XENP020378 vlCDR2
GAFSRAT

SEQ ID NO: 2675 - protein, 9 aa, Artificial Sequence
  Description of Artificial Sequence: Synthetic peptide
  XENP020378 vlCDR3
QQYGSSPWT

SEQ ID NO: 2676 - protein, 246 aa, Artificial Sequence
  Description of Artificial Sequence: Synthetic polypeptide
  XENP020379 [CTLA-4]_H3.4_L0.119_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2677 - protein, 118 aa, Artificial Sequence; identical to SEQ ID NO: 2461
  Description of Artificial Sequence: Synthetic polypeptide
  VH of XENP020379

SEQ ID NO: 2678 - protein, 108 aa, Artificial Sequence; identical to SEQ ID NO: 23
  Description of Artificial Sequence: Synthetic polypeptide
  VL of XENP020379

SEQ ID NO: 2679 - protein, 5 aa, Artificial Sequence
  Description of Artificial Sequence: Synthetic peptide
  XENP020379 vhCDR1
SYTMH

SEQ ID NO: 2680 - protein, 17 aa, Artificial Sequence
  Description of Artificial Sequence: Synthetic peptide
  XENP020379 vhCDR2
FISYDGNHKYYADSVKG

SEQ ID NO: 2681 - protein, 9 aa, Artificial Sequence
  Description of Artificial Sequence: Synthetic peptide
  XENP020379 vhCDR3
TGHLGPFDL

SEQ ID NO: 2682 - protein, 12 aa, Artificial Sequence
  Description of Artificial Sequence: Synthetic peptide
  XENP020379 vlCDR1
RASQSVGSSYLA

SEQ ID NO: 2683 - protein, 7 aa, Artificial Sequence
  Description of Artificial Sequence: Synthetic peptide
  XENP020379 vlCDR2
GAFSRAT

SEQ ID NO: 2684 - protein, 9 aa, Artificial Sequence
  Description of Artificial Sequence: Synthetic peptide
  XENP020379 vlCDR3
QQYGSSPWT

SEQ ID NO: 2685 - protein, 246 aa, Artificial Sequence
  Description of Artificial Sequence: Synthetic polypeptide
  XENP020380 [CTLA-4]_H3.4_L0.120_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 2686 - protein, 118 aa, Artificial Sequence; identical to SEQ ID NO: 2461
  Description of Artificial Sequence: Synthetic polypeptide
  VH of XENP020380

SEQ ID NO: 2687 - protein, 108 aa, Artificial Sequence
  Description of Artificial Sequence: Synthetic polypeptide
  VL of XENP020380
EIVLTQSPGTLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 2688 - protein, 5 aa, Artificial Sequence
  Description of Artificial Sequence: Synthetic peptide
  XENP020380 vhCDR1
SYTMH

SEQ ID NO: 2689 - protein, 17 aa, Artificial Sequence
  Description of Artificial Sequence: Synthetic peptide
  XENP020380 vhCDR2
FISYDGNHKYYADSVKG

SEQ ID NO: 2690 - protein, 9 aa, Artificial Sequence
  Description of Artificial Sequence: Synthetic peptide
  XENP020380 vhCDR3
TGHLGPFDL

SEQ ID NO: 2691 - protein, 12 aa, Artificial Sequence
  Description of Artificial Sequence: Synthetic peptide
  XENP020380 vlCDR1
RASQSVSSSYLA

SEQ ID NO: 2692 - protein, 7 aa, Artificial Sequence
  Description of Artificial Sequence: Synthetic peptide
  XENP020380 vlCDR2
GAFSRAT

SEQ ID NO: 2693 - protein, 9 aa, Artificial Sequence
  Description of Artificial Sequence: Synthetic peptide
  XENP020380 vlCDR3
QQYGSSPWT

SEQ ID NO: 2694 - protein, 246 aa, Artificial Sequence
  Description of Artificial Sequence: Synthetic polypeptide
  XENP020381 [CTLA-4]_H3.4_L0.121_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2695 - protein, 118 aa, Artificial Sequence; identical to SEQ ID NO: 2461
  Description of Artificial Sequence: Synthetic polypeptide
  VH of XENP020381

SEQ ID NO: 2696 - protein, 108 aa, Artificial Sequence
  Description of Artificial Sequence: Synthetic polypeptide
  VL of XENP020381
EIVLTQSPGTLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2697 - protein, 5 aa, Artificial Sequence
  Description of Artificial Sequence: Synthetic peptide
  XENP020381 vhCDR1
SYTMH

SEQ ID NO: 2698 - protein, 17 aa, Artificial Sequence
  Description of Artificial Sequence: Synthetic peptide
  XENP020381 vhCDR2
FISYDGNHKYYADSVKG

SEQ ID NO: 2699 - protein, 9 aa, Artificial Sequence
  Description of Artificial Sequence: Synthetic peptide
  XENP020381 vhCDR3
TGHLGPFDL

SEQ ID NO: 2700 - protein, 12 aa, Artificial Sequence
  Description of Artificial Sequence: Synthetic peptide
  XENP020381 vlCDR1
RASQSVGSSYLA

SEQ ID NO: 2701 - protein, 7 aa, Artificial Sequence
  Description of Artificial Sequence: Synthetic peptide
  XENP020381 vlCDR2
GASSRAT

SEQ ID NO: 2702 - protein, 9 aa, Artificial Sequence
  Description of Artificial Sequence: Synthetic peptide
  XENP020381 vlCDR3
QQYGSSPWT

SEQ ID NO: 2703 - protein, 246 aa, Artificial Sequence
  Description of Artificial Sequence: Synthetic polypeptide
  XENP020382 [CTLA-4]_H3.4_L0.122_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2704 - protein, 118 aa, Artificial Sequence; identical to SEQ ID NO: 2461
  Description of Artificial Sequence: Synthetic polypeptide
  VH of XENP020382

SEQ ID NO: 2705 - protein, 108 aa, Artificial Sequence; identical to SEQ ID NO: 1481
  Description of Artificial Sequence: Synthetic polypeptide
  VL of XENP020382

SEQ ID NO: 2706 - protein, 5 aa, Artificial Sequence
  Description of Artificial Sequence: Synthetic peptide
  XENP020382 vhCDR1
SYTMH

SEQ ID NO: 2707 - protein, 17 aa, Artificial Sequence
  Description of Artificial Sequence: Synthetic peptide
  XENP020382 vhCDR2
FISYDGNHKYYADSVKG

SEQ ID NO: 2708 - protein, 9 aa, Artificial Sequence
  Description of Artificial Sequence: Synthetic peptide
  XENP020382 vhCDR3
TGHLGPFDL

SEQ ID NO: 2709 - protein, 12 aa, Artificial Sequence
  Description of Artificial Sequence: Synthetic peptide
  XENP020382 vlCDR1
RASQSVGSSYLA

SEQ ID NO: 2710 - protein, 7 aa, Artificial Sequence
  Description of Artificial Sequence: Synthetic peptide
  XENP020382 vlCDR2
GAFSRAT

SEQ ID NO: 2711 - protein, 9 aa, Artificial Sequence
  Description of Artificial Sequence: Synthetic peptide
  XENP020382 vlCDR3
QQYGSSPWT

SEQ ID NO: 2712 - protein, 246 aa, Artificial Sequence
  Description of Artificial Sequence: Synthetic polypeptide
  XENP020383 [CTLA-4]_H3.4_L0.123_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 2713 - protein, 118 aa, Artificial Sequence; identical to SEQ ID NO: 2461
  Description of Artificial Sequence: Synthetic polypeptide
  VH of XENP020383

SEQ ID NO: 2714 - protein, 108 aa, Artificial Sequence
  Description of Artificial Sequence: Synthetic polypeptide
  VL of XENP020383
EIVLTQSPATLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 2715 - protein, 5 aa, Artificial Sequence
  Description of Artificial Sequence: Synthetic peptide
  XENP020383 vhCDR1
SYTMH

SEQ ID NO: 2716 - protein, 17 aa, Artificial Sequence
  Description of Artificial Sequence: Synthetic peptide
  XENP020383 vhCDR2
FISYDGNHKYYADSVKG

SEQ ID NO: 2717 - protein, 9 aa, Artificial Sequence
  Description of Artificial Sequence: Synthetic peptide
  XENP020383 vhCDR3
TGHLGPFDL

SEQ ID NO: 2718 - protein, 12 aa, Artificial Sequence
  Description of Artificial Sequence: Synthetic peptide
  XENP020383 vlCDR1
RASQSVSSSYLA

SEQ ID NO: 2719 - protein, 7 aa, Artificial Sequence
  Description of Artificial Sequence: Synthetic peptide
  XENP020383 vlCDR2
GAFSRAT

SEQ ID NO: 2720 - protein, 9 aa, Artificial Sequence
  Description of Artificial Sequence: Synthetic peptide
  XENP020383 vlCDR3
QQYGSSPWT

SEQ ID NO: 2721 - protein, 246 aa, Artificial Sequence
  Description of Artificial Sequence: Synthetic polypeptide
  XENP020384 [CTLA-4]_H3.4_L0.124_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2722 - protein, 118 aa, Artificial Sequence; identical to SEQ ID NO: 2461
  Description of Artificial Sequence: Synthetic polypeptide
  VH of XENP020384

SEQ ID NO: 2723 - protein, 108 aa, Artificial Sequence
  Description of Artificial Sequence: Synthetic polypeptide
  VL of XENP020384
EIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2724 - protein, 5 aa, Artificial Sequence
  Description of Artificial Sequence: Synthetic peptide
  XENP020384 vhCDR1
SYTMH

SEQ ID NO: 2725 - protein, 17 aa, Artificial Sequence
  Description of Artificial Sequence: Synthetic peptide
  XENP020384 vhCDR2
FISYDGNHKYYADSVKG

SEQ ID NO: 2726 - protein, 9 aa, Artificial Sequence
  Description of Artificial Sequence: Synthetic peptide
  XENP020384 vhCDR3
TGHLGPFDL

SEQ ID NO: 2727 - protein, 12 aa, Artificial Sequence
  Description of Artificial Sequence: Synthetic peptide
  XENP020384 vlCDR1
RASQSVGSSYLA

SEQ ID NO: 2728 - protein, 7 aa, Artificial Sequence
  Description of Artificial Sequence: Synthetic peptide
  XENP020384 vlCDR2
GASSRAT

SEQ ID NO: 2729 - protein, 9 aa, Artificial Sequence
  Description of Artificial Sequence: Synthetic peptide
  XENP020384 vlCDR3
QQYGSSPWT

SEQ ID NO: 2730 - protein, 246 aa, Artificial Sequence
  Description of Artificial Sequence: Synthetic polypeptide
  XENP020385 [CTLA-4]_H3.4_L0.125_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 2731 - protein, 118 aa, Artificial Sequence; identical to SEQ ID NO: 2461
  Description of Artificial Sequence: Synthetic polypeptide
  VH of XENP020385

SEQ ID NO: 2732 - protein, 108 aa, Artificial Sequence; identical to SEQ ID NO: 1607
  Description of Artificial Sequence: Synthetic polypeptide
  VL of XENP020385

SEQ ID NO: 2733 - protein, 5 aa, Artificial Sequence
  Description of Artificial Sequence: Synthetic peptide
  XENP020385 vhCDR1
SYTMH

SEQ ID NO: 2734 - protein, 17 aa, Artificial Sequence
  Description of Artificial Sequence: Synthetic peptide
  XENP020385 vhCDR2
FISYDGNHKYYADSVKG

SEQ ID NO: 2735 - protein, 9 aa, Artificial Sequence
  Description of Artificial Sequence: Synthetic peptide
  XENP020385 vhCDR3
TGHLGPFDL

SEQ ID NO: 2736 - protein, 12 aa, Artificial Sequence
  Description of Artificial Sequence: Synthetic peptide
  XENP020385 vlCDR1
RASQSVSSSYLA

SEQ ID NO: 2737 - protein, 7 aa, Artificial Sequence
  Description of Artificial Sequence: Synthetic peptide
  XENP020385 vlCDR2
GAFSRAT

SEQ ID NO: 2738 - protein, 9 aa, Artificial Sequence
  Description of Artificial Sequence: Synthetic peptide
  XENP020385 vlCDR3
QQYGSSPWT

SEQ ID NO: 2739 - protein, 246 aa, Artificial Sequence
  Description of Artificial Sequence: Synthetic polypeptide
  XENP020386 [CTLA-4]_H3.4_L0.126_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2740 - protein, 118 aa, Artificial Sequence; identical to SEQ ID NO: 2461
  Description of Artificial Sequence: Synthetic polypeptide
  VH of XENP020386

SEQ ID NO: 2741 - protein, 108 aa, Artificial Sequence; identical to SEQ ID NO: 2066
  Description of Artificial Sequence: Synthetic polypeptide
  VL of XENP020386

SEQ ID NO: 2742 - protein, 5 aa, Artificial Sequence
  Description of Artificial Sequence: Synthetic peptide
  XENP020386 vhCDR1
SYTMH

SEQ ID NO: 2743 - protein, 17 aa, Artificial Sequence
  Description of Artificial Sequence: Synthetic peptide
  XENP020386 vhCDR2
FISYDGNHKYYADSVKG

SEQ ID NO: 2744 - protein, 9 aa, Artificial Sequence
  Description of Artificial Sequence: Synthetic peptide
  XENP020386 vhCDR3
TGHLGPFDL

SEQ ID NO: 2745 - protein, 12 aa, Artificial Sequence
  Description of Artificial Sequence: Synthetic peptide
  XENP020386 vlCDR1
RASQSVGSSYLA

SEQ ID NO: 2746 - protein, 7 aa, Artificial Sequence
  Description of Artificial Sequence: Synthetic peptide
  XENP020386 vlCDR2
GASSRAT

SEQ ID NO: 2747 - protein, 9 aa, Artificial Sequence
  Description of Artificial Sequence: Synthetic peptide
  XENP020386 vlCDR3
QQYGSSPWT

SEQ ID NO: 2748 - protein, 246 aa, Artificial Sequence
  Description of Artificial Sequence: Synthetic polypeptide
  XENP020387 [CTLA-4]_H3.4_L0.127_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2749 - protein, 118 aa, Artificial Sequence; identical to SEQ ID NO: 2461
  Description of Artificial Sequence: Synthetic polypeptide
  VH of XENP020387

SEQ ID NO: 2750 - protein, 108 aa, Artificial Sequence
  Description of Artificial Sequence: Synthetic polypeptide
  VL of XENP020387
EIVLTQSPGTLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2751 - protein, 5 aa, Artificial Sequence
  Description of Artificial Sequence: Synthetic peptide
  XENP020387 vhCDR1
SYTMH

SEQ ID NO: 2752 - protein, 17 aa, Artificial Sequence
  Description of Artificial Sequence: Synthetic peptide
  XENP020387 vhCDR2
FISYDGNHKYYADSVKG

SEQ ID NO: 2753 - protein, 9 aa, Artificial Sequence
  Description of Artificial Sequence: Synthetic peptide
  XENP020387 vhCDR3
TGHLGPFDL

SEQ ID NO: 2754 - protein, 12 aa, Artificial Sequence
  Description of Artificial Sequence: Synthetic peptide
  XENP020387 vlCDR1
RASQSVSSSYLA

SEQ ID NO: 2755 - protein, 7 aa, Artificial Sequence
  Description of Artificial Sequence: Synthetic peptide
  XENP020387 vlCDR2
GASSRAT

SEQ ID NO: 2756 - protein, 9 aa, Artificial Sequence
  Description of Artificial Sequence: Synthetic peptide
  XENP020387 vlCDR3
QQYGSSPWT

SEQ ID NO: 2757 - protein, 246 aa, Artificial Sequence
  Description of Artificial Sequence: Synthetic polypeptide
  XENP020388 [CTLA-4]_H3.4_L0.128_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 2758 - protein, 118 aa, Artificial Sequence; identical to SEQ ID NO: 2461
  Description of Artificial Sequence: Synthetic polypeptide
  VH of XENP020388

SEQ ID NO: 2759 - protein, 108 aa, Artificial Sequence
  Description of Artificial Sequence: Synthetic polypeptide
  VL of XENP020388
EIVLTQSPATLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 2760 - protein, 5 aa, Artificial Sequence
  Description of Artificial Sequence: Synthetic peptide
  XENP020388 vhCDR1
SYTMH

SEQ ID NO: 2761 - protein, 17 aa, Artificial Sequence
  Description of Artificial Sequence: Synthetic peptide
  XENP020388 vhCDR2
FISYDGNHKYYADSVKG

SEQ ID NO: 2762 - protein, 9 aa, Artificial Sequence
  Description of Artificial Sequence: Synthetic peptide
  XENP020388 vhCDR3
TGHLGPFDL

SEQ ID NO: 2763 - protein, 12 aa, Artificial Sequence
  Description of Artificial Sequence: Synthetic peptide
  XENP020388 vlCDR1
RASQSVSSSYLA

SEQ ID NO: 2764 - protein, 7 aa, Artificial Sequence
  Description of Artificial Sequence: Synthetic peptide
  XENP020388 vlCDR2
GAFSRAT

SEQ ID NO: 2765 - protein, 9 aa, Artificial Sequence
  Description of Artificial Sequence: Synthetic peptide
  XENP020388 vlCDR3
QQYGSSPWT

SEQ ID NO: 2766 - protein, 246 aa, Artificial Sequence
  Description of Artificial Sequence: Synthetic polypeptide
  XENP020389 [CTLA-4]_H3.4_L0.129_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2767 - protein, 118 aa, Artificial Sequence; identical to SEQ ID NO: 2461
  Description of Artificial Sequence: Synthetic polypeptide
  VH of XENP020389

SEQ ID NO: 2768 - protein, 108 aa, Artificial Sequence
  Description of Artificial Sequence: Synthetic polypeptide
  VL of XENP020389
EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2769 - protein, 5 aa, Artificial Sequence
  Description of Artificial Sequence: Synthetic peptide
  XENP020389 vhCDR1
SYTMH

SEQ ID NO: 2770 - protein, 17 aa, Artificial Sequence
  Description of Artificial Sequence: Synthetic peptide
  XENP020389 vhCDR2
FISYDGNHKYYADSVKG

SEQ ID NO: 2771 - protein, 9 aa, Artificial Sequence
  Description of Artificial Sequence: Synthetic peptide
  XENP020389 vhCDR3
TGHLGPFDL

SEQ ID NO: 2772 - protein, 12 aa, Artificial Sequence
  Description of Artificial Sequence: Synthetic peptide
  XENP020389 vlCDR1
RASQSVGSSYLA

SEQ ID NO: 2773 - protein, 7 aa, Artificial Sequence
  Description of Artificial Sequence: Synthetic peptide
  XENP020389 vlCDR2
GASSRAT

SEQ ID NO: 2774 - protein, 9 aa, Artificial Sequence
  Description of Artificial Sequence: Synthetic peptide
  XENP020389 vlCDR3
QQYGSSPWT

SEQ ID NO: 2775 - protein, 246 aa, Artificial Sequence
  Description of Artificial Sequence: Synthetic polypeptide
  XENP020390 [CTLA-4]_H3.4_L0.130_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2776 - protein, 118 aa, Artificial Sequence; identical to SEQ ID NO: 2461
  Description of Artificial Sequence: Synthetic polypeptide
  VH of XENP020390

SEQ ID NO: 2777 - protein, 108 aa, Artificial Sequence
  Description of Artificial Sequence: Synthetic polypeptide
  VL of XENP020390
EIVLTQSPATLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2778 - protein, 5 aa, Artificial Sequence
  Description of Artificial Sequence: Synthetic peptide
  XENP020390 vhCDR1
SYTMH

SEQ ID NO: 2779 - protein, 17 aa, Artificial Sequence
  Description of Artificial Sequence: Synthetic peptide
  XENP020390 vhCDR2
FISYDGNHKYYADSVKG

SEQ ID NO: 2780 - protein, 9 aa, Artificial Sequence
  Description of Artificial Sequence: Synthetic peptide
  XENP020390 vhCDR3
TGHLGPFDL

SEQ ID NO: 2781 - protein, 12 aa, Artificial Sequence
  Description of Artificial Sequence: Synthetic peptide
  XENP020390 vlCDR1
RASQSVSSSYLA

SEQ ID NO: 2782 - protein, 7 aa, Artificial Sequence
  Description of Artificial Sequence: Synthetic peptide
  XENP020390 vlCDR2
GASSRAT

SEQ ID NO: 2783 - protein, 9 aa, Artificial Sequence
  Description of Artificial Sequence: Synthetic peptide
  XENP020390 vlCDR3
QQYGSSPWT

SEQ ID NO: 2784 - protein, 246 aa, Artificial Sequence
  Description of Artificial Sequence: Synthetic polypeptide
  XENP020391 [CTLA-4]_H3.4_L0.131_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2785 - protein, 118 aa, Artificial Sequence; identical to SEQ ID NO: 2461
  Description of Artificial Sequence: Synthetic polypeptide
  VH of XENP020391

SEQ ID NO: 2786 - protein, 108 aa, Artificial Sequence
  Description of Artificial Sequence: Synthetic polypeptide
  VL of XENP020391
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2787 - protein, 5 aa, Artificial Sequence
  Description of Artificial Sequence: Synthetic peptide
  XENP020391 vhCDR1
SYTMH

SEQ ID NO: 2788 - protein, 17 aa, Artificial Sequence
  Description of Artificial Sequence: Synthetic peptide
  XENP020391 vhCDR2
FISYDGNHKYYADSVKG

SEQ ID NO: 2789 - protein, 9 aa, Artificial Sequence
  Description of Artificial Sequence: Synthetic peptide
  XENP020391 vhCDR3
TGHLGPFDL

SEQ ID NO: 2790 - protein, 12 aa, Artificial Sequence
  Description of Artificial Sequence: Synthetic peptide
  XENP020391 vlCDR1
RASQSVSSSYLA

SEQ ID NO: 2791 - protein, 7 aa, Artificial Sequence
  Description of Artificial Sequence: Synthetic peptide
  XENP020391 vlCDR2
GASSRAT

SEQ ID NO: 2792 - protein, 9 aa, Artificial Sequence
  Description of Artificial Sequence: Synthetic peptide
  XENP020391 vlCDR3
QQYGSSPWT

SEQ ID NO: 2793 - protein, 246 aa, Artificial Sequence
  Description of Artificial Sequence: Synthetic polypeptide
  XENP020392 [CTLA-4]_H3.4_L0.132_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2794 - protein, 118 aa, Artificial Sequence; identical to SEQ ID NO: 2461
  Description of Artificial Sequence: Synthetic polypeptide
  VH of XENP020392

SEQ ID NO: 2795 - protein, 108 aa, Artificial Sequence
  Description of Artificial Sequence: Synthetic polypeptide
  VL of XENP020392
EIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2796 - protein, 5 aa, Artificial Sequence
  Description of Artificial Sequence: Synthetic peptide
  XENP020392 vhCDR1
SYTMH

SEQ ID NO: 2797 - protein, 17 aa, Artificial Sequence
  Description of Artificial Sequence: Synthetic peptide
  XENP020392 vhCDR2
FISYDGNHKYYADSVKG

SEQ ID NO: 2798 - protein, 9 aa, Artificial Sequence
  Description of Artificial Sequence: Synthetic peptide
  XENP020392 vhCDR3
TGHLGPFDL

SEQ ID NO: 2799 - protein, 12 aa, Artificial Sequence
  Description of Artificial Sequence: Synthetic peptide
  XENP020392 vlCDR1
RASQSVSSSYLA

SEQ ID NO: 2800 - protein, 7 aa, Artificial Sequence
  Description of Artificial Sequence: Synthetic peptide
  XENP020392 vlCDR2
GASSRAT

SEQ ID NO: 2801 - protein, 9 aa, Artificial Sequence
  Description of Artificial Sequence: Synthetic peptide
  XENP020392 vlCDR3
QQYGSSPWT

SEQ ID NO: 2802 - protein, 246 aa, Artificial Sequence
  Description of Artificial Sequence: Synthetic polypeptide
  XENP020393 [CTLA-4]_H3.5_L2_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSGKPGSGKPGSGKPGSGKPGSEIVMTQSPATLSVSPGERATLSCRASQSVGSSYLAWYQQKPGQAPRLLIYGAFSRATGIPARFSGSGSGTEFTLTISSLQSEDFAVYYCQQYGSSPWTFGQGTKVEIK

SEQ ID NO: 2803 - protein, 118 aa, Artificial Sequence; identical to SEQ ID NO: 2470
  Description of Artificial Sequence: Synthetic polypeptide
  VH of XENP020393

SEQ ID NO: 2804 - protein, 108 aa, Artificial Sequence; identical to SEQ ID NO: 167
  Description of Artificial Sequence: Synthetic polypeptide
  VL of XENP020393

SEQ ID NO: 2805 - protein, 5 aa, Artificial Sequence
  Description of Artificial Sequence: Synthetic peptide
  XENP020393 vhCDR1
SYTMH

SEQ ID NO: 2806 - protein, 17 aa, Artificial Sequence
  Description of Artificial Sequence: Synthetic peptide
  XENP020393 vhCDR2
FISYDGNTKYYADSVKG

SEQ ID NO: 2807 - protein, 9 aa, Artificial Sequence
  Description of Artificial Sequence: Synthetic peptide
  XENP020393 vhCDR3
TGHLGPFDL

SEQ ID NO: 2808 - protein, 12 aa, Artificial Sequence
  Description of Artificial Sequence: Synthetic peptide
  XENP020393 vlCDR1
RASQSVGSSYLA

SEQ ID NO: 2809 - protein, 7 aa, Artificial Sequence
  Description of Artificial Sequence: Synthetic peptide
  XENP020393 vlCDR2
GAFSRAT

SEQ ID NO: 2810 - protein, 9 aa, Artificial Sequence
  Description of Artificial Sequence: Synthetic peptide
  XENP020393 vlCDR3
QQYGSSPWT

SEQ ID NO: 2811 - protein, 246 aa, Artificial Sequence
  Description of Artificial Sequence: Synthetic polypeptide
  XENP020394 [CTLA-4]_H3.5_L2.1_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSGKPGSGKPGSGKPGSGKPGSEIVMTQSPATLSVSPGERATLSCRASQSVSSSYLAWYQQKPGQAPRLLIYGAFSRATGIPARFSGSGSGTEFTLTISSLQSEDFAVYYCQQYGSSPWTFGQGTKVEIK

SEQ ID NO: 2812 - protein, 118 aa, Artificial Sequence; identical to SEQ ID NO: 2470
  Description of Artificial Sequence: Synthetic polypeptide
  VH of XENP020394

SEQ ID NO: 2813 - protein, 108 aa, Artificial Sequence
  Description of Artificial Sequence: Synthetic polypeptide
  VL of XENP020394
EIVMTQSPATLSVSPGERATLSCRASQSVSSSYLAWYQQKPGQAPRLLIYGAFSRATGIPARFSGSGSGTEFTLTISSLQSEDFAVYYCQQYGSSPWTFGQGTKVEIK

SEQ ID NO: 2814 - protein, 5 aa, Artificial Sequence
  Description of Artificial Sequence: Synthetic peptide
  XENP020394 vhCDR1
SYTMH

SEQ ID NO: 2815 - protein, 17 aa, Artificial Sequence
  Description of Artificial Sequence: Synthetic peptide
  XENP020394 vhCDR2
FISYDGNTKYYADSVKG

SEQ ID NO: 2816 - protein, 9 aa, Artificial Sequence
  Description of Artificial Sequence: Synthetic peptide
  XENP020394 vhCDR3
TGHLGPFDL

SEQ ID NO: 2817 - protein, 12 aa, Artificial Sequence
  Description of Artificial Sequence: Synthetic peptide
  XENP020394 vlCDR1
RASQSVSSSYLA

SEQ ID NO: 2818 - protein, 7 aa, Artificial Sequence
  Description of Artificial Sequence: Synthetic peptide
  XENP020394 vlCDR2
GAFSRAT

SEQ ID NO: 2819 - protein, 9 aa, Artificial Sequence
  Description of Artificial Sequence: Synthetic peptide
  XENP020394 vlCDR3
QQYGSSPWT

SEQ ID NO: 2820 - protein, 246 aa, Artificial Sequence
  Description of Artificial Sequence: Synthetic polypeptide
  XENP020395 [CTLA-4]_H3.5_L2.2_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSGKPGSGKPGSGKPGSGKPGSEIVMTQSPATLSVSPGERATLSCRASQSVGSSYLAWYQQKPGQAPRLLIYGASSRATGIPARFSGSGSGTEFTLTISSLQSEDFAVYYCQQYGSSPWTFGQGTKVEIK

SEQ ID NO: 2821 - protein, 118 aa, Artificial Sequence; identical to SEQ ID NO: 2470
  Description of Artificial Sequence: Synthetic polypeptide
  VH of XENP020395

SEQ ID NO: 2822 - protein, 108 aa, Artificial Sequence
  Description of Artificial Sequence: Synthetic polypeptide
  VL of XENP020395
EIVMTQSPATLSVSPGERATLSCRASQSVGSSYLAWYQQKPGQAPRLLIYGASSRATGIPARFSGSGSGTEFTLTISSLQSEDFAVYYCQQYGSSPWTFGQGTKVEIK

SEQ ID NO: 2823 - protein, 5 aa, Artificial Sequence
  Description of Artificial Sequence: Synthetic peptide
  XENP020395 vhCDR1
SYTMH

SEQ ID NO: 2824 - protein, 17 aa, Artificial Sequence
  Description of Artificial Sequence: Synthetic peptide
  XENP020395 vhCDR2
FISYDGNTKYYADSVKG

SEQ ID NO: 2825 - protein, 9 aa, Artificial Sequence
  Description of Artificial Sequence: Synthetic peptide
  XENP020395 vhCDR3
TGHLGPFDL

SEQ ID NO: 2826 - protein, 12 aa, Artificial Sequence
  Description of Artificial Sequence: Synthetic peptide
  XENP020395 vlCDR1
RASQSVGSSYLA

SEQ ID NO: 2827 - protein, 7 aa, Artificial Sequence
  Description of Artificial Sequence: Synthetic peptide
  XENP020395 vlCDR2
GASSRAT

SEQ ID NO: 2828 - protein, 9 aa, Artificial Sequence
  Description of Artificial Sequence: Synthetic peptide
  XENP020395 vlCDR3
QQYGSSPWT

SEQ ID NO: 2829 - protein, 246 aa, Artificial Sequence
  Description of Artificial Sequence: Synthetic polypeptide
  XENP020396 [CTLA-4]_H3.5_L2.3_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSGKPGSGKPGSGKPGSGKPGSEIVMTQSPATLSVSPGERATLSCRASQSVSSSYLAWYQQKPGQAPRLLIYGASSRATGIPARFSGSGSGTEFTLTISSLQSEDFAVYYCQQYGSSPWTFGQGTKVEIK

SEQ ID NO: 2830 - protein, 118 aa, Artificial Sequence; identical to SEQ ID NO: 2470
  Description of Artificial Sequence: Synthetic polypeptide
  VH of XENP020396

SEQ ID NO: 2831 - protein, 108 aa, Artificial Sequence
  Description of Artificial Sequence: Synthetic polypeptide
  VL of XENP020396
EIVMTQSPATLSVSPGERATLSCRASQSVSSSYLAWYQQKPGQAPRLLIYGASSRATGIPARFSGSGSGTEFTLTISSLQSEDFAVYYCQQYGSSPWTFGQGTKVEIK

SEQ ID NO: 2832 - protein, 5 aa, Artificial Sequence
  Description of Artificial Sequence: Synthetic peptide
  XENP020396 vhCDR1
SYTMH

SEQ ID NO: 2833 - protein, 17 aa, Artificial Sequence
  Description of Artificial Sequence: Synthetic peptide
  XENP020396 vhCDR2
FISYDGNTKYYADSVKG

SEQ ID NO: 2834 - protein, 9 aa, Artificial Sequence
  Description of Artificial Sequence: Synthetic peptide
  XENP020396 vhCDR3
TGHLGPFDL

SEQ ID NO: 2835 - protein, 12 aa, Artificial Sequence
  Description of Artificial Sequence: Synthetic peptide
  XENP020396 vlCDR1
RASQSVSSSYLA

SEQ ID NO: 2836 - protein, 7 aa, Artificial Sequence
  Description of Artificial Sequence: Synthetic peptide
  XENP020396 vlCDR2
GASSRAT

SEQ ID NO: 2837 - protein, 9 aa, Artificial Sequence
  Description of Artificial Sequence: Synthetic peptide
  XENP020396 vlCDR3
QQYGSSPWT

SEQ ID NO: 2838 - protein, 246 aa, Artificial Sequence
  Description of Artificial Sequence: Synthetic polypeptide
  XENP020431 [CTLA-4]_H3.21_L0.124_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSGKPGSGKPGSGKPGSGKPGSEIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2839 - protein, 118 aa, Artificial Sequence; identical to SEQ ID NO: 2614
  Description of Artificial Sequence: Synthetic polypeptide
  VH of XENP020431

SEQ ID NO: 2840 - protein, 108 aa, Artificial Sequence; identical to SEQ ID NO: 2723
  Description of Artificial Sequence: Synthetic polypeptide
  VL of XENP020431

SEQ ID NO: 2841 - protein, 5 aa, Artificial Sequence
  Description of Artificial Sequence: Synthetic peptide
  XENP020431 vhCDR1
SYTMH

SEQ ID NO: 2842 - protein, 17 aa, Artificial Sequence
  Description of Artificial Sequence: Synthetic peptide
  XENP020431 vhCDR2
FISYDGNTKYYADSVKG

SEQ ID NO: 2843 - protein, 9 aa, Artificial Sequence
  Description of Artificial Sequence: Synthetic peptide
  XENP020431 vhCDR3
GGLLGPFDL

SEQ ID NO: 2844 - protein, 12 aa, Artificial Sequence
  Description of Artificial Sequence: Synthetic peptide
  XENP020431 vlCDR1
RASQSVGSSYLA

SEQ ID NO: 2845 - protein, 7 aa, Artificial Sequence
  Description of Artificial Sequence: Synthetic peptide
  XENP020431 vlCDR2
GASSRAT

SEQ ID NO: 2846 - protein, 9 aa, Artificial Sequence
  Description of Artificial Sequence: Synthetic peptide
  XENP020431 vlCDR3
QQYGSSPWT

SEQ ID NO: 2847 - protein, 246 aa, Artificial Sequence
  Description of Artificial Sequence: Synthetic polypeptide
  XENP020432 [CTLA-4]_H3.21_L0.129_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2848 - protein, 118 aa, Artificial Sequence; identical to SEQ ID NO: 2614
  Description of Artificial Sequence: Synthetic polypeptide
  VH of XENP020432

SEQ ID NO: 2849 - protein, 108 aa, Artificial Sequence; identical to SEQ ID NO: 2768
  Description of Artificial Sequence: Synthetic polypeptide
  VL of XENP020432

SEQ ID NO: 2850 - protein, 5 aa, Artificial Sequence
  Description of Artificial Sequence: Synthetic peptide
  XENP020432 vhCDR1
SYTMH

SEQ ID NO: 2851 - protein, 17 aa, Artificial Sequence
  Description of Artificial Sequence: Synthetic peptide
  XENP020432 vhCDR2
FISYDGNTKYYADSVKG

SEQ ID NO: 2852 - protein, 9 aa, Artificial Sequence
  Description of Artificial Sequence: Synthetic peptide
  XENP020432 vhCDR3
GGLLGPFDL

SEQ ID NO: 2853 - protein, 12 aa, Artificial Sequence
  Description of Artificial Sequence: Synthetic peptide
  XENP020432 vlCDR1
RASQSVGSSYLA

SEQ ID NO: 2854 - protein, 7 aa, Artificial Sequence
  Description of Artificial Sequence: Synthetic peptide
  XENP020432 vlCDR2
GASSRAT

SEQ ID NO: 2855 - protein, 9 aa, Artificial Sequence
  Description of Artificial Sequence: Synthetic peptide
  XENP020432 vlCDR3
QQYGSSPWT

SEQ ID NO: 2856 - protein, 246 aa, Artificial Sequence
  Description of Artificial Sequence: Synthetic polypeptide
  XENP020433 [CTLA-4]_H3.21_L0.132_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2857 - protein, 118 aa, Artificial Sequence; identical to SEQ ID NO: 2614
  Description of Artificial Sequence: Synthetic polypeptide
  VH of XENP020433

SEQ ID NO: 2858 - protein, 108 aa, Artificial Sequence; identical to SEQ ID NO: 2795
  Description of Artificial Sequence: Synthetic polypeptide
  VL of XENP020433

SEQ ID NO: 2859 - protein, 5 aa, Artificial Sequence
  Description of Artificial Sequence: Synthetic peptide
  XENP020433 vhCDR1
SYTMH

SEQ ID NO: 2860 - protein, 17 aa, Artificial Sequence
  Description of Artificial Sequence: Synthetic peptide
  XENP020433 vhCDR2
FISYDGNTKYYADSVKG

SEQ ID NO: 2861 - protein, 9 aa, Artificial Sequence
  Description of Artificial Sequence: Synthetic peptide
  XENP020433 vhCDR3
GGLLGPFDL

SEQ ID NO: 2862 - protein, 12 aa, Artificial Sequence
  Description of Artificial Sequence: Synthetic peptide
  XENP020433 vlCDR1
RASQSVSSSYLA

SEQ ID NO: 2863 - protein, 7 aa, Artificial Sequence
  Description of Artificial Sequence: Synthetic peptide
  XENP020433 vlCDR2
GASSRAT

SEQ ID NO: 2864 - protein, 9 aa, Artificial Sequence
  Description of Artificial Sequence: Synthetic peptide
  XENP020433 vlCDR3
QQYGSSPWT

SEQ ID NO: 2865 - protein, 246 aa, Artificial Sequence
  Description of Artificial Sequence: Synthetic polypeptide
  XENP020434 [CTLA-4]_H3.23_L0.124_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2866 - protein, 118 aa, Artificial Sequence; identical to SEQ ID NO: 2632
  Description of Artificial Sequence: Synthetic polypeptide
  VH of XENP020434

SEQ ID NO: 2867 - protein, 108 aa, Artificial Sequence; identical to SEQ ID NO: 2723
  Description of Artificial Sequence: Synthetic polypeptide
  VL of XENP020434

SEQ ID NO: 2868 - protein, 5 aa, Artificial Sequence
  Description of Artificial Sequence: Synthetic peptide
  XENP020434 vhCDR1
SYTMH

SEQ ID NO: 2869 - protein, 17 aa, Artificial Sequence
  Description of Artificial Sequence: Synthetic peptide
  XENP020434 vhCDR2
FISYDGNYKYYADSVKG

SEQ ID NO: 2870 - protein, 9 aa, Artificial Sequence
  Description of Artificial Sequence: Synthetic peptide
  XENP020434 vhCDR3
GGHLGPFDL

SEQ ID NO: 2871 - protein, 12 aa, Artificial Sequence
  Description of Artificial Sequence: Synthetic peptide
  XENP020434 vlCDR1
RASQSVGSSYLA

SEQ ID NO: 2872 - protein, 7 aa, Artificial Sequence
  Description of Artificial Sequence: Synthetic peptide
  XENP020434 vlCDR2
GASSRAT

SEQ ID NO: 2873 - protein, 9 aa, Artificial Sequence
  Description of Artificial Sequence: Synthetic peptide
  XENP020434 vlCDR3
QQYGSSPWT

SEQ ID NO: 2874 - protein, 246 aa, Artificial Sequence
  Description of Artificial Sequence: Synthetic polypeptide
  XENP020435 [CTLA-4]_H3.23_L0.129_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2875 - protein, 118 aa, Artificial Sequence; identical to SEQ ID NO: 2632
  Description of Artificial Sequence: Synthetic polypeptide
  VH of XENP020435

SEQ ID NO: 2876 - protein, 108 aa, Artificial Sequence; identical to SEQ ID NO: 2768
  Description of Artificial Sequence: Synthetic polypeptide
  VL of XENP020435

SEQ ID NO: 2877 - protein, 5 aa, Artificial Sequence
  Description of Artificial Sequence: Synthetic peptide
  XENP020435 vhCDR1
SYTMH

SEQ ID NO: 2878 - protein, 17 aa, Artificial Sequence
  Description of Artificial Sequence: Synthetic peptide
  XENP020435 vhCDR2
FISYDGNYKYYADSVKG

SEQ ID NO: 2879 - protein, 9 aa, Artificial Sequence
  Description of Artificial Sequence: Synthetic peptide
  XENP020435 vhCDR3
GGHLGPFDL

SEQ ID NO: 2880 - protein, 12 aa, Artificial Sequence
  Description of Artificial Sequence: Synthetic peptide
  XENP020435 vlCDR1
RASQSVGSSYLA

SEQ ID NO: 2881 - protein, 7 aa, Artificial Sequence
  Description of Artificial Sequence: Synthetic peptide
  XENP020435 vlCDR2
GASSRAT

SEQ ID NO: 2882 - protein, 9 aa, Artificial Sequence
  Description of Artificial Sequence: Synthetic peptide
  XENP020435 vlCDR3
QQYGSSPWT

SEQ ID NO: 2883 - protein, 246 aa, Artificial Sequence
  Description of Artificial Sequence: Synthetic polypeptide
  XENP020436 [CTLA-4]_H3.23_L0.132_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2884 - protein, 118 aa, Artificial Sequence; identical to SEQ ID NO: 2632
  Description of Artificial Sequence: Synthetic polypeptide
  VH of XENP020436

SEQ ID NO: 2885 - protein, 108 aa, Artificial Sequence; identical to SEQ ID NO: 2795
  Description of Artificial Sequence: Synthetic polypeptide
  VL of XENP020436

SEQ ID NO: 2886 - protein, 5 aa, Artificial Sequence
  Description of Artificial Sequence: Synthetic peptide
  XENP020436 vhCDR1
SYTMH

SEQ ID NO: 2887 - protein, 17 aa, Artificial Sequence
  Description of Artificial Sequence: Synthetic peptide
  XENP020436 vhCDR2
FISYDGNYKYYADSVKG

SEQ ID NO: 2888 - protein, 9 aa, Artificial Sequence
  Description of Artificial Sequence: Synthetic peptide
  XENP020436 vhCDR3
GGHLGPFDL

SEQ ID NO: 2889 - protein, 12 aa, Artificial Sequence
  Description of Artificial Sequence: Synthetic peptide
  XENP020436 vlCDR1
RASQSVSSSYLA

SEQ ID NO: 2890 - protein, 7 aa, Artificial Sequence
  Description of Artificial Sequence: Synthetic peptide
  XENP020436 vlCDR2
GASSRAT

SEQ ID NO: 2891 - protein, 9 aa, Artificial Sequence
  Description of Artificial Sequence: Synthetic peptide
  XENP020436 vlCDR3
QQYGSSPWT

SEQ ID NO: 2892 - protein, 246 aa, Artificial Sequence
  Description of Artificial Sequence: Synthetic polypeptide
  XENP020437 [CTLA-4]_H3.25_L0.124_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSGKPGSGKPGSGKPGSGKPGSEIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2893 - protein, 118 aa, Artificial Sequence; identical to SEQ ID NO: 2650
  Description of Artificial Sequence: Synthetic polypeptide
  VH of XENP020437

SEQ ID NO: 2894 - protein, 108 aa, Artificial Sequence; identical to SEQ ID NO: 2723
  Description of Artificial Sequence: Synthetic polypeptide
  VL of XENP020437

SEQ ID NO: 2895 - protein, 5 aa, Artificial Sequence
  Description of Artificial Sequence: Synthetic peptide
  XENP020437 vhCDR1
SYTMH

SEQ ID NO: 2896 - protein, 17 aa, Artificial Sequence
  Description of Artificial Sequence: Synthetic peptide
  XENP020437 vhCDR2
FISYDGNYKYYADSVKG

SEQ ID NO: 2897 - protein, 9 aa, Artificial Sequence
  Description of Artificial Sequence: Synthetic peptide
  XENP020437 vhCDR3
GGLLGPFDL

SEQ ID NO: 2898 - protein, 12 aa, Artificial Sequence
  Description of Artificial Sequence: Synthetic peptide
  XENP020437 vlCDR1
RASQSVGSSYLA

SEQ ID NO: 2899 - protein, 7 aa, Artificial Sequence
  Description of Artificial Sequence: Synthetic peptide
  XENP020437 vlCDR2
GASSRAT

SEQ ID NO: 2900 - protein, 9 aa, Artificial Sequence
  Description of Artificial Sequence: Synthetic peptide
  XENP020437 vlCDR3
QQYGSSPWT

SEQ ID NO: 2901 - protein, 246 aa, Artificial Sequence
  Description of Artificial Sequence: Synthetic polypeptide
  XENP020438 [CTLA-4]_H3.25_L0.129_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2902 - protein, 118 aa, Artificial Sequence; identical to SEQ ID NO: 2650
  Description of Artificial Sequence: Synthetic polypeptide
  VH of XENP020438

SEQ ID NO: 2903 - protein, 108 aa, Artificial Sequence; identical to SEQ ID NO: 2768
  Description of Artificial Sequence: Synthetic polypeptide
  VL of XENP020438

SEQ ID NO: 2904 - protein, 5 aa, Artificial Sequence
  Description of Artificial Sequence: Synthetic peptide
  XENP020438 vhCDR1
SYTMH

SEQ ID NO: 2905 - protein, 17 aa, Artificial Sequence
  Description of Artificial Sequence: Synthetic peptide
  XENP020438 vhCDR2
FISYDGNYKYYADSVKG

SEQ ID NO: 2906 - protein, 9 aa, Artificial Sequence
  Description of Artificial Sequence: Synthetic peptide
  XENP020438 vhCDR3
GGLLGPFDL

SEQ ID NO: 2907 - protein, 12 aa, Artificial Sequence
  Description of Artificial Sequence: Synthetic peptide
  XENP020438 vlCDR1
RASQSVGSSYLA

SEQ ID NO: 2908 - protein, 7 aa, Artificial Sequence
  Description of Artificial Sequence: Synthetic peptide
  XENP020438 vlCDR2
GASSRAT

SEQ ID NO: 2909 - protein, 9 aa, Artificial Sequence
  Description of Artificial Sequence: Synthetic peptide
  XENP020438 vlCDR3
QQYGSSPWT

SEQ ID NO: 2910 - protein, 246 aa, Artificial Sequence
  Description of Artificial Sequence: Synthetic polypeptide
  XENP020439 [CTLA-4]_H3.25_L0.132_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2911 - protein, 118 aa, Artificial Sequence; identical to SEQ ID NO: 2650
  Description of Artificial Sequence: Synthetic polypeptide
  VH of XENP020439

SEQ ID NO: 2912 - protein, 108 aa, Artificial Sequence; identical to SEQ ID NO: 2795
  Description of Artificial Sequence: Synthetic polypeptide
  VL of XENP020439

SEQ ID NO: 2913 - protein, 5 aa, Artificial Sequence
  Description of Artificial Sequence: Synthetic peptide
  XENP020439 vhCDR1
SYTMH

SEQ ID NO: 2914 - protein, 17 aa, Artificial Sequence
  Description of Artificial Sequence: Synthetic peptide
  XENP020439 vhCDR2
FISYDGNYKYYADSVKG

SEQ ID NO: 2915 - protein, 9 aa, Artificial Sequence
  Description of Artificial Sequence: Synthetic peptide
  XENP020439 vhCDR3
GGLLGPFDL

SEQ ID NO: 2916 - protein, 12 aa, Artificial Sequence
  Description of Artificial Sequence: Synthetic peptide
  XENP020439 vlCDR1
RASQSVSSSYLA

SEQ ID NO: 2917 - protein, 7 aa, Artificial Sequence
  Description of Artificial Sequence: Synthetic peptide
  XENP020439 vlCDR2
GASSRAT

SEQ ID NO: 2918 - protein, 9 aa, Artificial Sequence
  Description of Artificial Sequence: Synthetic peptide
  XENP020439 vlCDR3
QQYGSSPWT

SEQ ID NO: 2919 - protein, 221 aa, Artificial Sequence
  Description of Artificial Sequence: Synthetic polypeptide
  XENP009950 [CTLA-4]_H0_L0_Fab_Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2920 - protein, 118 aa, Artificial Sequence; identical to SEQ ID NO: 22
  Description of Artificial Sequence: Synthetic polypeptide
  VH of XENP009950

SEQ ID NO: 2921 - protein, 5 aa, Artificial Sequence
  Description of Artificial Sequence: Synthetic peptide
  XENP009950 vhCDR1
SYTMH

SEQ ID NO: 2922 - protein, 17 aa, Artificial Sequence
  Description of Artificial Sequence: Synthetic peptide
  XENP009950 vhCDR2
FISYDGNNKYYADSVKG

SEQ ID NO: 2923 - protein, 9 aa, Artificial Sequence
  Description of Artificial Sequence: Synthetic peptide
  XENP009950 vhCDR3
TGWLGPFDY

SEQ ID NO: 2924 - protein, 215 aa, Artificial Sequence
  Description of Artificial Sequence: Synthetic polypeptide
  XENP009950 [CTLA-4]_H0_L0_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2925 - protein, 108 aa, Artificial Sequence; identical to SEQ ID NO: 23
  Description of Artificial Sequence: Synthetic polypeptide
  VL of XENP009950

SEQ ID NO: 2926 - protein, 12 aa, Artificial Sequence
  Description of Artificial Sequence: Synthetic peptide
  XENP009950 vlCDR1
RASQSVGSSYLA

SEQ ID NO: 2927 - protein, 7 aa, Artificial Sequence
  Description of Artificial Sequence: Synthetic peptide
  XENP009950 vlCDR2
GAFSRAT

SEQ ID NO: 2928 - protein, 9 aa, Artificial Sequence
  Description of Artificial Sequence: Synthetic peptide
  XENP009950 vlCDR3
QQYGSSPWT

SEQ ID NO: 2929 - protein, 221 aa, Artificial Sequence
  Description of Artificial Sequence: Synthetic polypeptide
  XENP019211 [CTLA-4]_H0.1_L0_Fab Heavy Chain
EVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2930 - protein, 118 aa, Artificial Sequence; identical to SEQ ID NO: 193
  Description of Artificial Sequence: Synthetic polypeptide
  VH of XENP019211

SEQ ID NO: 2931 - protein, 5 aa, Artificial Sequence
  Description of Artificial Sequence: Synthetic peptide
  XENP019211 vhCDR1
SYTMH

SEQ ID NO: 2932 - protein, 17 aa, Artificial Sequence
  Description of Artificial Sequence: Synthetic peptide
  XENP019211 vhCDR2
FISYDGNNKYYADSVKG

SEQ ID NO: 2933 - protein, 9 aa, Artificial Sequence
  Description of Artificial Sequence: Synthetic peptide
  XENP019211 vhCDR3
TGWLGPFDY

SEQ ID NO: 2934 - protein, 215 aa, Artificial Sequence; identical to SEQ ID NO: 2924
  Description of Artificial Sequence: Synthetic polypeptide
  XENP019211 [CTLA-4]_H0.1_L0_Fab Light Chain

SEQ ID NO: 2935 - protein, 108 aa, Artificial Sequence; identical to SEQ ID NO: 23
  Description of Artificial Sequence: Synthetic polypeptide
  VL of XENP019211

SEQ ID NO: 2936 - protein, 12 aa, Artificial Sequence
  Description of Artificial Sequence: Synthetic peptide
  XENP019211 vlCDR1
RASQSVGSSYLA

SEQ ID NO: 2937 - protein, 7 aa, Artificial Sequence
  Description of Artificial Sequence: Synthetic peptide
  XENP019211 vlCDR2
GAFSRAT

SEQ ID NO: 2938 - protein, 9 aa, Artificial Sequence
  Description of Artificial Sequence: Synthetic peptide
  XENP019211 vlCDR3
QQYGSSPWT

SEQ ID NO: 2939 - protein, 221 aa, Artificial Sequence
  Description of Artificial Sequence: Synthetic polypeptide
  XENP019212 [CTLA-4]_H0.2_L0_Fab Heavy Chain
QVQLLESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2940 - protein, 118 aa, Artificial Sequence; identical to SEQ ID NO: 202
  Description of Artificial Sequence: Synthetic polypeptide
  VH of XENP019212

SEQ ID NO: 2941 - protein, 5 aa, Artificial Sequence
  Description of Artificial Sequence: Synthetic peptide
  XENP019212 vhCDR1
SYTMH

SEQ ID NO: 2942 - protein, 17 aa, Artificial Sequence
  Description of Artificial Sequence: Synthetic peptide
  XENP019212 vhCDR2
FISYDGNNKYYADSVKG

SEQ ID NO: 2943 - protein, 9 aa, Artificial Sequence
  Description of Artificial Sequence: Synthetic peptide
  XENP019212 vhCDR3
TGWLGPFDY

SEQ ID NO: 2944 - protein, 215 aa, Artificial Sequence; identical to SEQ ID NO: 2924
  Description of Artificial Sequence: Synthetic polypeptide
  XENP019212 [CTLA-4]_H0.2_L0_Fab Light Chain

SEQ ID NO: 2945 - protein, 108 aa, Artificial Sequence; identical to SEQ ID NO: 23
  Description of Artificial Sequence: Synthetic polypeptide
  VL of XENP019212

SEQ ID NO: 2946 - protein, 12 aa, Artificial Sequence
  Description of Artificial Sequence: Synthetic peptide
  XENP019212 vlCDR1
RASQSVGSSYLA

SEQ ID NO: 2947 - protein, 7 aa, Artificial Sequence
  Description of Artificial Sequence: Synthetic peptide
  XENP019212 vlCDR2
GAFSRAT

SEQ ID NO: 2948 - protein, 9 aa, Artificial Sequence
  Description of Artificial Sequence: Synthetic peptide
  XENP019212 vlCDR3
QQYGSSPWT

SEQ ID NO: 2949 - protein, 221 aa, Artificial Sequence
  Description of Artificial Sequence: Synthetic polypeptide
  XENP019213 [CTLA-4]_H0.3_L0_Fab Heavy Chain
QVQLVESGGGLVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2950 - protein, 118 aa, Artificial Sequence; identical to SEQ ID NO: 211
  Description of Artificial Sequence: Synthetic polypeptide
  VH of XENP019213

SEQ ID NO: 2951 - protein, 5 aa, Artificial Sequence
  Description of Artificial Sequence: Synthetic peptide
  XENP019213 vhCDR1
SYTMH

SEQ ID NO: 2952 - protein, 17 aa, Artificial Sequence
  Description of Artificial Sequence: Synthetic peptide
  XENP019213 vhCDR2
FISYDGNNKYYADSVKG

SEQ ID NO: 2953 - protein, 9 aa, Artificial Sequence
  Description of Artificial Sequence: Synthetic peptide
  XENP019213 vhCDR3
TGWLGPFDY

SEQ ID NO: 2954 - protein, 215 aa, Artificial Sequence; identical to SEQ ID NO: 2924
  Description of Artificial Sequence: Synthetic polypeptide
  XENP019213 [CTLA-4]_H0.3_L0_Fab Light Chain

SEQ ID NO: 2955 - protein, 108 aa, Artificial Sequence; identical to SEQ ID NO: 23
  Description of Artificial Sequence: Synthetic polypeptide
  VL of XENP019213

SEQ ID NO: 2956 - protein, 12 aa, Artificial Sequence
  Description of Artificial Sequence: Synthetic peptide
  XENP019213 vlCDR1
RASQSVGSSYLA

SEQ ID NO: 2957 - protein, 7 aa, Artificial Sequence
  Description of Artificial Sequence: Synthetic peptide
  XENP019213 vlCDR2
GAFSRAT

SEQ ID NO: 2958 - protein, 9 aa, Artificial Sequence
  Description of Artificial Sequence: Synthetic peptide
  XENP019213 vlCDR3
QQYGSSPWT

SEQ ID NO: 2959 - protein, 221 aa, Artificial Sequence
  Description of Artificial Sequence: Synthetic polypeptide
  XENP019214 [CTLA-4]_H0.4_L0_Fab Heavy Chain
QVQLVESGGGVKQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2960 - protein, 118 aa, Artificial Sequence; identical to SEQ ID NO: 220
  Description of Artificial Sequence: Synthetic polypeptide
  VH of XENP019214

SEQ ID NO: 2961 - protein, 5 aa, Artificial Sequence
  Description of Artificial Sequence: Synthetic peptide
  XENP019214 vhCDR1
SYTMH

SEQ ID NO: 2962 - protein, 17 aa, Artificial Sequence
  Description of Artificial Sequence: Synthetic peptide
  XENP019214 vhCDR2
FISYDGNNKYYADSVKG

SEQ ID NO: 2963 - protein, 9 aa, Artificial Sequence
  Description of Artificial Sequence: Synthetic peptide
  XENP019214 vhCDR3
TGWLGPFDY

SEQ ID NO: 2964 - protein, 215 aa, Artificial Sequence; identical to SEQ ID NO: 2924
  Description of Artificial Sequence: Synthetic polypeptide
  XENP019214 [CTLA-4]_H0.4_L0_Fab Light Chain

SEQ ID NO: 2965 - protein, 108 aa, Artificial Sequence; identical to SEQ ID NO: 23
  Description of Artificial Sequence: Synthetic polypeptide
  VL of XENP019214

SEQ ID NO: 2966 - protein, 12 aa, Artificial Sequence
  Description of Artificial Sequence: Synthetic peptide
  XENP019214 vlCDR1
RASQSVGSSYLA

SEQ ID NO: 2967 - protein, 7 aa, Artificial Sequence
  Description of Artificial Sequence: Synthetic peptide
  XENP019214 vlCDR2
GAFSRAT

SEQ ID NO: 2968 - protein, 9 aa, Artificial Sequence
  Description of Artificial Sequence: Synthetic peptide
  XENP019214 vlCDR3
QQYGSSPWT

SEQ ID NO: 2969 - protein, 221 aa, Artificial Sequence
  Description of Artificial Sequence: Synthetic polypeptide
  XENP019215 [CTLA-4]_H0.5_L0_Fab Heavy Chain
QVQLVESGGGVKQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2970 - protein, 118 aa, Artificial Sequence; identical to SEQ ID NO: 229
  Description of Artificial Sequence: Synthetic polypeptide
  VH of XENP019215

SEQ ID NO: 2971 - protein, 5 aa, Artificial Sequence
  Description of Artificial Sequence: Synthetic peptide
  XENP019215 vhCDR1
SYTMH

SEQ ID NO: 2972 - protein, 17 aa, Artificial Sequence
  Description of Artificial Sequence: Synthetic peptide
  XENP019215 vhCDR2
FISYDGNNKYYADSVKG

SEQ ID NO: 2973 - protein, 9 aa, Artificial Sequence
  Description of Artificial Sequence: Synthetic peptide
  XENP019215 vhCDR3
TGWLGPFDY

SEQ ID NO: 2974 - protein, 215 aa, Artificial Sequence; identical to SEQ ID NO: 2924
  Description of Artificial Sequence: Synthetic polypeptide
  XENP019215 [CTLA-4]_H0.5_L0_Fab Light Chain

SEQ ID NO: 2975 - protein, 108 aa, Artificial Sequence; identical to SEQ ID NO: 23
  Description of Artificial Sequence: Synthetic polypeptide
  VL of XENP019215

SEQ ID NO: 2976 - protein, 12 aa, Artificial Sequence
  Description of Artificial Sequence: Synthetic peptide
  XENP019215 vlCDR1
RASQSVGSSYLA

SEQ ID NO: 2977 - protein, 7 aa, Artificial Sequence
  Description of Artificial Sequence: Synthetic peptide
  XENP019215 vlCDR2
GAFSRAT

SEQ ID NO: 2978 - protein, 9 aa, Artificial Sequence
  Description of Artificial Sequence: Synthetic peptide
  XENP019215 vlCDR3
QQYGSSPWT

SEQ ID NO: 2979 - protein, 221 aa, Artificial Sequence
  Description of Artificial Sequence: Synthetic polypeptide
  XENP019216 [CTLA-4]_H0.6_L0_Fab Heavy Chain
QVQLVESGGGVVKPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2980 - protein, 118 aa, Artificial Sequence; identical to SEQ ID NO: 238
  Description of Artificial Sequence: Synthetic polypeptide
  VH of XENP019216

SEQ ID NO: 2981 - protein, 5 aa, Artificial Sequence
  Description of Artificial Sequence: Synthetic peptide
  XENP019216 vhCDR1
SYTMH

SEQ ID NO: 2982 - protein, 17 aa, Artificial Sequence
  Description of Artificial Sequence: Synthetic peptide
  XENP019216 vhCDR2
FISYDGNNKYYADSVKG

SEQ ID NO: 2983 - protein, 9 aa, Artificial Sequence
  Description of Artificial Sequence: Synthetic peptide
  XENP019216 vhCDR3
TGWLGPFDY

SEQ ID NO: 2984 - protein, 215 aa, Artificial Sequence; identical to SEQ ID NO: 2924
  Description of Artificial Sequence: Synthetic polypeptide
  XENP019216 [CTLA-4]_H0.6_L0_Fab Light Chain

SEQ ID NO: 2985 - protein, 108 aa, Artificial Sequence; identical to SEQ ID NO: 23
  Description of Artificial Sequence: Synthetic polypeptide
  VL of XENP019216

SEQ ID NO: 2986 - protein, 12 aa, Artificial Sequence
  Description of Artificial Sequence: Synthetic peptide
  XENP019216 vlCDR1
RASQSVGSSYLA

SEQ ID NO: 2987 - protein, 7 aa, Artificial Sequence
  Description of Artificial Sequence: Synthetic peptide
  XENP019216 vlCDR2
GAFSRAT

SEQ ID NO: 2988 - protein, 9 aa, Artificial Sequence
  Description of Artificial Sequence: Synthetic peptide
  XENP019216 vlCDR3
QQYGSSPWT

SEQ ID NO: 2989 - protein, 221 aa, Artificial Sequence
  Description of Artificial Sequence: Synthetic polypeptide
  XENP019217 [CTLA-4]_H0.7_L0_Fab Heavy Chain
QVQLVESGGGVVEPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2990 - protein, 118 aa, Artificial Sequence; identical to SEQ ID NO: 247
  Description of Artificial Sequence: Synthetic polypeptide
  VH of XENP019217

SEQ ID NO: 2991 - protein, 5 aa, Artificial Sequence
  Description of Artificial Sequence: Synthetic peptide
  XENP019217 vhCDR1
SYTMH

SEQ ID NO: 2992 - protein, 17 aa, Artificial Sequence
  Description of Artificial Sequence: Synthetic peptide
  XENP019217 vhCDR2
FISYDGNNKYYADSVKG

SEQ ID NO: 2993 - protein, 9 aa, Artificial Sequence
  Description of Artificial Sequence: Synthetic peptide
  XENP019217 vhCDR3
TGWLGPFDY

SEQ ID NO: 2994 - protein, 215 aa, Artificial Sequence; identical to SEQ ID NO: 2924
  Description of Artificial Sequence: Synthetic polypeptide
  XENP019217 [CTLA-4]_H0.7_L0_Fab Light Chain

SEQ ID NO: 2995 - protein, 108 aa, Artificial Sequence; identical to SEQ ID NO: 23
  Description of Artificial Sequence: Synthetic polypeptide
  VL of XENP019217

SEQ ID NO: 2996 - protein, 12 aa, Artificial Sequence
  Description of Artificial Sequence: Synthetic peptide
  XENP019217 vlCDR1
RASQSVGSSYLA

SEQ ID NO: 2997 - protein, 7 aa, Artificial Sequence
  Description of Artificial Sequence: Synthetic peptide
  XENP019217 vlCDR2
GAFSRAT

SEQ ID NO: 2998 - protein, 9 aa, Artificial Sequence
  Description of Artificial Sequence: Synthetic peptide
  XENP019217 vlCDR3
QQYGSSPWT

SEQ ID NO: 2999 - protein, 221 aa, Artificial Sequence
  Description of Artificial Sequence: Synthetic polypeptide
  XENP019218 [CTLA-4]_H0.8_L0_Fab Heavy Chain
QVQLVESGGGVVQPGGSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3000 - protein, 118 aa, Artificial Sequence; identical to SEQ ID NO: 256
  Description of Artificial Sequence: Synthetic polypeptide
  VH of XENP019218

SEQ ID NO: 3001 - protein, 5 aa, Artificial Sequence
  Description of Artificial Sequence: Synthetic peptide
  XENP019218 vhCDR1
SYTMH

SEQ ID NO: 3002 - protein, 17 aa, Artificial Sequence
  Description of Artificial Sequence: Synthetic peptide
  XENP019218 vhCDR2
FISYDGNNKYYADSVKG

SEQ ID NO: 3003 - protein, 9 aa, Artificial Sequence
  Description of Artificial Sequence: Synthetic peptide
  XENP019218 vhCDR3
TGWLGPFDY

SEQ ID NO: 3004 - protein, 215 aa, Artificial Sequence; identical to SEQ ID NO: 2924
  Description of Artificial Sequence: Synthetic polypeptide
  XENP019218 [CTLA-4]_H0.8_L0_Fab Light Chain

SEQ ID NO: 3005 - protein, 108 aa, Artificial Sequence; identical to SEQ ID NO: 23
  Description of Artificial Sequence: Synthetic polypeptide
  VL of XENP019218

SEQ ID NO: 3006 - protein, 12 aa, Artificial Sequence
  Description of Artificial Sequence: Synthetic peptide
  XENP019218 vlCDR1
RASQSVGSSYLA

SEQ ID NO: 3007 - protein, 7 aa, Artificial Sequence
  Description of Artificial Sequence: Synthetic peptide
  XENP019218 vlCDR2
GAFSRAT

SEQ ID NO: 3008 - protein, 9 aa, Artificial Sequence
  Description of Artificial Sequence: Synthetic peptide
  XENP019218 vlCDR3
QQYGSSPWT

SEQ ID NO: 3009 - protein, 221 aa, Artificial Sequence
  Description of Artificial Sequence: Synthetic polypeptide
  XENP019219 [CTLA-4]_H0.9_L0_Fab Heavy Chain
QVQLVESGGGVVQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3010 - protein, 118 aa, Artificial Sequence; identical to SEQ ID NO: 265
  Description of Artificial Sequence: Synthetic polypeptide
  VH of XENP019219

SEQ ID NO: 3011 - protein, 5 aa, Artificial Sequence
  Description of Artificial Sequence: Synthetic peptide
  XENP019219 vhCDR1
SYTMH

SEQ ID NO: 3012 - protein, 17 aa, Artificial Sequence
  Description of Artificial Sequence: Synthetic peptide
  XENP019219 vhCDR2
FISYDGNNKYYADSVKG

SEQ ID NO: 3013 - protein, 9 aa, Artificial Sequence
  Description of Artificial Sequence: Synthetic peptide
  XENP019219 vhCDR3
TGWLGPFDY

SEQ ID NO: 3014 - protein, 215 aa, Artificial Sequence; identical to SEQ ID NO: 2924
  Description of Artificial Sequence: Synthetic polypeptide
  XENP019219 [CTLA-4]_H0.9_L0_Fab Light Chain

SEQ ID NO: 3015 - protein, 108 aa, Artificial Sequence; identical to SEQ ID NO: 23
  Description of Artificial Sequence: Synthetic polypeptide
  VL of XENP019219

SEQ ID NO: 3016 - protein, 12 aa, Artificial Sequence
  Description of Artificial Sequence: Synthetic peptide
  XENP019219 vlCDR1
RASQSVGSSYLA

SEQ ID NO: 3017 - protein, 7 aa, Artificial Sequence
  Description of Artificial Sequence: Synthetic peptide
  XENP019219 vlCDR2
GAFSRAT

SEQ ID NO: 3018 - protein, 9 aa, Artificial Sequence
  Description of Artificial Sequence: Synthetic peptide
  XENP019219 vlCDR3
QQYGSSPWT

SEQ ID NO: 3019 - protein, 221 aa, Artificial Sequence
  Description of Artificial Sequence: Synthetic polypeptide
  XENP019220 [CTLA-4]_H0.10_L0_Fab Heavy Chain
QVQLVESGGGVVQPGRSLKLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3020 - protein, 118 aa, Artificial Sequence; identical to SEQ ID NO: 274
  Description of Artificial Sequence: Synthetic polypeptide
  VH of XENP019220

SEQ ID NO: 3021 - protein, 5 aa, Artificial Sequence
  Description of Artificial Sequence: Synthetic peptide
  XENP019220 vhCDR1
SYTMH

SEQ ID NO: 3022 - protein, 17 aa, Artificial Sequence
  Description of Artificial Sequence: Synthetic peptide
  XENP019220 vhCDR2
FISYDGNNKYYADSVKG

SEQ ID NO: 3023 - protein, 9 aa, Artificial Sequence
  Description of Artificial Sequence: Synthetic peptide
  XENP019220 vhCDR3
TGWLGPFDY

SEQ ID NO: 3024 - protein, 215 aa, Artificial Sequence; identical to SEQ ID NO: 2924
  Description of Artificial Sequence: Synthetic polypeptide
  XENP019220 [CTLA-4]_H0.10_L0_Fab Light Chain

SEQ ID NO: 3025 - protein, 108 aa, Artificial Sequence; identical to SEQ ID NO: 23
  Description of Artificial Sequence: Synthetic polypeptide
  VL of XENP019220

SEQ ID NO: 3026 - protein, 12 aa, Artificial Sequence
  Description of Artificial Sequence: Synthetic peptide
  XENP019220 vlCDR1
RASQSVGSSYLA

SEQ ID NO: 3027 - protein, 7 aa, Artificial Sequence
  Description of Artificial Sequence: Synthetic peptide
  XENP019220 vlCDR2
GAFSRAT

SEQ ID NO: 3028 - protein, 9 aa, Artificial Sequence
  Description of Artificial Sequence: Synthetic peptide
  XENP019220 vlCDR3
QQYGSSPWT

SEQ ID NO: 3029 - protein, 221 aa, Artificial Sequence
  Description of Artificial Sequence: Synthetic polypeptide
  XENP019221 [CTLA-4]_H0.11_L0_Fab Heavy Chain
QVQLVESGGGVVQPGRSLRLSCAASGFTVSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3030 - protein, 118 aa, Artificial Sequence; identical to SEQ ID NO: 283
  Description of Artificial Sequence: Synthetic polypeptide
  VH of XENP019221

SEQ ID NO: 3031 - protein, 5 aa, Artificial Sequence
  Description of Artificial Sequence: Synthetic peptide
  XENP019221 vhCDR1
SYTMH

SEQ ID NO: 3032 - protein, 17 aa, Artificial Sequence
  Description of Artificial Sequence: Synthetic peptide
  XENP019221 vhCDR2
FISYDGNNKYYADSVKG

SEQ ID NO: 3033 - protein, 9 aa, Artificial Sequence
  Description of Artificial Sequence: Synthetic peptide
  XENP019221 vhCDR3
TGWLGPFDY

SEQ ID NO: 3034 - protein, 215 aa, Artificial Sequence; identical to SEQ ID NO: 2924
  Description of Artificial Sequence: Synthetic polypeptide
  XENP019221 [CTLA-4]_H0.11_L0_Fab Light Chain

SEQ ID NO: 3035 - protein, 108 aa, Artificial Sequence; identical to SEQ ID NO: 23
  Description of Artificial Sequence: Synthetic polypeptide
  VL of XENP019221

SEQ ID NO: 3036 - protein, 12 aa, Artificial Sequence
  Description of Artificial Sequence: Synthetic peptide
  XENP019221 vlCDR1
RASQSVGSSYLA

SEQ ID NO: 3037 - protein, 7 aa, Artificial Sequence
  Description of Artificial Sequence: Synthetic peptide
  XENP019221 vlCDR2
GAFSRAT

SEQ ID NO: 3038 - protein, 9 aa, Artificial Sequence
  Description of Artificial Sequence: Synthetic peptide
  XENP019221 vlCDR3
QQYGSSPWT

SEQ ID NO: 3039 - protein, 221 aa, Artificial Sequence
  Description of Artificial Sequence: Synthetic polypeptide
  XENP019222 [CTLA-4]_H0.12_L0_Fab Heavy Chain
QVQLVESGGGVVQPGRSLRLSCAASGFTFSAYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3040 - protein, 118 aa, Artificial Sequence; identical to SEQ ID NO: 292
  Description of Artificial Sequence: Synthetic polypeptide
  VH of XENP019222

SEQ ID NO: 3041 - protein, 5 aa, Artificial Sequence
  Description of Artificial Sequence: Synthetic peptide
  XENP019222 vhCDR1
AYTMH

SEQ ID NO: 3042 - protein, 17 aa, Artificial Sequence
  Description of Artificial Sequence: Synthetic peptide
  XENP019222 vhCDR2
FISYDGNNKYYADSVKG

SEQ ID NO: 3043 - protein, 9 aa, Artificial Sequence
  Description of Artificial Sequence: Synthetic peptide
  XENP019222 vhCDR3
TGWLGPFDY

SEQ ID NO: 3044 - protein, 215 aa, Artificial Sequence; identical to SEQ ID NO: 2924
  Description of Artificial Sequence: Synthetic polypeptide
  XENP019222 [CTLA-4]_H0.12_L0_Fab Light Chain

SEQ ID NO: 3045 - protein, 108 aa, Artificial Sequence; identical to SEQ ID NO: 23
  Description of Artificial Sequence: Synthetic polypeptide
  VL of XENP019222

SEQ ID NO: 3046 - protein, 12 aa, Artificial Sequence
  Description of Artificial Sequence: Synthetic peptide
  XENP019222 vlCDR1
RASQSVGSSYLA

SEQ ID NO: 3047 - protein, 7 aa, Artificial Sequence
  Description of Artificial Sequence: Synthetic peptide
  XENP019222 vlCDR2
GAFSRAT

SEQ ID NO: 3048 - protein, 9 aa, Artificial Sequence
  Description of Artificial Sequence: Synthetic peptide
  XENP019222 vlCDR3
QQYGSSPWT

SEQ ID NO: 3049 - protein, 221 aa, Artificial Sequence
  Description of Artificial Sequence: Synthetic polypeptide
  XENP019223 [CTLA-4]_H0.13_L0_Fab Heavy Chain
QVQLVESGGGVVQPGRSLRLSCAASGFTFSDYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3050 - protein, 118 aa, Artificial Sequence; identical to SEQ ID NO: 301
  Description of Artificial Sequence: Synthetic polypeptide
  VH of XENP019223

SEQ ID NO: 3051 - protein, 5 aa, Artificial Sequence
  Description of Artificial Sequence: Synthetic peptide
  XENP019223 vhCDR1
DYTMH

SEQ ID NO: 3052 - protein, 17 aa, Artificial Sequence
  Description of Artificial Sequence: Synthetic peptide
  XENP019223 vhCDR2
FISYDGNNKYYADSVKG

SEQ ID NO: 3053 - protein, 9 aa, Artificial Sequence
  Description of Artificial Sequence: Synthetic peptide
  XENP019223 vhCDR3
TGWLGPFDY

SEQ ID NO: 3054 - protein, 215 aa, Artificial Sequence; identical to SEQ ID NO: 2924
  Description of Artificial Sequence: Synthetic polypeptide
  XENP019223 [CTLA-4]_H0.13_L0_Fab Light Chain

SEQ ID NO: 3055 - protein, 108 aa, Artificial Sequence; identical to SEQ ID NO: 23
  Description of Artificial Sequence: Synthetic polypeptide
  VL of XENP019223

SEQ ID NO: 3056 - protein, 12 aa, Artificial Sequence
  Description of Artificial Sequence: Synthetic peptide
  XENP019223 vlCDR1
RASQSVGSSYLA

SEQ ID NO: 3057 - protein, 7 aa, Artificial Sequence
  Description of Artificial Sequence: Synthetic peptide
  XENP019223 vlCDR2
GAFSRAT

SEQ ID NO: 3058 - protein, 9 aa, Artificial Sequence
  Description of Artificial Sequence: Synthetic peptide
  XENP019223 vlCDR3
QQYGSSPWT

SEQ ID NO: 3059 - protein, 221 aa, Artificial Sequence
  Description of Artificial Sequence: Synthetic polypeptide
  XENP019224 [CTLA-4]_H0.14_L0_Fab Heavy Chain
QVQLVESGGGVVQPGRSLRLSCAASGFTFSGYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3060 - protein, 118 aa, Artificial Sequence; identical to SEQ ID NO: 310
  Description of Artificial Sequence: Synthetic polypeptide
  VH of XENP019224

SEQ ID NO: 3061 - protein, 5 aa, Artificial Sequence
  Description of Artificial Sequence: Synthetic peptide
  XENP019224 vhCDR1
GYTMH

SEQ ID NO: 3062 - protein, 17 aa, Artificial Sequence
  Description of Artificial Sequence: Synthetic peptide
  XENP019224 vhCDR2
FISYDGNNKYYADSVKG

SEQ ID NO: 3063 - protein, 9 aa, Artificial Sequence
  Description of Artificial Sequence: Synthetic peptide
  XENP019224 vhCDR3
TGWLGPFDY

SEQ ID NO: 3064 - protein, 215 aa, Artificial Sequence; identical to SEQ ID NO: 2924
  Description of Artificial Sequence: Synthetic polypeptide
  XENP019224 [CTLA-4]_H0.14_L0_Fab Light Chain

SEQ ID NO: 3065 - protein, 108 aa, Artificial Sequence; identical to SEQ ID NO: 23
  Description of Artificial Sequence: Synthetic polypeptide
  VL of XENP019224

SEQ ID NO: 3066 - protein, 12 aa, Artificial Sequence
  Description of Artificial Sequence: Synthetic peptide
  XENP019224 vlCDR1
RASQSVGSSYLA

SEQ ID NO: 3067 - protein, 7 aa, Artificial Sequence
  Description of Artificial Sequence: Synthetic peptide
  XENP019224 vlCDR2
GAFSRAT

SEQ ID NO: 3068 - protein, 9 aa, Artificial Sequence
  Description of Artificial Sequence: Synthetic peptide
  XENP019224 vlCDR3
QQYGSSPWT

SEQ ID NO: 3069 - protein, 221 aa, Artificial Sequence
  Description of Artificial Sequence: Synthetic polypeptide
  XENP019225 [CTLA-4]_H0.15_L0_Fab Heavy Chain
QVQLVESGGGVVQPGRSLRLSCAASGFTFSNYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3070 - protein, 118 aa, Artificial Sequence; identical to SEQ ID NO: 319
  Description of Artificial Sequence: Synthetic polypeptide
  VH of XENP019225

SEQ ID NO: 3071 - protein, 5 aa, Artificial Sequence
  Description of Artificial Sequence: Synthetic peptide
  XENP019225 vhCDR1
NYTMH

SEQ ID NO: 3072 - protein, 17 aa, Artificial Sequence
  Description of Artificial Sequence: Synthetic peptide
  XENP019225 vhCDR2
FISYDGNNKYYADSVKG

SEQ ID NO: 3073 - protein, 9 aa, Artificial Sequence
  Description of Artificial Sequence: Synthetic peptide
  XENP019225 vhCDR3
TGWLGPFDY

SEQ ID NO: 3074 - protein, 215 aa, Artificial Sequence; identical to SEQ ID NO: 2924
  Description of Artificial Sequence: Synthetic polypeptide
  XENP019225 [CTLA-4]_H0.15_L0_Fab Light Chain

SEQ ID NO: 3075 - protein, 108 aa, Artificial Sequence; identical to SEQ ID NO: 23
  Description of Artificial Sequence: Synthetic polypeptide
  VL of XENP019225

SEQ ID NO: 3076 - protein, 12 aa, Artificial Sequence
  Description of Artificial Sequence: Synthetic peptide
  XENP019225 vlCDR1
RASQSVGSSYLA

SEQ ID NO: 3077 - protein, 7 aa, Artificial Sequence
  Description of Artificial Sequence: Synthetic peptide
  XENP019225 vlCDR2
GAFSRAT

SEQ ID NO: 3078 - protein, 9 aa, Artificial Sequence
  Description of Artificial Sequence: Synthetic peptide
  XENP019225 vlCDR3
QQYGSSPWT

SEQ ID NO: 3079 - protein, 221 aa, Artificial Sequence
  Description of Artificial Sequence: Synthetic polypeptide
  XENP019226 [CTLA-4]_H0.16_L0_Fab Heavy Chain
QVQLVESGGGVVQPGRSLRLSCAASGFTFSQYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3080 - protein, 118 aa, Artificial Sequence; identical to SEQ ID NO: 328
  Description of Artificial Sequence: Synthetic polypeptide
  VH of XENP019226

SEQ ID NO: 3081 - protein, 5 aa, Artificial Sequence
  Description of Artificial Sequence: Synthetic peptide
  XENP019226 vhCDR1
QYTMH

SEQ ID NO: 3082 - protein, 17 aa, Artificial Sequence
  Description of Artificial Sequence: Synthetic peptide
  XENP019226 vhCDR2
FISYDGNNKYYADSVKG

SEQ ID NO: 3083 - protein, 9 aa, Artificial Sequence
  Description of Artificial Sequence: Synthetic peptide
  XENP019226 vhCDR3
TGWLGPFDY

SEQ ID NO: 3084 - protein, 215 aa, Artificial Sequence; identical to SEQ ID NO: 2924
  Description of Artificial Sequence: Synthetic polypeptide
  XENP019226 [CTLA-4]_H0.16_L0_Fab Light Chain

SEQ ID NO: 3085 - protein, 108 aa, Artificial Sequence; identical to SEQ ID NO: 23
  Description of Artificial Sequence: Synthetic polypeptide
  VL of XENP019226

SEQ ID NO: 3086 - protein, 12 aa, Artificial Sequence
  Description of Artificial Sequence: Synthetic peptide
  XENP019226 vlCDR1
RASQSVGSSYLA

SEQ ID NO: 3087 - protein, 7 aa, Artificial Sequence
  Description of Artificial Sequence: Synthetic peptide
  XENP019226 vlCDR2
GAFSRAT

SEQ ID NO: 3088 - protein, 9 aa, Artificial Sequence
  Description of Artificial Sequence: Synthetic peptide
  XENP019226 vlCDR3
QQYGSSPWT

SEQ ID NO: 3089 - protein, 221 aa, Artificial Sequence
  Description of Artificial Sequence: Synthetic polypeptide
  XENP019227 [CTLA-4]_H0.17_L0_Fab Heavy Chain
QVQLVESGGGVVQPGRSLRLSCAASGFTFSTYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3090 - protein, 118 aa, Artificial Sequence; identical to SEQ ID NO: 337
  Description of Artificial Sequence: Synthetic polypeptide
  VH of XENP019227

SEQ ID NO: 3091 - protein, 5 aa, Artificial Sequence
  Description of Artificial Sequence: Synthetic peptide
  XENP019227 vhCDR1
TYTMH

SEQ ID NO: 3092 - protein, 17 aa, Artificial Sequence
  Description of Artificial Sequence: Synthetic peptide
  XENP019227 vhCDR2
FISYDGNNKYYADSVKG

SEQ ID NO: 3093 - protein, 9 aa, Artificial Sequence
  Description of Artificial Sequence: Synthetic peptide
  XENP019227 vhCDR3
TGWLGPFDY

SEQ ID NO: 3094 - protein, 215 aa, Artificial Sequence; identical to SEQ ID NO: 2924
  Description of Artificial Sequence: Synthetic polypeptide
  XENP019227 [CTLA-4]_H0.17_L0_Fab Light Chain

SEQ ID NO: 3095 - protein, 108 aa, Artificial Sequence; identical to SEQ ID NO: 23
  Description of Artificial Sequence: Synthetic polypeptide
  VL of XENP019227

SEQ ID NO: 3096 - protein, 12 aa, Artificial Sequence
  Description of Artificial Sequence: Synthetic peptide
  XENP019227 vlCDR1
RASQSVGSSYLA

SEQ ID NO: 3097 - protein, 7 aa, Artificial Sequence
  Description of Artificial Sequence: Synthetic peptide
  XENP019227 vlCDR2
GAFSRAT

SEQ ID NO: 3098 - protein, 9 aa, Artificial Sequence
  Description of Artificial Sequence: Synthetic peptide
  XENP019227 vlCDR3
QQYGSSPWT

SEQ ID NO: 3099 - protein, 221 aa, Artificial Sequence
  Description of Artificial Sequence: Synthetic polypeptide
  XENP019228 [CTLA-4]_H0.18_L0_Fab Heavy Chain
QVQLVESGGGVVQPGRSLRLSCAASGFTFSSATMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3100 - protein, 118 aa, Artificial Sequence; identical to SEQ ID NO: 346
  Description of Artificial Sequence: Synthetic polypeptide
  VH of XENP019228

SEQ ID NO: 3101 - protein, 5 aa, Artificial Sequence
  Description of Artificial Sequence: Synthetic peptide
  XENP019228 vhCDR1
SATMH

SEQ ID NO: 3102 - protein, 17 aa, Artificial Sequence
  Description of Artificial Sequence: Synthetic peptide
  XENP019228 vhCDR2
FISYDGNNKYYADSVKG

SEQ ID NO: 3103 - protein, 9 aa, Artificial Sequence
  Description of Artificial Sequence: Synthetic peptide
  XENP019228 vhCDR3
TGWLGPFDY

SEQ ID NO: 3104 - protein, 215 aa, Artificial Sequence; identical to SEQ ID NO: 2924
  Description of Artificial Sequence: Synthetic polypeptide
  XENP019228 [CTLA-4]_H0.18_L0_Fab Light Chain

SEQ ID NO: 3105 - protein, 108 aa, Artificial Sequence; identical to SEQ ID NO: 23
  Description of Artificial Sequence: Synthetic polypeptide
  VL of XENP019228

SEQ ID NO: 3106 - protein, 12 aa, Artificial Sequence
  Description of Artificial Sequence: Synthetic peptide
  XENP019228 vlCDR1
RASQSVGSSYLA

SEQ ID NO: 3107 - protein, 7 aa, Artificial Sequence
  Description of Artificial Sequence: Synthetic peptide
  XENP019228 vlCDR2
GAFSRAT

SEQ ID NO: 3108 - protein, 9 aa, Artificial Sequence
  Description of Artificial Sequence: Synthetic peptide
  XENP019228 vlCDR3
QQYGSSPWT

SEQ ID NO: 3109 - protein, 221 aa, Artificial Sequence
  Description of Artificial Sequence: Synthetic polypeptide
  XENP019229 [CTLA-4]_H0.19_L0_Fab Heavy Chain
QVQLVESGGGVVQPGRSLRLSCAASGFTFSSHTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3110 - protein, 118 aa, Artificial Sequence; identical to SEQ ID NO: 355
  Description of Artificial Sequence: Synthetic polypeptide
  VH of XENP019229

SEQ ID NO: 3111 - protein, 5 aa, Artificial Sequence
  Description of Artificial Sequence: Synthetic peptide
  XENP019229 vhCDR1
SHTMH

SEQ ID NO: 3112 - protein, 17 aa, Artificial Sequence
  Description of Artificial Sequence: Synthetic peptide
  XENP019229 vhCDR2
FISYDGNNKYYADSVKG

SEQ ID NO: 3113 - protein, 9 aa, Artificial Sequence
  Description of Artificial Sequence: Synthetic peptide
  XENP019229 vhCDR3
TGWLGPFDY

SEQ ID NO: 3114 - protein, 215 aa, Artificial Sequence; identical to SEQ ID NO: 2924
  Description of Artificial Sequence: Synthetic polypeptide
  XENP019229 [CTLA-4]_H0.19_L0_Fab Light Chain

SEQ ID NO: 3115 - protein, 108 aa, Artificial Sequence; identical to SEQ ID NO: 23
  Description of Artificial Sequence: Synthetic polypeptide
  VL of XENP019229

SEQ ID NO: 3116 - protein, 12 aa, Artificial Sequence
  Description of Artificial Sequence: Synthetic peptide
  XENP019229 vlCDR1
RASQSVGSSYLA

SEQ ID NO: 3117 - protein, 7 aa, Artificial Sequence
  Description of Artificial Sequence: Synthetic peptide
  XENP019229 vlCDR2
GAFSRAT

SEQ ID NO: 3118 - protein, 9 aa, Artificial Sequence
  Description of Artificial Sequence: Synthetic peptide
  XENP019229 vlCDR3
QQYGSSPWT

SEQ ID NO: 3119 - protein, 221 aa, Artificial Sequence
  Description of Artificial Sequence: Synthetic polypeptide
  XENP019230 [CTLA-4]_H0.20_L0_Fab Heavy Chain
QVQLVESGGGVVQPGRSLRLSCAASGFTFSSFTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3120 - protein, 118 aa, Artificial Sequence; identical to SEQ ID NO: 364
  Description of Artificial Sequence: Synthetic polypeptide
  VH of XENP019230

SEQ ID NO: 3121 - protein, 5 aa, Artificial Sequence
  Description of Artificial Sequence: Synthetic peptide
  XENP019230 vhCDR1
SFTMH

SEQ ID NO: 3122 - protein, 17 aa, Artificial Sequence
  Description of Artificial Sequence: Synthetic peptide
  XENP019230 vhCDR2
FISYDGNNKYYADSVKG

SEQ ID NO: 3123 - protein, 9 aa, Artificial Sequence
  Description of Artificial Sequence: Synthetic peptide
  XENP019230 vhCDR3
TGWLGPFDY

SEQ ID NO: 3124 - protein, 215 aa, Artificial Sequence; identical to SEQ ID NO: 2924
  Description of Artificial Sequence: Synthetic polypeptide
  XENP019230 [CTLA-4]_H0.20_L0_Fab Light Chain

SEQ ID NO: 3125 - protein, 108 aa, Artificial Sequence; identical to SEQ ID NO: 23
  Description of Artificial Sequence: Synthetic polypeptide
  VL of XENP019230

SEQ ID NO: 3126 - protein, 12 aa, Artificial Sequence
  Description of Artificial Sequence: Synthetic peptide
  XENP019230 vlCDR1
RASQSVGSSYLA

SEQ ID NO: 3127 - protein, 7 aa, Artificial Sequence
  Description of Artificial Sequence: Synthetic peptide
  XENP019230 vlCDR2
GAFSRAT

SEQ ID NO: 3128 - protein, 9 aa, Artificial Sequence
  Description of Artificial Sequence: Synthetic peptide
  XENP019230 vlCDR3
QQYGSSPWT

SEQ ID NO: 3129 - protein, 221 aa, Artificial Sequence
  Description of Artificial Sequence: Synthetic polypeptide
  XENP019231 [CTLA-4]_H0.21_L0_Fab Heavy Chain
QVQLVESGGGVVQPGRSLRLSCAASGFTFSSLTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3130 - protein, 118 aa, Artificial Sequence; identical to SEQ ID NO: 373
  Description of Artificial Sequence: Synthetic polypeptide
  VH of XENP019231

SEQ ID NO: 3131 - protein, 5 aa, Artificial Sequence
  Description of Artificial Sequence: Synthetic peptide
  XENP019231 vhCDR1
SLTMH

SEQ ID NO: 3132 - protein, 17 aa, Artificial Sequence
  Description of Artificial Sequence: Synthetic peptide
  XENP019231 vhCDR2
FISYDGNNKYYADSVKG

SEQ ID NO: 3133 - protein, 9 aa, Artificial Sequence
  Description of Artificial Sequence: Synthetic peptide
  XENP019231 vhCDR3
TGWLGPFDY

SEQ ID NO: 3134 - protein, 215 aa, Artificial Sequence; identical to SEQ ID NO: 2924
  Description of Artificial Sequence: Synthetic polypeptide
  XENP019231 [CTLA-4]_H0.21_L0_Fab Light Chain

SEQ ID NO: 3135 - protein, 108 aa, Artificial Sequence; identical to SEQ ID NO: 23
  Description of Artificial Sequence: Synthetic polypeptide
  VL of XENP019231

SEQ ID NO: 3136 - protein, 12 aa, Artificial Sequence
  Description of Artificial Sequence: Synthetic peptide
  XENP019231 vlCDR1
RASQSVGSSYLA

SEQ ID NO: 3137 - protein, 7 aa, Artificial Sequence
  Description of Artificial Sequence: Synthetic peptide
  XENP019231 vlCDR2
GAFSRAT

SEQ ID NO: 3138 - protein, 9 aa, Artificial Sequence
  Description of Artificial Sequence: Synthetic peptide
  XENP019231 vlCDR3
QQYGSSPWT

SEQ ID NO: 3139 - protein, 221 aa, Artificial Sequence
  Description of Artificial Sequence: Synthetic polypeptide
  XENP019232 [CTLA-4]_H0.22_L0_Fab Heavy Chain
QVQLVESGGGVVQPGRSLRLSCAASGFTFSSNTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3140 - protein, 118 aa, Artificial Sequence; identical to SEQ ID NO: 382
  Description of Artificial Sequence: Synthetic polypeptide
  VH of XENP019232

SEQ ID NO: 3141 - protein, 5 aa, Artificial Sequence
  Description of Artificial Sequence: Synthetic peptide
  XENP019232 vhCDR1
SNTMH

SEQ ID NO: 3142 - protein, 17 aa, Artificial Sequence
  Description of Artificial Sequence: Synthetic peptide
  XENP019232 vhCDR2
FISYDGNNKYYADSVKG

SEQ ID NO: 3143 - protein, 9 aa, Artificial Sequence
  Description of Artificial Sequence: Synthetic peptide
  XENP019232 vhCDR3
TGWLGPFDY

SEQ ID NO: 3144 - protein, 215 aa, Artificial Sequence; identical to SEQ ID NO: 2924
  Description of Artificial Sequence: Synthetic polypeptide
  XENP019232 [CTLA-4]_H0.22_L0_Fab Light Chain

SEQ ID NO: 3145 - protein, 108 aa, Artificial Sequence; identical to SEQ ID NO: 23
  Description of Artificial Sequence: Synthetic polypeptide
  VL of XENP019232

SEQ ID NO: 3146 - protein, 12 aa, Artificial Sequence
  Description of Artificial Sequence: Synthetic peptide
  XENP019232 vlCDR1
RASQSVGSSYLA

SEQ ID NO: 3147 - protein, 7 aa, Artificial Sequence
  Description of Artificial Sequence: Synthetic peptide
  XENP019232 vlCDR2
GAFSRAT

SEQ ID NO: 3148 - protein, 9 aa, Artificial Sequence
  Description of Artificial Sequence: Synthetic peptide
  XENP019232 vlCDR3
QQYGSSPWT

SEQ ID NO: 3149 - protein, 221 aa, Artificial Sequence
  Description of Artificial Sequence: Synthetic polypeptide
  XENP019233 [CTLA-4]_H0.23_L0_Fab Heavy Chain
QVQLVESGGGVVQPGRSLRLSCAASGFTFSSSTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3150 - protein, 118 aa, Artificial Sequence; identical to SEQ ID NO: 391
  Description of Artificial Sequence: Synthetic polypeptide
  VH of XENP019233

SEQ ID NO: 3151 - protein, 5 aa, Artificial Sequence
  Description of Artificial Sequence: Synthetic peptide
  XENP019233 vhCDR1
SSTMH

SEQ ID NO: 3152 - protein, 17 aa, Artificial Sequence
  Description of Artificial Sequence: Synthetic peptide
  XENP019233 vhCDR2
FISYDGNNKYYADSVKG

SEQ ID NO: 3153 - protein, 9 aa, Artificial Sequence
  Description of Artificial Sequence: Synthetic peptide
  XENP019233 vhCDR3
TGWLGPFDY

SEQ ID NO: 3154 - protein, 215 aa, Artificial Sequence; identical to SEQ ID NO: 2924
  Description of Artificial Sequence: Synthetic polypeptide
  XENP019233 [CTLA-4]_H0.23_L0_Fab Light Chain

SEQ ID NO: 3155 - protein, 108 aa, Artificial Sequence; identical to SEQ ID NO: 23
  Description of Artificial Sequence: Synthetic polypeptide
  VL of XENP019233

SEQ ID NO: 3156 - protein, 12 aa, Artificial Sequence
  Description of Artificial Sequence: Synthetic peptide
  XENP019233 vlCDR1
RASQSVGSSYLA

SEQ ID NO: 3157 - protein, 7 aa, Artificial Sequence
  Description of Artificial Sequence: Synthetic peptide
  XENP019233 vlCDR2
GAFSRAT

SEQ ID NO: 3158 - protein, 9 aa, Artificial Sequence
  Description of Artificial Sequence: Synthetic peptide
  XENP019233 vlCDR3
QQYGSSPWT

SEQ ID NO: 3159 - protein, 221 aa, Artificial Sequence
  Description of Artificial Sequence: Synthetic polypeptide
  XENP019234 [CTLA-4]_H0.24_L0_Fab Heavy Chain
QVQLVESGGGVVQPGRSLRLSCAASGFTFSSVTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3160 - protein, 118 aa, Artificial Sequence; identical to SEQ ID NO: 400
  Description of Artificial Sequence: Synthetic polypeptide
  VH of XENP019234

SEQ ID NO: 3161 - protein, 5 aa, Artificial Sequence
  Description of Artificial Sequence: Synthetic peptide
  XENP019234 vhCDR1
SVTMH

SEQ ID NO: 3162 - protein, 17 aa, Artificial Sequence
  Description of Artificial Sequence: Synthetic peptide
  XENP019234 vhCDR2
FISYDGNNKYYADSVKG

SEQ ID NO: 3163 - protein, 9 aa, Artificial Sequence
  Description of Artificial Sequence: Synthetic peptide
  XENP019234 vhCDR3
TGWLGPFDY

SEQ ID NO: 3164 - protein, 215 aa, Artificial Sequence; identical to SEQ ID NO: 2924
  Description of Artificial Sequence: Synthetic polypeptide
  XENP019234 [CTLA-4]_H0.24_L0_Fab Light Chain

SEQ ID NO: 3165 - protein, 108 aa, Artificial Sequence; identical to SEQ ID NO: 23
  Description of Artificial Sequence: Synthetic polypeptide
  VL of XENP019234

SEQ ID NO: 3166 - protein, 12 aa, Artificial Sequence
  Description of Artificial Sequence: Synthetic peptide
  XENP019234 vlCDR1
RASQSVGSSYLA

SEQ ID NO: 3167 - protein, 7 aa, Artificial Sequence
  Description of Artificial Sequence: Synthetic peptide
  XENP019234 vlCDR2
GAFSRAT

SEQ ID NO: 3168 - protein, 9 aa, Artificial Sequence
  Description of Artificial Sequence: Synthetic peptide
  XENP019234 vlCDR3
QQYGSSPWT

SEQ ID NO: 3169 - protein, 221 aa, Artificial Sequence
  Description of Artificial Sequence: Synthetic polypeptide
  XENP019235 [CTLA-4]_H0.25_L0_Fab Heavy Chain
QVQLVESGGGVVQPGRSLRLSCAASGFTFSSYAMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3170 - protein, 118 aa, Artificial Sequence; identical to SEQ ID NO: 409
  Description of Artificial Sequence: Synthetic polypeptide
  VH of XENP019235

SEQ ID NO: 3171 - protein, 5 aa, Artificial Sequence
  Description of Artificial Sequence: Synthetic peptide
  XENP019235 vhCDR1
SYAMH

SEQ ID NO: 3172 - protein, 17 aa, Artificial Sequence
  Description of Artificial Sequence: Synthetic peptide
  XENP019235 vhCDR2
FISYDGNNKYYADSVKG

SEQ ID NO: 3173 - protein, 9 aa, Artificial Sequence
  Description of Artificial Sequence: Synthetic peptide
  XENP019235 vhCDR3
TGWLGPFDY

SEQ ID NO: 3174 - protein, 215 aa, Artificial Sequence; identical to SEQ ID NO: 2924
  Description of Artificial Sequence: Synthetic polypeptide
  XENP019235 [CTLA-4]_H0.25_L0_Fab Light Chain

SEQ ID NO: 3175 - protein, 108 aa, Artificial Sequence; identical to SEQ ID NO: 23
  Description of Artificial Sequence: Synthetic polypeptide
  VL of XENP019235

SEQ ID NO: 3176 - protein, 12 aa, Artificial Sequence
  Description of Artificial Sequence: Synthetic peptide
  XENP019235 vlCDR1
RASQSVGSSYLA

SEQ ID NO: 3177 - protein, 7 aa, Artificial Sequence
  Description of Artificial Sequence: Synthetic peptide
  XENP019235 vlCDR2
GAFSRAT

SEQ ID NO: 3178 - protein, 9 aa, Artificial Sequence
  Description of Artificial Sequence: Synthetic peptide
  XENP019235 vlCDR3
QQYGSSPWT

SEQ ID NO: 3179 - protein, 221 aa, Artificial Sequence
  Description of Artificial Sequence: Synthetic polypeptide
  XENP019236 [CTLA-4]_H0.26_L0_Fab Heavy Chain
QVQLVESGGGVVQPGRSLRLSCAASGFTFSSYGMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3180 - protein, 118 aa, Artificial Sequence; identical to SEQ ID NO: 418
  Description of Artificial Sequence: Synthetic polypeptide
  VH of XENP019236

SEQ ID NO: 3181 - protein, 5 aa, Artificial Sequence
  Description of Artificial Sequence: Synthetic peptide
  XENP019236 vhCDR1
SYGMH

SEQ ID NO: 3182 - protein, 17 aa, Artificial Sequence
  Description of Artificial Sequence: Synthetic peptide
  XENP019236 vhCDR2
FISYDGNNKYYADSVKG

SEQ ID NO: 3183 - protein, 9 aa, Artificial Sequence
  Description of Artificial Sequence: Synthetic peptide
  XENP019236 vhCDR3
TGWLGPFDY

SEQ ID NO: 3184 - protein, 215 aa, Artificial Sequence; identical to SEQ ID NO: 2924
  Description of Artificial Sequence: Synthetic polypeptide
  XENP019236 [CTLA-4]_H0.26_L0_Fab Light Chain

SEQ ID NO: 3185 - protein, 108 aa, Artificial Sequence; identical to SEQ ID NO: 23
  Description of Artificial Sequence: Synthetic polypeptide
  VL of XENP019236

SEQ ID NO: 3186 - protein, 12 aa, Artificial Sequence
  Description of Artificial Sequence: Synthetic peptide
  XENP019236 vlCDR1
RASQSVGSSYLA

SEQ ID NO: 3187 - protein, 7 aa, Artificial Sequence
  Description of Artificial Sequence: Synthetic peptide
  XENP019236 vlCDR2
GAFSRAT

SEQ ID NO: 3188 - protein, 9 aa, Artificial Sequence
  Description of Artificial Sequence: Synthetic peptide
  XENP019236 vlCDR3
QQYGSSPWT

SEQ ID NO: 3189 - protein, 221 aa, Artificial Sequence
  Description of Artificial Sequence: Synthetic polypeptide
  XENP019237 [CTLA-4]_H0.27_L0_Fab Heavy Chain
QVQLVESGGGVVQPGRSLRLSCAASGFTFSSYSMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3190 - protein, 118 aa, Artificial Sequence; identical to SEQ ID NO: 427
  Description of Artificial Sequence: Synthetic polypeptide
  VH of XENP019237

SEQ ID NO: 3191 - protein, 5 aa, Artificial Sequence
  Description of Artificial Sequence: Synthetic peptide
  XENP019237 vhCDR1
SYSMH

SEQ ID NO: 3192 - protein, 17 aa, Artificial Sequence
  Description of Artificial Sequence: Synthetic peptide
  XENP019237 vhCDR2
FISYDGNNKYYADSVKG

SEQ ID NO: 3193 - protein, 9 aa, Artificial Sequence
  Description of Artificial Sequence: Synthetic peptide
  XENP019237 vhCDR3
TGWLGPFDY

SEQ ID NO: 3194 - protein, 215 aa, Artificial Sequence; identical to SEQ ID NO: 2924
  Description of Artificial Sequence: Synthetic polypeptide
  XENP019237 [CTLA-4]_H0.27_L0_Fab Light Chain

SEQ ID NO: 3195 - protein, 108 aa, Artificial Sequence; identical to SEQ ID NO: 23
  Description of Artificial Sequence: Synthetic polypeptide
  VL of XENP019237

SEQ ID NO: 3196 - protein, 12 aa, Artificial Sequence
  Description of Artificial Sequence: Synthetic peptide
  XENP019237 vlCDR1
RASQSVGSSYLA

SEQ ID NO: 3197 - protein, 7 aa, Artificial Sequence
  Description of Artificial Sequence: Synthetic peptide
  XENP019237 vlCDR2
GAFSRAT

SEQ ID NO: 3198 - protein, 9 aa, Artificial Sequence
  Description of Artificial Sequence: Synthetic peptide
  XENP019237 vlCDR3
QQYGSSPWT

SEQ ID NO: 3199 - protein, 221 aa, Artificial Sequence
  Description of Artificial Sequence: Synthetic polypeptide
  XENP019238 [CTLA-4]_H0.28_L0_Fab Heavy Chain
QVQLVESGGGVVQPGRSLRLSCAASGFTFSSYVMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3200 - protein, 118 aa, Artificial Sequence; identical to SEQ ID NO: 436
  Description of Artificial Sequence: Synthetic polypeptide
  VH of XENP019238

SEQ ID NO: 3201 - protein, 5 aa, Artificial Sequence
  Description of Artificial Sequence: Synthetic peptide
  XENP019238 vhCDR1
SYVMH

SEQ ID NO: 3202 - protein, 17 aa, Artificial Sequence
  Description of Artificial Sequence: Synthetic peptide
  XENP019238 vhCDR2
FISYDGNNKYYADSVKG

SEQ ID NO: 3203 - protein, 9 aa, Artificial Sequence
  Description of Artificial Sequence: Synthetic peptide
  XENP019238 vhCDR3
TGWLGPFDY

SEQ ID NO: 3204 - protein, 215 aa, Artificial Sequence; identical to SEQ ID NO: 2924
  Description of Artificial Sequence: Synthetic polypeptide
  XENP019238 [CTLA-4]_H0.28_L0_Fab Light Chain

SEQ ID NO: 3205 - protein, 108 aa, Artificial Sequence; identical to SEQ ID NO: 23
  Description of Artificial Sequence: Synthetic polypeptide
  VL of XENP019238

SEQ ID NO: 3206 - protein, 12 aa, Artificial Sequence
  Description of Artificial Sequence: Synthetic peptide
  XENP019238 vlCDR1
RASQSVGSSYLA

SEQ ID NO: 3207 - protein, 7 aa, Artificial Sequence
  Description of Artificial Sequence: Synthetic peptide
  XENP019238 vlCDR2
GAFSRAT

SEQ ID NO: 3208 - protein, 9 aa, Artificial Sequence
  Description of Artificial Sequence: Synthetic peptide
  XENP019238 vlCDR3
QQYGSSPWT

SEQ ID NO: 3209 - protein, 221 aa, Artificial Sequence
  Description of Artificial Sequence: Synthetic polypeptide
  XENP019239 [CTLA-4]_H0.29_L0_Fab Heavy Chain
QVQLVESGGGVVQPGRSLRLSCAASGFTFSSYYMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3210 - protein, 118 aa, Artificial Sequence; identical to SEQ ID NO: 445
  Description of Artificial Sequence: Synthetic polypeptide
  VH of XENP019239

SEQ ID NO: 3211 - protein, 5 aa, Artificial Sequence
  Description of Artificial Sequence: Synthetic peptide
  XENP019239 vhCDR1
SYYMH

SEQ ID NO: 3212 - protein, 17 aa, Artificial Sequence
  Description of Artificial Sequence: Synthetic peptide
  XENP019239 vhCDR2
FISYDGNNKYYADSVKG

SEQ ID NO: 3213 - protein, 9 aa, Artificial Sequence
  Description of Artificial Sequence: Synthetic peptide
  XENP019239 vhCDR3
TGWLGPFDY

SEQ ID NO: 3214 - protein, 215 aa, Artificial Sequence; identical to SEQ ID NO: 2924
  Description of Artificial Sequence: Synthetic polypeptide
  XENP019239 [CTLA-4]_H0.29_L0_Fab Light Chain

SEQ ID NO: 3215 - protein, 108 aa, Artificial Sequence; identical to SEQ ID NO: 23
  Description of Artificial Sequence: Synthetic polypeptide
  VL of XENP019239

SEQ ID NO: 3216 - protein, 12 aa, Artificial Sequence
  Description of Artificial Sequence: Synthetic peptide
  XENP019239 vlCDR1
RASQSVGSSYLA

SEQ ID NO: 3217 - protein, 7 aa, Artificial Sequence
  Description of Artificial Sequence: Synthetic peptide
  XENP019239 vlCDR2
GAFSRAT

SEQ ID NO: 3218 - protein, 9 aa, Artificial Sequence
  Description of Artificial Sequence: Synthetic peptide
  XENP019239 vlCDR3
QQYGSSPWT

SEQ ID NO: 3219 - protein, 221 aa, Artificial Sequence
  Description of Artificial Sequence: Synthetic polypeptide
  XENP019240 [CTLA-4]_H0.30_L0_Fab Heavy Chain
QVQLVESGGGVVQPGRSLRLSCAASGFTFSSYTMDWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3220 - protein, 118 aa, Artificial Sequence; identical to SEQ ID NO: 454
  Description of Artificial Sequence: Synthetic polypeptide
  VH of XENP019240

SEQ ID NO: 3221 - protein, 5 aa, Artificial Sequence
  Description of Artificial Sequence: Synthetic peptide
  XENP019240 vhCDR1
SYTMD

SEQ ID NO: 3222 - protein, 17 aa, Artificial Sequence
  Description of Artificial Sequence: Synthetic peptide
  XENP019240 vhCDR2
FISYDGNNKYYADSVKG

SEQ ID NO: 3223 - protein, 9 aa, Artificial Sequence
  Description of Artificial Sequence: Synthetic peptide
  XENP019240 vhCDR3
TGWLGPFDY

SEQ ID NO: 3224 - protein, 215 aa, Artificial Sequence; identical to SEQ ID NO: 2924
  Description of Artificial Sequence: Synthetic polypeptide
  XENP019240 [CTLA-4]_H0.30_L0_Fab Light Chain

SEQ ID NO: 3225 - protein, 108 aa, Artificial Sequence; identical to SEQ ID NO: 23
  Description of Artificial Sequence: Synthetic polypeptide
  VL of XENP019240

SEQ ID NO: 3226 - protein, 12 aa, Artificial Sequence
  Description of Artificial Sequence: Synthetic peptide
  XENP019240 vlCDR1
RASQSVGSSYLA

SEQ ID NO: 3227 - protein, 7 aa, Artificial Sequence
  Description of Artificial Sequence: Synthetic peptide
  XENP019240 vlCDR2
GAFSRAT

SEQ ID NO: 3228 - protein, 9 aa, Artificial Sequence
  Description of Artificial Sequence: Synthetic peptide
  XENP019240 vlCDR3
QQYGSSPWT

SEQ ID NO: 3229 - protein, 221 aa, Artificial Sequence
  Description of Artificial Sequence: Synthetic polypeptide
  XENP019241 [CTLA-4]_H0.31_L0_Fab Heavy Chain
QVQLVESGGGVVQPGRSLRLSCAASGFTFSSYTMFWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3230 - protein, 118 aa, Artificial Sequence; identical to SEQ ID NO: 463
  Description of Artificial Sequence: Synthetic polypeptide
  VH of XENP019241

SEQ ID NO: 3231 - protein, 5 aa, Artificial Sequence
  Description of Artificial Sequence: Synthetic peptide
  XENP019241 vhCDR1
SYTMF

SEQ ID NO: 3232 - protein, 17 aa, Artificial Sequence
  Description of Artificial Sequence: Synthetic peptide
  XENP019241 vhCDR2
FISYDGNNKYYADSVKG

SEQ ID NO: 3233 - protein, 9 aa, Artificial Sequence
  Description of Artificial Sequence: Synthetic peptide
  XENP019241 vhCDR3
TGWLGPFDY

SEQ ID NO: 3234 - protein, 215 aa, Artificial Sequence; identical to SEQ ID NO: 2924
  Description of Artificial Sequence: Synthetic polypeptide
  XENP019241 [CTLA-4]_H0.31_L0_Fab Light Chain

SEQ ID NO: 3235 - protein, 108 aa, Artificial Sequence; identical to SEQ ID NO: 23
  Description of Artificial Sequence: Synthetic polypeptide
  VL of XENP019241

SEQ ID NO: 3236 - protein, 12 aa, Artificial Sequence
  Description of Artificial Sequence: Synthetic peptide
  XENP019241 vlCDR1
RASQSVGSSYLA

SEQ ID NO: 3237 - protein, 7 aa, Artificial Sequence
  Description of Artificial Sequence: Synthetic peptide
  XENP019241 vlCDR2
GAFSRAT

SEQ ID NO: 3238 - protein, 9 aa, Artificial Sequence
  Description of Artificial Sequence: Synthetic peptide
  XENP019241 vlCDR3
QQYGSSPWT

SEQ ID NO: 3239 - protein, 221 aa, Artificial Sequence
  Description of Artificial Sequence: Synthetic polypeptide
  XENP019242 [CTLA-4]_H0.32_L0_Fab Heavy Chain
QVQLVESGGGVVQPGRSLRLSCAASGFTFSSYTMNWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3240 - protein, 118 aa, Artificial Sequence; identical to SEQ ID NO: 472
  Description of Artificial Sequence: Synthetic polypeptide
  VH of XENP019242

SEQ ID NO: 3241 - protein, 5 aa, Artificial Sequence
  Description of Artificial Sequence: Synthetic peptide
  XENP019242 vhCDR1
SYTMN

SEQ ID NO: 3242 - protein, 17 aa, Artificial Sequence
  Description of Artificial Sequence: Synthetic peptide
  XENP019242 vhCDR2
FISYDGNNKYYADSVKG

SEQ ID NO: 3243 - protein, 9 aa, Artificial Sequence
  Description of Artificial Sequence: Synthetic peptide
  XENP019242 vhCDR3
TGWLGPFDY

SEQ ID NO: 3244 - protein, 215 aa, Artificial Sequence; identical to SEQ ID NO: 2924
  Description of Artificial Sequence: Synthetic polypeptide
  XENP019242 [CTLA-4]_H0.32_L0_Fab Light Chain

SEQ ID NO: 3245 - protein, 108 aa, Artificial Sequence; identical to SEQ ID NO: 23
  Description of Artificial Sequence: Synthetic polypeptide
  VL of XENP019242

SEQ ID NO: 3246 - protein, 12 aa, Artificial Sequence
  Description of Artificial Sequence: Synthetic peptide
  XENP019242 vlCDR1
RASQSVGSSYLA

SEQ ID NO: 3247 - protein, 7 aa, Artificial Sequence
  Description of Artificial Sequence: Synthetic peptide
  XENP019242 vlCDR2
GAFSRAT

SEQ ID NO: 3248 - protein, 9 aa, Artificial Sequence
  Description of Artificial Sequence: Synthetic peptide
  XENP019242 vlCDR3
QQYGSSPWT

SEQ ID NO: 3249 - protein, 221 aa, Artificial Sequence
  Description of Artificial Sequence: Synthetic polypeptide
  XENP019243 [CTLA-4]_H0.33_L0_Fab Heavy Chain
QVQLVESGGGVVQPGRSLRLSCAASGFTFSSYTMSWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3250 - protein, 118 aa, Artificial Sequence; identical to SEQ ID NO: 481
  Description of Artificial Sequence: Synthetic polypeptide
  VH of XENP019243

SEQ ID NO: 3251 - protein, 5 aa, Artificial Sequence
  Description of Artificial Sequence: Synthetic peptide
  XENP019243 vhCDR1
SYTMS

SEQ ID NO: 3252 - protein, 17 aa, Artificial Sequence
  Description of Artificial Sequence: Synthetic peptide
  XENP019243 vhCDR2
FISYDGNNKYYADSVKG

SEQ ID NO: 3253 - protein, 9 aa, Artificial Sequence
  Description of Artificial Sequence: Synthetic peptide
  XENP019243 vhCDR3
TGWLGPFDY

SEQ ID NO: 3254 - protein, 215 aa, Artificial Sequence; identical to SEQ ID NO: 2924
  Description of Artificial Sequence: Synthetic polypeptide
  XENP019243 [CTLA-4]_H0.33_L0_Fab Light Chain

SEQ ID NO: 3255 - protein, 108 aa, Artificial Sequence; identical to SEQ ID NO: 23
  Description of Artificial Sequence: Synthetic polypeptide
  VL of XENP019243

SEQ ID NO: 3256 - protein, 12 aa, Artificial Sequence
  Description of Artificial Sequence: Synthetic peptide
  XENP019243 vlCDR1
RASQSVGSSYLA

SEQ ID NO: 3257 - protein, 7 aa, Artificial Sequence
  Description of Artificial Sequence: Synthetic peptide
  XENP019243 vlCDR2
GAFSRAT

SEQ ID NO: 3258 - protein, 9 aa, Artificial Sequence
  Description of Artificial Sequence: Synthetic peptide
  XENP019243 vlCDR3
QQYGSSPWT

SEQ ID NO: 3259 - protein, 221 aa, Artificial Sequence
  Description of Artificial Sequence: Synthetic polypeptide
  XENP019244 [CTLA-4]_H0.34_L0_Fab Heavy Chain
QVQLVESGGGVVQPGRSLRLSCAASGFTFSSYTMYWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3260 - protein, 118 aa, Artificial Sequence; identical to SEQ ID NO: 490
  Description of Artificial Sequence: Synthetic polypeptide
  VH of XENP019244

SEQ ID NO: 3261 - protein, 5 aa, Artificial Sequence
  Description of Artificial Sequence: Synthetic peptide
  XENP019244 vhCDR1
SYTMY

SEQ ID NO: 3262 - protein, 17 aa, Artificial Sequence
  Description of Artificial Sequence: Synthetic peptide
  XENP019244 vhCDR2
FISYDGNNKYYADSVKG

SEQ ID NO: 3263 - protein, 9 aa, Artificial Sequence
  Description of Artificial Sequence: Synthetic peptide
  XENP019244 vhCDR3
TGWLGPFDY

SEQ ID NO: 3264 - protein, 215 aa, Artificial Sequence; identical to SEQ ID NO: 2924
  Description of Artificial Sequence: Synthetic polypeptide
  XENP019244 [CTLA-4]_H0.34_L0_Fab Light Chain

SEQ ID NO: 3265 - protein, 108 aa, Artificial Sequence; identical to SEQ ID NO: 23
  Description of Artificial Sequence: Synthetic polypeptide
  VL of XENP019244

SEQ ID NO: 3266 - protein, 12 aa, Artificial Sequence
  Description of Artificial Sequence: Synthetic peptide
  XENP019244 vlCDR1
RASQSVGSSYLA

SEQ ID NO: 3267 - protein, 7 aa, Artificial Sequence
  Description of Artificial Sequence: Synthetic peptide
  XENP019244 vlCDR2
GAFSRAT

SEQ ID NO: 3268 - protein, 9 aa, Artificial Sequence
  Description of Artificial Sequence: Synthetic peptide
  XENP019244 vlCDR3
QQYGSSPWT

SEQ ID NO: 3269 - protein, 221 aa, Artificial Sequence
  Description of Artificial Sequence: Synthetic polypeptide
  XENP019245 [CTLA-4]_H0.35_L0_Fab Heavy Chain
QVQLVESGGGVVQPGRSLRLSCAASGFTFSSYTMHWIRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3270 - protein, 118 aa, Artificial Sequence; identical to SEQ ID NO: 499
  Description of Artificial Sequence: Synthetic polypeptide
  VH of XENP019245

SEQ ID NO: 3271 - protein, 5 aa, Artificial Sequence
  Description of Artificial Sequence: Synthetic peptide
  XENP019245 vhCDR1
SYTMH

SEQ ID NO: 3272 - protein, 17 aa, Artificial Sequence
  Description of Artificial Sequence: Synthetic peptide
  XENP019245 vhCDR2
FISYDGNNKYYADSVKG

SEQ ID NO: 3273 - protein, 9 aa, Artificial Sequence
  Description of Artificial Sequence: Synthetic peptide
  XENP019245 vhCDR3
TGWLGPFDY

SEQ ID NO: 3274 - protein, 215 aa, Artificial Sequence; identical to SEQ ID NO: 2924
  Description of Artificial Sequence: Synthetic polypeptide
  XENP019245 [CTLA-4]_H0.35_L0_Fab Light Chain

SEQ ID NO: 3275 - protein, 108 aa, Artificial Sequence; identical to SEQ ID NO: 23
  Description of Artificial Sequence: Synthetic polypeptide
  VL of XENP019245

SEQ ID NO: 3276 - protein, 12 aa, Artificial Sequence
  Description of Artificial Sequence: Synthetic peptide
  XENP019245 vlCDR1
RASQSVGSSYLA

SEQ ID NO: 3277 - protein, 7 aa, Artificial Sequence
  Description of Artificial Sequence: Synthetic peptide
  XENP019245 vlCDR2
GAFSRAT

SEQ ID NO: 3278 - protein, 9 aa, Artificial Sequence
  Description of Artificial Sequence: Synthetic peptide
  XENP019245 vlCDR3
QQYGSSPWT

SEQ ID NO: 3279 - protein, 221 aa, Artificial Sequence
  Description of Artificial Sequence: Synthetic polypeptide
  XENP019246 [CTLA-4]_H0.36_L0_Fab Heavy Chain
QVQLVESGGGVVQPGRSLRLSCAASGFTFSSYTMHWVRKAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3280 - protein, 118 aa, Artificial Sequence; identical to SEQ ID NO: 31
  Description of Artificial Sequence: Synthetic polypeptide
  VH of XENP019246

SEQ ID NO: 3281 - protein, 5 aa, Artificial Sequence
  Description of Artificial Sequence: Synthetic peptide
  XENP019246 vhCDR1
SYTMH

SEQ ID NO: 3282 - protein, 17 aa, Artificial Sequence
  Description of Artificial Sequence: Synthetic peptide
  XENP019246 vhCDR2
FISYDGNNKYYADSVKG

SEQ ID NO: 3283 - protein, 9 aa, Artificial Sequence
  Description of Artificial Sequence: Synthetic peptide
  XENP019246 vhCDR3
TGWLGPFDY

SEQ ID NO: 3284 - protein, 215 aa, Artificial Sequence; identical to SEQ ID NO: 2924
  Description of Artificial Sequence: Synthetic polypeptide
  XENP019246 [CTLA-4]_H0.36_L0_Fab Light Chain

SEQ ID NO: 3285 - protein, 108 aa, Artificial Sequence; identical to SEQ ID NO: 23
  Description of Artificial Sequence: Synthetic polypeptide
  VL of XENP019246

SEQ ID NO: 3286 - protein, 12 aa, Artificial Sequence
  Description of Artificial Sequence: Synthetic peptide
  XENP019246 vlCDR1
RASQSVGSSYLA

SEQ ID NO: 3287 - protein, 7 aa, Artificial Sequence
  Description of Artificial Sequence: Synthetic peptide
  XENP019246 vlCDR2
GAFSRAT

SEQ ID NO: 3288 - protein, 9 aa, Artificial Sequence
  Description of Artificial Sequence: Synthetic peptide
  XENP019246 vlCDR3
QQYGSSPWT

SEQ ID NO: 3289 - protein, 221 aa, Artificial Sequence
  Description of Artificial Sequence: Synthetic polypeptide
  XENP019247 [CTLA-4]_H0.37_L0_Fab Heavy Chain
QVQLVESGGGVVQPGRSLRLSCAASGFTFSSYTMHWVRQAPGKRLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3290 - protein, 118 aa, Artificial Sequence; identical to SEQ ID NO: 49
  Description of Artificial Sequence: Synthetic polypeptide
  VH of XENP019247

SEQ ID NO: 3291 - protein, 5 aa, Artificial Sequence
  Description of Artificial Sequence: Synthetic peptide
  XENP019247 vhCDR1
SYTMH

SEQ ID NO: 3292 - protein, 17 aa, Artificial Sequence
  Description of Artificial Sequence: Synthetic peptide
  XENP019247 vhCDR2
FISYDGNNKYYADSVKG

SEQ ID NO: 3293 - protein, 9 aa, Artificial Sequence
  Description of Artificial Sequence: Synthetic peptide
  XENP019247 vhCDR3
TGWLGPFDY

SEQ ID NO: 3294 - protein, 215 aa, Artificial Sequence; identical to SEQ ID NO: 2924
  Description of Artificial Sequence: Synthetic polypeptide
  XENP019247 [CTLA-4]_H0.37_L0_Fab Light Chain

SEQ ID NO: 3295 - protein, 108 aa, Artificial Sequence; identical to SEQ ID NO: 23
  Description of Artificial Sequence: Synthetic polypeptide
  VL of XENP019247

SEQ ID NO: 3296 - protein, 12 aa, Artificial Sequence
  Description of Artificial Sequence: Synthetic peptide
  XENP019247 vlCDR1
RASQSVGSSYLA

SEQ ID NO: 3297 - protein, 7 aa, Artificial Sequence
  Description of Artificial Sequence: Synthetic peptide
  XENP019247 vlCDR2
GAFSRAT

SEQ ID NO: 3298 - protein, 9 aa, Artificial Sequence
  Description of Artificial Sequence: Synthetic peptide
  XENP019247 vlCDR3
QQYGSSPWT

SEQ ID NO: 3299 - protein, 221 aa, Artificial Sequence
  Description of Artificial Sequence: Synthetic polypeptide
  XENP019248 [CTLA-4]_H0.38_L0_Fab Heavy Chain
QVQLVESGGGVVQPGRSLRLSCAASGFTFSSYTMHWVRQAPGKGLEWVAFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3300 - protein, 118 aa, Artificial Sequence; identical to SEQ ID NO: 526
  Description of Artificial Sequence: Synthetic polypeptide
  VH of XENP019248

SEQ ID NO: 3301 - protein, 5 aa, Artificial Sequence
  Description of Artificial Sequence: Synthetic peptide
  XENP019248 vhCDR1
SYTMH

SEQ ID NO: 3302 - protein, 17 aa, Artificial Sequence
  Description of Artificial Sequence: Synthetic peptide
  XENP019248 vhCDR2
FISYDGNNKYYADSVKG

SEQ ID NO: 3303 - protein, 9 aa, Artificial Sequence
  Description of Artificial Sequence: Synthetic peptide
  XENP019248 vhCDR3
TGWLGPFDY

SEQ ID NO: 3304 - protein, 215 aa, Artificial Sequence; identical to SEQ ID NO: 2924
  Description of Artificial Sequence: Synthetic polypeptide
  XENP019248 [CTLA-4]_H0.38_L0_Fab Light Chain

SEQ ID NO: 3305 - protein, 108 aa, Artificial Sequence; identical to SEQ ID NO: 23
  Description of Artificial Sequence: Synthetic polypeptide
  VL of XENP019248

SEQ ID NO: 3306 - protein, 12 aa, Artificial Sequence
  Description of Artificial Sequence: Synthetic peptide
  XENP019248 vlCDR1
RASQSVGSSYLA

SEQ ID NO: 3307 - protein, 7 aa, Artificial Sequence
  Description of Artificial Sequence: Synthetic peptide
  XENP019248 vlCDR2
GAFSRAT

SEQ ID NO: 3308 - protein, 9 aa, Artificial Sequence
  Description of Artificial Sequence: Synthetic peptide
  XENP019248 vlCDR3
QQYGSSPWT

SEQ ID NO: 3309 - protein, 221 aa, Artificial Sequence
  Description of Artificial Sequence: Synthetic polypeptide
  XENP019249 [CTLA-4]_H0.39_L0_Fab Heavy Chain
QVQLVESGGGVVQPGRSLRLSCAASGFTFSSYTMHWVRQAPGKGLEWVGFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3310 - protein, 118 aa, Artificial Sequence; identical to SEQ ID NO: 535
  Description of Artificial Sequence: Synthetic polypeptide
  VH of XENP019249

SEQ ID NO: 3311 - protein, 5 aa, Artificial Sequence
  Description of Artificial Sequence: Synthetic peptide
  XENP019249 vhCDR1
SYTMH

SEQ ID NO: 3312 - protein, 17 aa, Artificial Sequence
  Description of Artificial Sequence: Synthetic peptide
  XENP019249 vhCDR2
FISYDGNNKYYADSVKG

SEQ ID NO: 3313 - protein, 9 aa, Artificial Sequence
  Description of Artificial Sequence: Synthetic peptide
  XENP019249 vhCDR3
TGWLGPFDY

SEQ ID NO: 3314 - protein, 215 aa, Artificial Sequence; identical to SEQ ID NO: 2924
  Description of Artificial Sequence: Synthetic polypeptide
  XENP019249 [CTLA-4]_H0.39_L0_Fab Light Chain

SEQ ID NO: 3315 - protein, 108 aa, Artificial Sequence; identical to SEQ ID NO: 23
  Description of Artificial Sequence: Synthetic polypeptide
  VL of XENP019249

SEQ ID NO: 3316 - protein, 12 aa, Artificial Sequence
  Description of Artificial Sequence: Synthetic peptide
  XENP019249 vlCDR1
RASQSVGSSYLA

SEQ ID NO: 3317 - protein, 7 aa, Artificial Sequence
  Description of Artificial Sequence: Synthetic peptide
  XENP019249 vlCDR2
GAFSRAT

SEQ ID NO: 3318 - protein, 9 aa, Artificial Sequence
  Description of Artificial Sequence: Synthetic peptide
  XENP019249 vlCDR3
QQYGSSPWT

SEQ ID NO: 3319 - protein, 221 aa, Artificial Sequence
  Description of Artificial Sequence: Synthetic polypeptide
  XENP019250 [CTLA-4]_H0.40_L0_Fab Heavy Chain
QVQLVESGGGVVQPGRSLRLSCAASGFTFSSYTMHWVRQAPGKGLEWVSFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3320 - protein, 118 aa, Artificial Sequence; identical to SEQ ID NO: 544
  Description of Artificial Sequence: Synthetic polypeptide
  VH of XENP019250

SEQ ID NO: 3321 - protein, 5 aa, Artificial Sequence
  Description of Artificial Sequence: Synthetic peptide
  XENP019250 vhCDR1
SYTMH

SEQ ID NO: 3322 - protein, 17 aa, Artificial Sequence
  Description of Artificial Sequence: Synthetic peptide
  XENP019250 vhCDR2
FISYDGNNKYYADSVKG

SEQ ID NO: 3323 - protein, 9 aa, Artificial Sequence
  Description of Artificial Sequence: Synthetic peptide
  XENP019250 vhCDR3
TGWLGPFDY

SEQ ID NO: 3324 - protein, 215 aa, Artificial Sequence; identical to SEQ ID NO: 2924
  Description of Artificial Sequence: Synthetic polypeptide
  XENP019250 [CTLA-4]_H0.40_L0_Fab Light Chain

SEQ ID NO: 3325 - protein, 108 aa, Artificial Sequence; identical to SEQ ID NO: 23
  Description of Artificial Sequence: Synthetic polypeptide
  VL of XENP019250

SEQ ID NO: 3326 - protein, 12 aa, Artificial Sequence
  Description of Artificial Sequence: Synthetic peptide
  XENP019250 vlCDR1
RASQSVGSSYLA

SEQ ID NO: 3327 - protein, 7 aa, Artificial Sequence
  Description of Artificial Sequence: Synthetic peptide
  XENP019250 vlCDR2
GAFSRAT

SEQ ID NO: 3328 - protein, 9 aa, Artificial Sequence
  Description of Artificial Sequence: Synthetic peptide
  XENP019250 vlCDR3
QQYGSSPWT

SEQ ID NO: 3329 - protein, 221 aa, Artificial Sequence
  Description of Artificial Sequence: Synthetic polypeptide
  XENP019251 [CTLA-4]_H0.41_L0_Fab Heavy Chain
QVQLVESGGGVVQPGRSLRLSCAASGFTFSSYTMHWVRQAPGKGLEWVVFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3330 - protein, 118 aa, Artificial Sequence; identical to SEQ ID NO: 553
  Description of Artificial Sequence: Synthetic polypeptide
  VH of XENP019251

SEQ ID NO: 3331 - protein, 5 aa, Artificial Sequence
  Description of Artificial Sequence: Synthetic peptide
  XENP019251 vhCDR1
SYTMH

SEQ ID NO: 3332 - protein, 17 aa, Artificial Sequence
  Description of Artificial Sequence: Synthetic peptide
  XENP019251 vhCDR2
FISYDGNNKYYADSVKG

SEQ ID NO: 3333 - protein, 9 aa, Artificial Sequence
  Description of Artificial Sequence: Synthetic peptide
  XENP019251 vhCDR3
TGWLGPFDY

SEQ ID NO: 3334 - protein, 215 aa, Artificial Sequence; identical to SEQ ID NO: 2924
  Description of Artificial Sequence: Synthetic polypeptide
  XENP019251 [CTLA-4]_H0.41_L0_Fab Light Chain

SEQ ID NO: 3335 - protein, 108 aa, Artificial Sequence; identical to SEQ ID NO: 23
  Description of Artificial Sequence: Synthetic polypeptide
  VL of XENP019251

SEQ ID NO: 3336 - protein, 12 aa, Artificial Sequence
  Description of Artificial Sequence: Synthetic peptide
  XENP019251 vlCDR1
RASQSVGSSYLA

SEQ ID NO: 3337 - protein, 7 aa, Artificial Sequence
  Description of Artificial Sequence: Synthetic peptide
  XENP019251 vlCDR2
GAFSRAT

SEQ ID NO: 3338 - protein, 9 aa, Artificial Sequence
  Description of Artificial Sequence: Synthetic peptide
  XENP019251 vlCDR3
QQYGSSPWT

SEQ ID NO: 3339 - protein, 221 aa, Artificial Sequence
  Description of Artificial Sequence: Synthetic polypeptide
  XENP019252 [CTLA-4]_H0.42_L0_Fab Heavy Chain
QVQLVESGGGVVQPGRSLRLSCAASGFTFSSYTMHWVRQAPGKGLEWVTAISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3340 - protein, 118 aa, Artificial Sequence; identical to SEQ ID NO: 562
  Description of Artificial Sequence: Synthetic polypeptide
  VH of XENP019252

SEQ ID NO: 3341 - protein, 5 aa, Artificial Sequence
  Description of Artificial Sequence: Synthetic peptide
  XENP019252 vhCDR1
SYTMH

SEQ ID NO: 3342 - protein, 17 aa, Artificial Sequence
  Description of Artificial Sequence: Synthetic peptide
  XENP019252 vhCDR2
AISYDGNNKYYADSVKG

SEQ ID NO: 3343 - protein, 9 aa, Artificial Sequence
  Description of Artificial Sequence: Synthetic peptide
  XENP019252 vhCDR3
TGWLGPFDY

SEQ ID NO: 3344 - protein, 215 aa, Artificial Sequence; identical to SEQ ID NO: 2924
  Description of Artificial Sequence: Synthetic polypeptide
  XENP019252 [CTLA-4]_H0.42_L0_Fab Light Chain

SEQ ID NO: 3345 - protein, 108 aa, Artificial Sequence; identical to SEQ ID NO: 23
  Description of Artificial Sequence: Synthetic polypeptide
  VL of XENP019252

SEQ ID NO: 3346 - protein, 12 aa, Artificial Sequence
  Description of Artificial Sequence: Synthetic peptide
  XENP019252 vlCDR1
RASQSVGSSYLA

SEQ ID NO: 3347 - protein, 7 aa, Artificial Sequence
  Description of Artificial Sequence: Synthetic peptide
  XENP019252 vlCDR2
GAFSRAT

SEQ ID NO: 3348 - protein, 9 aa, Artificial Sequence
  Description of Artificial Sequence: Synthetic peptide
  XENP019252 vlCDR3
QQYGSSPWT

SEQ ID NO: 3349 - protein, 221 aa, Artificial Sequence
  Description of Artificial Sequence: Synthetic polypeptide
  XENP019253 [CTLA-4]_H0.43_L0_Fab Heavy Chain
QVQLVESGGGVVQPGRSLRLSCAASGFTFSSYTMHWVRQAPGKGLEWVTGISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3350 - protein, 118 aa, Artificial Sequence; identical to SEQ ID NO: 571
  Description of Artificial Sequence: Synthetic polypeptide
  VH of XENP019253

SEQ ID NO: 3351 - protein, 5 aa, Artificial Sequence
  Description of Artificial Sequence: Synthetic peptide
  XENP019253 vhCDR1
SYTMH

SEQ ID NO: 3352 - protein, 17 aa, Artificial Sequence
  Description of Artificial Sequence: Synthetic peptide
  XENP019253 vhCDR2
GISYDGNNKYYADSVKG

SEQ ID NO: 3353 - protein, 9 aa, Artificial Sequence
  Description of Artificial Sequence: Synthetic peptide
  XENP019253 vhCDR3
TGWLGPFDY

SEQ ID NO: 3354 - protein, 215 aa, Artificial Sequence; identical to SEQ ID NO: 2924
  Description of Artificial Sequence: Synthetic polypeptide
  XENP019253 [CTLA-4]_H0.43_L0_Fab Light Chain

SEQ ID NO: 3355 - protein, 108 aa, Artificial Sequence; identical to SEQ ID NO: 23
  Description of Artificial Sequence: Synthetic polypeptide
  VL of XENP019253

SEQ ID NO: 3356 - protein, 12 aa, Artificial Sequence
  Description of Artificial Sequence: Synthetic peptide
  XENP019253 vlCDR1
RASQSVGSSYLA

SEQ ID NO: 3357 - protein, 7 aa, Artificial Sequence
  Description of Artificial Sequence: Synthetic peptide
  XENP019253 vlCDR2
GAFSRAT

SEQ ID NO: 3358 - protein, 9 aa, Artificial Sequence
  Description of Artificial Sequence: Synthetic peptide
  XENP019253 vlCDR3
QQYGSSPWT

SEQ ID NO: 3359 - protein, 221 aa, Artificial Sequence
  Description of Artificial Sequence: Synthetic polypeptide
  XENP019254 [CTLA-4]_H0.44_L0_Fab Heavy Chain
QVQLVESGGGVVQPGRSLRLSCAASGFTFSSYTMHWVRQAPGKGLEWVTLISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3360 - protein, 118 aa, Artificial Sequence; identical to SEQ ID NO: 580
  Description of Artificial Sequence: Synthetic polypeptide
  VH of XENP019254

SEQ ID NO: 3361 - protein, 5 aa, Artificial Sequence
  Description of Artificial Sequence: Synthetic peptide
  XENP019254 vhCDR1
SYTMH

SEQ ID NO: 3362 - protein, 17 aa, Artificial Sequence
  Description of Artificial Sequence: Synthetic peptide
  XENP019254 vhCDR2
LISYDGNNKYYADSVKG

SEQ ID NO: 3363 - protein, 9 aa, Artificial Sequence
  Description of Artificial Sequence: Synthetic peptide
  XENP019254 vhCDR3
TGWLGPFDY

SEQ ID NO: 3364 - protein, 215 aa, Artificial Sequence; identical to SEQ ID NO: 2924
  Description of Artificial Sequence: Synthetic polypeptide
  XENP019254 [CTLA-4]_H0.44_L0_Fab Light Chain

SEQ ID NO: 3365 - protein, 108 aa, Artificial Sequence; identical to SEQ ID NO: 23
  Description of Artificial Sequence: Synthetic polypeptide
  VL of XENP019254

SEQ ID NO: 3366 - protein, 12 aa, Artificial Sequence
  Description of Artificial Sequence: Synthetic peptide
  XENP019254 vlCDR1
RASQSVGSSYLA

SEQ ID NO: 3367 - protein, 7 aa, Artificial Sequence
  Description of Artificial Sequence: Synthetic peptide
  XENP019254 vlCDR2
GAFSRAT

SEQ ID NO: 3368 - protein, 9 aa, Artificial Sequence
  Description of Artificial Sequence: Synthetic peptide
  XENP019254 vlCDR3
QQYGSSPWT

SEQ ID NO: 3369 - protein, 221 aa, Artificial Sequence
  Description of Artificial Sequence: Synthetic polypeptide
  XENP019255 [CTLA-4]_H0.45_L0_Fab Heavy Chain
QVQLVESGGGVVQPGRSLRLSCAASGFTFSSYTMHWVRQAPGKGLEWVTIISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3370 - protein, 118 aa, Artificial Sequence; identical to SEQ ID NO: 589
  Description of Artificial Sequence: Synthetic polypeptide
  VH of XENP019255

SEQ ID NO: 3371 - protein, 5 aa, Artificial Sequence
  Description of Artificial Sequence: Synthetic peptide
  XENP019255 vhCDR1
SYTMH

SEQ ID NO: 3372 - protein, 17 aa, Artificial Sequence
  Description of Artificial Sequence: Synthetic peptide
  XENP019255 vhCDR2
IISYDGNNKYYADSVKG

SEQ ID NO: 3373 - protein, 9 aa, Artificial Sequence
  Description of Artificial Sequence: Synthetic peptide
  XENP019255 vhCDR3
TGWLGPFDY

SEQ ID NO: 3374 - protein, 215 aa, Artificial Sequence; identical to SEQ ID NO: 2924
  Description of Artificial Sequence: Synthetic polypeptide
  XENP019255 [CTLA-4]_H0.45_L0_Fab Light Chain

SEQ ID NO: 3375 - protein, 108 aa, Artificial Sequence; identical to SEQ ID NO: 23
  Description of Artificial Sequence: Synthetic polypeptide
  VL of XENP019255

SEQ ID NO: 3376 - protein, 12 aa, Artificial Sequence
  Description of Artificial Sequence: Synthetic peptide
  XENP019255 vlCDR1
RASQSVGSSYLA

SEQ ID NO: 3377 - protein, 7 aa, Artificial Sequence
  Description of Artificial Sequence: Synthetic peptide
  XENP019255 vlCDR2
GAFSRAT

SEQ ID NO: 3378 - protein, 9 aa, Artificial Sequence
  Description of Artificial Sequence: Synthetic peptide
  XENP019255 vlCDR3
QQYGSSPWT

SEQ ID NO: 3379 - protein, 221 aa, Artificial Sequence
  Description of Artificial Sequence: Synthetic polypeptide
  XENP019256 [CTLA-4]_H0.46_L0_Fab Heavy Chain
QVQLVESGGGVVQPGRSLRLSCAASGFTFSSYTMHWVRQAPGKGLEWVTRISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3380 - protein, 118 aa, Artificial Sequence; identical to SEQ ID NO: 598
  Description of Artificial Sequence: Synthetic polypeptide
  VH of XENP019256

SEQ ID NO: 3381 - protein, 5 aa, Artificial Sequence
  Description of Artificial Sequence: Synthetic peptide
  XENP019256 vhCDR1
SYTMH

SEQ ID NO: 3382 - protein, 17 aa, Artificial Sequence
  Description of Artificial Sequence: Synthetic peptide
  XENP019256 vhCDR2
RISYDGNNKYYADSVKG

SEQ ID NO: 3383 - protein, 9 aa, Artificial Sequence
  Description of Artificial Sequence: Synthetic peptide
  XENP019256 vhCDR3
TGWLGPFDY

SEQ ID NO: 3384 - protein, 215 aa, Artificial Sequence; identical to SEQ ID NO: 2924
  Description of Artificial Sequence: Synthetic polypeptide
  XENP019256 [CTLA-4]_H0.46_L0_Fab Light Chain

SEQ ID NO: 3385 - protein, 108 aa, Artificial Sequence; identical to SEQ ID NO: 23
  Description of Artificial Sequence: Synthetic polypeptide
  VL of XENP019256

SEQ ID NO: 3386 - protein, 12 aa, Artificial Sequence
  Description of Artificial Sequence: Synthetic peptide
  XENP019256 vlCDR1
RASQSVGSSYLA

SEQ ID NO: 3387 - protein, 7 aa, Artificial Sequence
  Description of Artificial Sequence: Synthetic peptide
  XENP019256 vlCDR2
GAFSRAT

SEQ ID NO: 3388 - protein, 9 aa, Artificial Sequence
  Description of Artificial Sequence: Synthetic peptide
  XENP019256 vlCDR3
QQYGSSPWT

SEQ ID NO: 3389 - protein, 221 aa, Artificial Sequence
  Description of Artificial Sequence: Synthetic polypeptide
  XENP019257 [CTLA-4]_H0.47_L0_Fab Heavy Chain
QVQLVESGGGVVQPGRSLRLSCAASGFTFSSYTMHWVRQAPGKGLEWVTVISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3390 - protein, 118 aa, Artificial Sequence; identical to SEQ ID NO: 607
  Description of Artificial Sequence: Synthetic polypeptide
  VH of XENP019257

SEQ ID NO: 3391 - protein, 5 aa, Artificial Sequence
  Description of Artificial Sequence: Synthetic peptide
  XENP019257 vhCDR1
SYTMH

SEQ ID NO: 3392 - protein, 17 aa, Artificial Sequence
  Description of Artificial Sequence: Synthetic peptide
  XENP019257 vhCDR2
VISYDGNNKYYADSVKG

SEQ ID NO: 3393 - protein, 9 aa, Artificial Sequence
  Description of Artificial Sequence: Synthetic peptide
  XENP019257 vhCDR3
TGWLGPFDY

SEQ ID NO: 3394 - protein, 215 aa, Artificial Sequence; identical to SEQ ID NO: 2924
  Description of Artificial Sequence: Synthetic polypeptide
  XENP019257 [CTLA-4]_H0.47_L0_Fab Light Chain

SEQ ID NO: 3395 - protein, 108 aa, Artificial Sequence; identical to SEQ ID NO: 23
  Description of Artificial Sequence: Synthetic polypeptide
  VL of XENP019257

SEQ ID NO: 3396 - protein, 12 aa, Artificial Sequence
  Description of Artificial Sequence: Synthetic peptide
  XENP019257 vlCDR1
RASQSVGSSYLA

SEQ ID NO: 3397 - protein, 7 aa, Artificial Sequence
  Description of Artificial Sequence: Synthetic peptide
  XENP019257 vlCDR2
GAFSRAT

SEQ ID NO: 3398 - protein, 9 aa, Artificial Sequence
  Description of Artificial Sequence: Synthetic peptide
  XENP019257 vlCDR3
QQYGSSPWT

SEQ ID NO: 3399 - protein, 221 aa, Artificial Sequence
  Description of Artificial Sequence: Synthetic polypeptide
  XENP019258 [CTLA-4]_H0.48_L0_Fab Heavy Chain
QVQLVESGGGVVQPGRSLRLSCAASGFTFSSYTMHWVRQAPGKGLEWVTYISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3400 - protein, 118 aa, Artificial Sequence; identical to SEQ ID NO: 616
  Description of Artificial Sequence: Synthetic polypeptide
  VH of XENP019258

SEQ ID NO: 3401 - protein, 5 aa, Artificial Sequence
  Description of Artificial Sequence: Synthetic peptide
  XENP019258 vhCDR1
SYTMH

SEQ ID NO: 3402 - protein, 17 aa, Artificial Sequence
  Description of Artificial Sequence: Synthetic peptide
  XENP019258 vhCDR2
YISYDGNNKYYADSVKG

SEQ ID NO: 3403 - protein, 9 aa, Artificial Sequence
  Description of Artificial Sequence: Synthetic peptide
  XENP019258 vhCDR3
TGWLGPFDY

SEQ ID NO: 3404 - protein, 215 aa, Artificial Sequence; identical to SEQ ID NO: 2924
  Description of Artificial Sequence: Synthetic polypeptide
  XENP019258 [CTLA-4]_H0.48_L0_Fab Light Chain

SEQ ID NO: 3405 - protein, 108 aa, Artificial Sequence; identical to SEQ ID NO: 23
  Description of Artificial Sequence: Synthetic polypeptide
  VL of XENP019258

SEQ ID NO: 3406 - protein, 12 aa, Artificial Sequence
  Description of Artificial Sequence: Synthetic peptide
  XENP019258 vlCDR1
RASQSVGSSYLA

SEQ ID NO: 3407 - protein, 7 aa, Artificial Sequence
  Description of Artificial Sequence: Synthetic peptide
  XENP019258 vlCDR2
GAFSRAT

SEQ ID NO: 3408 - protein, 9 aa, Artificial Sequence
  Description of Artificial Sequence: Synthetic peptide
  XENP019258 vlCDR3
QQYGSSPWT

SEQ ID NO: 3409 - protein, 221 aa, Artificial Sequence
  Description of Artificial Sequence: Synthetic polypeptide
  XENP019259 [CTLA-4]_H0.49_L0_Fab Heavy Chain
QVQLVESGGGVVQPGRSLRLSCAASGFTFSSYTMHWVRQAPGKGLEWVTFESYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3410 - protein, 118 aa, Artificial Sequence; identical to SEQ ID NO: 625
  Description of Artificial Sequence: Synthetic polypeptide
  VH of XENP019259

SEQ ID NO: 3411 - protein, 5 aa, Artificial Sequence
  Description of Artificial Sequence: Synthetic peptide
  XENP019259 vhCDR1
SYTMH

SEQ ID NO: 3412 - protein, 17 aa, Artificial Sequence
  Description of Artificial Sequence: Synthetic peptide
  XENP019259 vhCDR2
FESYDGNNKYYADSVKG

SEQ ID NO: 3413 - protein, 9 aa, Artificial Sequence
  Description of Artificial Sequence: Synthetic peptide
  XENP019259 vhCDR3
TGWLGPFDY

SEQ ID NO: 3414 - protein, 215 aa, Artificial Sequence; identical to SEQ ID NO: 2924
  Description of Artificial Sequence: Synthetic polypeptide
  XENP019259 [CTLA-4]_H0.49_L0_Fab Light Chain

SEQ ID NO: 3415 - protein, 108 aa, Artificial Sequence; identical to SEQ ID NO: 23
  Description of Artificial Sequence: Synthetic polypeptide
  VL of XENP019259

SEQ ID NO: 3416 - protein, 12 aa, Artificial Sequence
  Description of Artificial Sequence: Synthetic peptide
  XENP019259 vlCDR1
RASQSVGSSYLA

SEQ ID NO: 3417 - protein, 7 aa, Artificial Sequence
  Description of Artificial Sequence: Synthetic peptide
  XENP019259 vlCDR2
GAFSRAT

SEQ ID NO: 3418 - protein, 9 aa, Artificial Sequence
  Description of Artificial Sequence: Synthetic peptide
  XENP019259 vlCDR3
QQYGSSPWT

SEQ ID NO: 3419 - protein, 221 aa, Artificial Sequence
  Description of Artificial Sequence: Synthetic polypeptide
  XENP019260 [CTLA-4]_H0.50_L0_Fab Heavy Chain
QVQLVESGGGVVQPGRSLRLSCAASGFTFSSYTMHWVRQAPGKGLEWVTFHSYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3420 - protein, 118 aa, Artificial Sequence; identical to SEQ ID NO: 634
  Description of Artificial Sequence: Synthetic polypeptide
  VH of XENP019260

SEQ ID NO: 3421 - protein, 5 aa, Artificial Sequence
  Description of Artificial Sequence: Synthetic peptide
  XENP019260 vhCDR1
SYTMH

SEQ ID NO: 3422 - protein, 17 aa, Artificial Sequence
  Description of Artificial Sequence: Synthetic peptide
  XENP019260 vhCDR2
FHSYDGNNKYYADSVKG

SEQ ID NO: 3423 - protein, 9 aa, Artificial Sequence
  Description of Artificial Sequence: Synthetic peptide
  XENP019260 vhCDR3
TGWLGPFDY

SEQ ID NO: 3424 - protein, 215 aa, Artificial Sequence; identical to SEQ ID NO: 2924
  Description of Artificial Sequence: Synthetic polypeptide
  XENP019260 [CTLA-4]_H0.50_L0_Fab Light Chain

SEQ ID NO: 3425 - protein, 108 aa, Artificial Sequence; identical to SEQ ID NO: 23
  Description of Artificial Sequence: Synthetic polypeptide
  VL of XENP019260

SEQ ID NO: 3426 - protein, 12 aa, Artificial Sequence
  Description of Artificial Sequence: Synthetic peptide
  XENP019260 vlCDR1
RASQSVGSSYLA

SEQ ID NO: 3427 - protein, 7 aa, Artificial Sequence
  Description of Artificial Sequence: Synthetic peptide
  XENP019260 vlCDR2
GAFSRAT

SEQ ID NO: 3428 - protein, 9 aa, Artificial Sequence
  Description of Artificial Sequence: Synthetic peptide
  XENP019260 vlCDR3
QQYGSSPWT

SEQ ID NO: 3429 - protein, 221 aa, Artificial Sequence
  Description of Artificial Sequence: Synthetic polypeptide
  XENP019261 [CTLA-4]_H0.51_L0_Fab Heavy Chain
QVQLVESGGGVVQPGRSLRLSCAASGFTFSSYTMHWVRQAPGKGLEWVTFTSYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3430 - protein, 118 aa, Artificial Sequence; identical to SEQ ID NO: 643
  Description of Artificial Sequence: Synthetic polypeptide
  VH of XENP019261

SEQ ID NO: 3431 - protein, 5 aa, Artificial Sequence
  Description of Artificial Sequence: Synthetic peptide
  XENP019261 vhCDR1
SYTMH

SEQ ID NO: 3432 - protein, 17 aa, Artificial Sequence
  Description of Artificial Sequence: Synthetic peptide
  XENP019261 vhCDR2
FTSYDGNNKYYADSVKG

SEQ ID NO: 3433 - protein, 9 aa, Artificial Sequence
  Description of Artificial Sequence: Synthetic peptide
  XENP019261 vhCDR3
TGWLGPFDY

SEQ ID NO: 3434 - protein, 215 aa, Artificial Sequence; identical to SEQ ID NO: 2924
  Description of Artificial Sequence: Synthetic polypeptide
  XENP019261 [CTLA-4]_H0.51_L0_Fab Light Chain

SEQ ID NO: 3435 - protein, 108 aa, Artificial Sequence; identical to SEQ ID NO: 23
  Description of Artificial Sequence: Synthetic polypeptide
  VL of XENP019261

SEQ ID NO: 3436 - protein, 12 aa, Artificial Sequence
  Description of Artificial Sequence: Synthetic peptide
  XENP019261 vlCDR1
RASQSVGSSYLA

SEQ ID NO: 3437 - protein, 7 aa, Artificial Sequence
  Description of Artificial Sequence: Synthetic peptide
  XENP019261 vlCDR2
GAFSRAT

SEQ ID NO: 3438 - protein, 9 aa, Artificial Sequence
  Description of Artificial Sequence: Synthetic peptide
  XENP019261 vlCDR3
QQYGSSPWT

SEQ ID NO: 3439 - protein, 221 aa, Artificial Sequence
  Description of Artificial Sequence: Synthetic polypeptide
  XENP019262 [CTLA-4]_H0.52_L0_Fab Heavy Chain
QVQLVESGGGVVQPGRSLRLSCAASGFTFSSYTMHWVRQAPGKGLEWVTFVSYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3440 - protein, 118 aa, Artificial Sequence; identical to SEQ ID NO: 652
  Description of Artificial Sequence: Synthetic polypeptide
  VH of XENP019262

SEQ ID NO: 3441 - protein, 5 aa, Artificial Sequence
  Description of Artificial Sequence: Synthetic peptide
  XENP019262 vhCDR1
SYTMH

SEQ ID NO: 3442 - protein, 17 aa, Artificial Sequence
  Description of Artificial Sequence: Synthetic peptide
  XENP019262 vhCDR2
FVSYDGNNKYYADSVKG

SEQ ID NO: 3443 - protein, 9 aa, Artificial Sequence
  Description of Artificial Sequence: Synthetic peptide
  XENP019262 vhCDR3
TGWLGPFDY

SEQ ID NO: 3444 - protein, 215 aa, Artificial Sequence; identical to SEQ ID NO: 2924
  Description of Artificial Sequence: Synthetic polypeptide
  XENP019262 [CTLA-4]_H0.52_L0_Fab Light Chain

SEQ ID NO: 3445 - protein, 108 aa, Artificial Sequence; identical to SEQ ID NO: 23
  Description of Artificial Sequence: Synthetic polypeptide
  VL of XENP019262

SEQ ID NO: 3446 - protein, 12 aa, Artificial Sequence
  Description of Artificial Sequence: Synthetic peptide
  XENP019262 vlCDR1
RASQSVGSSYLA

SEQ ID NO: 3447 - protein, 7 aa, Artificial Sequence
  Description of Artificial Sequence: Synthetic peptide
  XENP019262 vlCDR2
GAFSRAT

SEQ ID NO: 3448 - protein, 9 aa, Artificial Sequence
  Description of Artificial Sequence: Synthetic peptide
  XENP019262 vlCDR3
QQYGSSPWT

SEQ ID NO: 3449 - protein, 221 aa, Artificial Sequence
  Description of Artificial Sequence: Synthetic polypeptide
  XENP019263 [CTLA-4]_H0.53_L0_Fab Heavy Chain
QVQLVESGGGVVQPGRSLRLSCAASGFTFSSYTMHWVRQAPGKGLEWVTFYSYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3450 - protein, 118 aa, Artificial Sequence; identical to SEQ ID NO: 661
  Description of Artificial Sequence: Synthetic polypeptide
  VH of XENP019263

SEQ ID NO: 3451 - protein, 5 aa, Artificial Sequence
  Description of Artificial Sequence: Synthetic peptide
  XENP019263 vhCDR1
SYTMH

SEQ ID NO: 3452 - protein, 17 aa, Artificial Sequence
  Description of Artificial Sequence: Synthetic peptide
  XENP019263 vhCDR2
FYSYDGNNKYYADSVKG

SEQ ID NO: 3453 - protein, 9 aa, Artificial Sequence
  Description of Artificial Sequence: Synthetic peptide
  XENP019263 vhCDR3
TGWLGPFDY

SEQ ID NO: 3454 - protein, 215 aa, Artificial Sequence; identical to SEQ ID NO: 2924
  Description of Artificial Sequence: Synthetic polypeptide
  XENP019263 [CTLA-4]_H0.53_L0_Fab Light Chain

SEQ ID NO: 3455 - protein, 108 aa, Artificial Sequence; identical to SEQ ID NO: 23
  Description of Artificial Sequence: Synthetic polypeptide
  VL of XENP019263

SEQ ID NO: 3456 - protein, 12 aa, Artificial Sequence
  Description of Artificial Sequence: Synthetic peptide
  XENP019263 vlCDR1
RASQSVGSSYLA

SEQ ID NO: 3457 - protein, 7 aa, Artificial Sequence
  Description of Artificial Sequence: Synthetic peptide
  XENP019263 vlCDR2
GAFSRAT

SEQ ID NO: 3458 - protein, 9 aa, Artificial Sequence
  Description of Artificial Sequence: Synthetic peptide
  XENP019263 vlCDR3
QQYGSSPWT

SEQ ID NO: 3459 - protein, 221 aa, Artificial Sequence
  Description of Artificial Sequence: Synthetic polypeptide
  XENP019264 [CTLA-4]_H0.54_L0_Fab Heavy Chain
QVQLVESGGGVVQPGRSLRLSCAASGFTFSSYTMHWVRQAPGKGLEWVTFISGDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3460 - protein, 118 aa, Artificial Sequence; identical to SEQ ID NO: 670
  Description of Artificial Sequence: Synthetic polypeptide
  VH of XENP019264

SEQ ID NO: 3461 - protein, 5 aa, Artificial Sequence
  Description of Artificial Sequence: Synthetic peptide
  XENP019264 vhCDR1
SYTMH

SEQ ID NO: 3462 - protein, 17 aa, Artificial Sequence
  Description of Artificial Sequence: Synthetic peptide
  XENP019264 vhCDR2
FISGDGNNKYYADSVKG

SEQ ID NO: 3463 - protein, 9 aa, Artificial Sequence
  Description of Artificial Sequence: Synthetic peptide
  XENP019264 vhCDR3
TGWLGPFDY

SEQ ID NO: 3464 - protein, 215 aa, Artificial Sequence; identical to SEQ ID NO: 2924
  Description of Artificial Sequence: Synthetic polypeptide
  XENP019264 [CTLA-4]_H0.54_L0_Fab Light Chain

SEQ ID NO: 3465 - protein, 108 aa, Artificial Sequence; identical to SEQ ID NO: 23
  Description of Artificial Sequence: Synthetic polypeptide
  VL of XENP019264

SEQ ID NO: 3466 - protein, 12 aa, Artificial Sequence
  Description of Artificial Sequence: Synthetic peptide
  XENP019264 vlCDR1
RASQSVGSSYLA

SEQ ID NO: 3467 - protein, 7 aa, Artificial Sequence
  Description of Artificial Sequence: Synthetic peptide
  XENP019264 vlCDR2
GAFSRAT

SEQ ID NO: 3468 - protein, 9 aa, Artificial Sequence
  Description of Artificial Sequence: Synthetic peptide
  XENP019264 vlCDR3
QQYGSSPWT

SEQ ID NO: 3469 - protein, 221 aa, Artificial Sequence
  Description of Artificial Sequence: Synthetic polypeptide
  XENP019265 [CTLA-4]_H0.55_L0_Fab Heavy Chain
QVQLVESGGGVVQPGRSLRLSCAASGFTFSSYTMHWVRQAPGKGLEWVTFISNDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3470 - protein, 118 aa, Artificial Sequence; identical to SEQ ID NO: 679
  Description of Artificial Sequence: Synthetic polypeptide
  VH of XENP019265

SEQ ID NO: 3471 - protein, 5 aa, Artificial Sequence
  Description of Artificial Sequence: Synthetic peptide
  XENP019265 vhCDR1
SYTMH

SEQ ID NO: 3472 - protein, 17 aa, Artificial Sequence
  Description of Artificial Sequence: Synthetic peptide
  XENP019265 vhCDR2
FISNDGNNKYYADSVKG

SEQ ID NO: 3473 - protein, 9 aa, Artificial Sequence
  Description of Artificial Sequence: Synthetic peptide
  XENP019265 vhCDR3
TGWLGPFDY

SEQ ID NO: 3474 - protein, 215 aa, Artificial Sequence; identical to SEQ ID NO: 2924
  Description of Artificial Sequence: Synthetic polypeptide
  XENP019265 [CTLA-4]_H0.55_L0_Fab Light Chain

SEQ ID NO: 3475 - protein, 108 aa, Artificial Sequence; identical to SEQ ID NO: 23
  Description of Artificial Sequence: Synthetic polypeptide
  VL of XENP019265

SEQ ID NO: 3476 - protein, 12 aa, Artificial Sequence
  Description of Artificial Sequence: Synthetic peptide
  XENP019265 vlCDR1
RASQSVGSSYLA

SEQ ID NO: 3477 - protein, 7 aa, Artificial Sequence
  Description of Artificial Sequence: Synthetic peptide
  XENP019265 vlCDR2
GAFSRAT

SEQ ID NO: 3478 - protein, 9 aa, Artificial Sequence
  Description of Artificial Sequence: Synthetic peptide
  XENP019265 vlCDR3
QQYGSSPWT

SEQ ID NO: 3479 - protein, 221 aa, Artificial Sequence
  Description of Artificial Sequence: Synthetic polypeptide
  XENP019266 [CTLA-4]_H0.56_L0_Fab Heavy Chain
QVQLVESGGGVVQPGRSLRLSCAASGFTFSSYTMHWVRQAPGKGLEWVTFISSDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3480 - protein, 118 aa, Artificial Sequence; identical to SEQ ID NO: 688
  Description of Artificial Sequence: Synthetic polypeptide
  VH of XENP019266

SEQ ID NO: 3481 - protein, 5 aa, Artificial Sequence
  Description of Artificial Sequence: Synthetic peptide
  XENP019266 vhCDR1
SYTMH

SEQ ID NO: 3482 - protein, 17 aa, Artificial Sequence
  Description of Artificial Sequence: Synthetic peptide
  XENP019266 vhCDR2
FISSDGNNKYYADSVKG

SEQ ID NO: 3483 - protein, 9 aa, Artificial Sequence
  Description of Artificial Sequence: Synthetic peptide
  XENP019266 vhCDR3
TGWLGPFDY

SEQ ID NO: 3484 - protein, 215 aa, Artificial Sequence; identical to SEQ ID NO: 2924
  Description of Artificial Sequence: Synthetic polypeptide
  XENP019266 [CTLA-4]_H0.56_L0_Fab Light Chain

SEQ ID NO: 3485 - protein, 108 aa, Artificial Sequence; identical to SEQ ID NO: 23
  Description of Artificial Sequence: Synthetic polypeptide
  VL of XENP019266

SEQ ID NO: 3486 - protein, 12 aa, Artificial Sequence
  Description of Artificial Sequence: Synthetic peptide
  XENP019266 vlCDR1
RASQSVGSSYLA

SEQ ID NO: 3487 - protein, 7 aa, Artificial Sequence
  Description of Artificial Sequence: Synthetic peptide
  XENP019266 vlCDR2
GAFSRAT

SEQ ID NO: 3488 - protein, 9 aa, Artificial Sequence
  Description of Artificial Sequence: Synthetic peptide
  XENP019266 vlCDR3
QQYGSSPWT

SEQ ID NO: 3489 - protein, 221 aa, Artificial Sequence
  Description of Artificial Sequence: Synthetic polypeptide
  XENP019267 [CTLA-4]_H0.57_L0_Fab Heavy Chain
QVQLVESGGGVVQPGRSLRLSCAASGFTFSSYTMHWVRQAPGKGLEWVTFISYNGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3490 - protein, 118 aa, Artificial Sequence; identical to SEQ ID NO: 697
  Description of Artificial Sequence: Synthetic polypeptide
  VH of XENP019267

SEQ ID NO: 3491 - protein, 5 aa, Artificial Sequence
  Description of Artificial Sequence: Synthetic peptide
  XENP019267 vhCDR1
SYTMH

SEQ ID NO: 3492 - protein, 17 aa, Artificial Sequence
  Description of Artificial Sequence: Synthetic peptide
  XENP019267 vhCDR2
FISYNGNNKYYADSVKG

SEQ ID NO: 3493 - protein, 9 aa, Artificial Sequence
  Description of Artificial Sequence: Synthetic peptide
  XENP019267 vhCDR3
TGWLGPFDY

SEQ ID NO: 3494 - protein, 215 aa, Artificial Sequence; identical to SEQ ID NO: 2924
  Description of Artificial Sequence: Synthetic polypeptide
  XENP019267 [CTLA-4]_H0.57_L0_Fab Light Chain

SEQ ID NO: 3495 - protein, 108 aa, Artificial Sequence; identical to SEQ ID NO: 23
  Description of Artificial Sequence: Synthetic polypeptide
  VL of XENP019267

SEQ ID NO: 3496 - protein, 12 aa, Artificial Sequence
  Description of Artificial Sequence: Synthetic peptide
  XENP019267 vlCDR1
RASQSVGSSYLA

SEQ ID NO: 3497 - protein, 7 aa, Artificial Sequence
  Description of Artificial Sequence: Synthetic peptide
  XENP019267 vlCDR2
GAFSRAT

SEQ ID NO: 3498 - protein, 9 aa, Artificial Sequence
  Description of Artificial Sequence: Synthetic peptide
  XENP019267 vlCDR3
QQYGSSPWT

SEQ ID NO: 3499 - protein, 221 aa, Artificial Sequence
  Description of Artificial Sequence: Synthetic polypeptide
  XENP019268 [CTLA-4]_H0.58_L0_Fab Heavy Chain
QVQLVESGGGVVQPGRSLRLSCAASGFTFSSYTMHWVRQAPGKGLEWVTFISYSGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3500 - protein, 118 aa, Artificial Sequence; identical to SEQ ID NO: 706
  Description of Artificial Sequence: Synthetic polypeptide
  VH of XENP019268

SEQ ID NO: 3501 - protein, 5 aa, Artificial Sequence
  Description of Artificial Sequence: Synthetic peptide
  XENP019268 vhCDR1
SYTMH

SEQ ID NO: 3502 - protein, 17 aa, Artificial Sequence
  Description of Artificial Sequence: Synthetic peptide
  XENP019268 vhCDR2
FISYSGNNKYYADSVKG

SEQ ID NO: 3503 - protein, 9 aa, Artificial Sequence
  Description of Artificial Sequence: Synthetic peptide
  XENP019268 vhCDR3
TGWLGPFDY

SEQ ID NO: 3504 - protein, 215 aa, Artificial Sequence; identical to SEQ ID NO: 2924
  Description of Artificial Sequence: Synthetic polypeptide
  XENP019268 [CTLA-4]_H0.58_L0_Fab Light Chain

SEQ ID NO: 3505 - protein, 108 aa, Artificial Sequence; identical to SEQ ID NO: 23
  Description of Artificial Sequence: Synthetic polypeptide
  VL of XENP019268

SEQ ID NO: 3506 - protein, 12 aa, Artificial Sequence
  Description of Artificial Sequence: Synthetic peptide
  XENP019268 vlCDR1
RASQSVGSSYLA

SEQ ID NO: 3507 - protein, 7 aa, Artificial Sequence
  Description of Artificial Sequence: Synthetic peptide
  XENP019268 vlCDR2
GAFSRAT

SEQ ID NO: 3508 - protein, 9 aa, Artificial Sequence
  Description of Artificial Sequence: Synthetic peptide
  XENP019268 vlCDR3
QQYGSSPWT

SEQ ID NO: 3509 - protein, 221 aa, Artificial Sequence
  Description of Artificial Sequence: Synthetic polypeptide
  XENP019269 [CTLA-4]_H0.59_L0_Fab Heavy Chain
QVQLVESGGGVVQPGRSLRLSCAASGFTFSSYTMHWVRQAPGKGLEWVTFISYEGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3510 - protein, 118 aa, Artificial Sequence; identical to SEQ ID NO: 715
  Description of Artificial Sequence: Synthetic polypeptide
  VH of XENP019269

SEQ ID NO: 3511 - protein, 5 aa, Artificial Sequence
  Description of Artificial Sequence: Synthetic peptide
  XENP019269 vhCDR1
SYTMH

SEQ ID NO: 3512 - protein, 17 aa, Artificial Sequence
  Description of Artificial Sequence: Synthetic peptide
  XENP019269 vhCDR2
FISYEGNNKYYADSVKG

SEQ ID NO: 3513 - protein, 9 aa, Artificial Sequence
  Description of Artificial Sequence: Synthetic peptide
  XENP019269 vhCDR3
TGWLGPFDY

SEQ ID NO: 3514 - protein, 215 aa, Artificial Sequence; identical to SEQ ID NO: 2924
  Description of Artificial Sequence: Synthetic polypeptide
  XENP019269 [CTLA-4]_H0.59_L0_Fab Light Chain

SEQ ID NO: 3515 - protein, 108 aa, Artificial Sequence; identical to SEQ ID NO: 23
  Description of Artificial Sequence: Synthetic polypeptide
  VL of XENP019269

SEQ ID NO: 3516 - protein, 12 aa, Artificial Sequence
  Description of Artificial Sequence: Synthetic peptide
  XENP019269 vlCDR1
RASQSVGSSYLA

SEQ ID NO: 3517 - protein, 7 aa, Artificial Sequence
  Description of Artificial Sequence: Synthetic peptide
  XENP019269 vlCDR2
GAFSRAT

SEQ ID NO: 3518 - protein, 9 aa, Artificial Sequence
  Description of Artificial Sequence: Synthetic peptide
  XENP019269 vlCDR3
QQYGSSPWT

SEQ ID NO: 3519 - protein, 221 aa, Artificial Sequence
  Description of Artificial Sequence: Synthetic polypeptide
  XENP019270 [CTLA-4]_H0.60_L0_Fab Heavy Chain
QVQLVESGGGVVQPGRSLRLSCAASGFTFSSYTMHWVRQAPGKGLEWVTFISYHGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3520 - protein, 118 aa, Artificial Sequence; identical to SEQ ID NO: 724
  Description of Artificial Sequence: Synthetic polypeptide
  VH of XENP019270

SEQ ID NO: 3521 - protein, 5 aa, Artificial Sequence
  Description of Artificial Sequence: Synthetic peptide
  XENP019270 vhCDR1
SYTMH

SEQ ID NO: 3522 - protein, 17 aa, Artificial Sequence
  Description of Artificial Sequence: Synthetic peptide
  XENP019270 vhCDR2
FISYHGNNKYYADSVKG

SEQ ID NO: 3523 - protein, 9 aa, Artificial Sequence
  Description of Artificial Sequence: Synthetic peptide
  XENP019270 vhCDR3
TGWLGPFDY

SEQ ID NO: 3524 - protein, 215 aa, Artificial Sequence; identical to SEQ ID NO: 2924
  Description of Artificial Sequence: Synthetic polypeptide
  XENP019270 [CTLA-4]_H0.60_L0_Fab Light Chain

SEQ ID NO: 3525 - protein, 108 aa, Artificial Sequence; identical to SEQ ID NO: 23
  Description of Artificial Sequence: Synthetic polypeptide
  VL of XENP019270

SEQ ID NO: 3526 - protein, 12 aa, Artificial Sequence
  Description of Artificial Sequence: Synthetic peptide
  XENP019270 vlCDR1
RASQSVGSSYLA

SEQ ID NO: 3527 - protein, 7 aa, Artificial Sequence
  Description of Artificial Sequence: Synthetic peptide
  XENP019270 vlCDR2
GAFSRAT

SEQ ID NO: 3528 - protein, 9 aa, Artificial Sequence
  Description of Artificial Sequence: Synthetic peptide
  XENP019270 vlCDR3
QQYGSSPWT

SEQ ID NO: 3529 - protein, 221 aa, Artificial Sequence
  Description of Artificial Sequence: Synthetic polypeptide
  XENP019271 [CTLA-4]_H0.61_L0_Fab Heavy Chain
QVQLVESGGGVVQPGRSLRLSCAASGFTFSSYTMHWVRQAPGKGLEWVTFISYKGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3530 - protein, 118 aa, Artificial Sequence; identical to SEQ ID NO: 733
  Description of Artificial Sequence: Synthetic polypeptide
  VH of XENP019271

SEQ ID NO: 3531 - protein, 5 aa, Artificial Sequence
  Description of Artificial Sequence: Synthetic peptide
  XENP019271 vhCDR1
SYTMH

SEQ ID NO: 3532 - protein, 17 aa, Artificial Sequence
  Description of Artificial Sequence: Synthetic peptide
  XENP019271 vhCDR2
FISYKGNNKYYADSVKG

SEQ ID NO: 3533 - protein, 9 aa, Artificial Sequence
  Description of Artificial Sequence: Synthetic peptide
  XENP019271 vhCDR3
TGWLGPFDY

SEQ ID NO: 3534 - protein, 215 aa, Artificial Sequence; identical to SEQ ID NO: 2924
  Description of Artificial Sequence: Synthetic polypeptide
  XENP019271 [CTLA-4]_H0.61_L0_Fab Light Chain

SEQ ID NO: 3535 - protein, 108 aa, Artificial Sequence; identical to SEQ ID NO: 23
  Description of Artificial Sequence: Synthetic polypeptide
  VL of XENP019271

SEQ ID NO: 3536 - protein, 12 aa, Artificial Sequence
  Description of Artificial Sequence: Synthetic peptide
  XENP019271 vlCDR1
RASQSVGSSYLA

SEQ ID NO: 3537 - protein, 7 aa, Artificial Sequence
  Description of Artificial Sequence: Synthetic peptide
  XENP019271 vlCDR2
GAFSRAT

SEQ ID NO: 3538 - protein, 9 aa, Artificial Sequence
  Description of Artificial Sequence: Synthetic peptide
  XENP019271 vlCDR3
QQYGSSPWT

SEQ ID NO: 3539 - protein, 221 aa, Artificial Sequence
  Description of Artificial Sequence: Synthetic polypeptide
  XENP019272 [CTLA-4]_H0.62_L0_Fab Heavy Chain
QVQLVESGGGVVQPGRSLRLSCAASGFTFSSYTMHWVRQAPGKGLEWVTFISYKGNNKYYADSVKGRFTISEDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3540 - protein, 118 aa, Artificial Sequence; identical to SEQ ID NO: 742
  Description of Artificial Sequence: Synthetic polypeptide
  VH of XENP019272

SEQ ID NO: 3541 - protein, 5 aa, Artificial Sequence
  Description of Artificial Sequence: Synthetic peptide
  XENP019272 vhCDR1
SYTMH

SEQ ID NO: 3542 - protein, 17 aa, Artificial Sequence
  Description of Artificial Sequence: Synthetic peptide
  XENP019272 vhCDR2
FISYKGNNKYYADSVKG

SEQ ID NO: 3543 - protein, 9 aa, Artificial Sequence
  Description of Artificial Sequence: Synthetic peptide
  XENP019272 vhCDR3
TGWLGPFDY

SEQ ID NO: 3544 - protein, 215 aa, Artificial Sequence; identical to SEQ ID NO: 2924
  Description of Artificial Sequence: Synthetic polypeptide
  XENP019272 [CTLA-4]_H0.62_L0_Fab Light Chain

SEQ ID NO: 3545 - protein, 108 aa, Artificial Sequence; identical to SEQ ID NO: 23
  Description of Artificial Sequence: Synthetic polypeptide
  VL of XENP019272

SEQ ID NO: 3546 - protein, 12 aa, Artificial Sequence
  Description of Artificial Sequence: Synthetic peptide
  XENP019272 vlCDR1
RASQSVGSSYLA

SEQ ID NO: 3547 - protein, 7 aa, Artificial Sequence
  Description of Artificial Sequence: Synthetic peptide
  XENP019272 vlCDR2
GAFSRAT

SEQ ID NO: 3548 - protein, 9 aa, Artificial Sequence
  Description of Artificial Sequence: Synthetic peptide
  XENP019272 vlCDR3
QQYGSSPWT

SEQ ID NO: 3549 - protein, 221 aa, Artificial Sequence
  Description of Artificial Sequence: Synthetic polypeptide
  XENP019273 [CTLA-4]_H0.63_L0_Fab Heavy Chain
QVQLVESGGGVVQPGRSLRLSCAASGFTFSSYTMHWVRQAPGKGLEWVTFISYQGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3550 - protein, 118 aa, Artificial Sequence; identical to SEQ ID NO: 751
  Description of Artificial Sequence: Synthetic polypeptide
  VH of XENP019273

SEQ ID NO: 3551 - protein, 5 aa, Artificial Sequence
  Description of Artificial Sequence: Synthetic peptide
  XENP019273 vhCDR1
SYTMH

SEQ ID NO: 3552 - protein, 17 aa, Artificial Sequence
  Description of Artificial Sequence: Synthetic peptide
  XENP019273 vhCDR2
FISYQGNNKYYADSVKG

SEQ ID NO: 3553 - protein, 9 aa, Artificial Sequence
  Description of Artificial Sequence: Synthetic peptide
  XENP019273 vhCDR3
TGWLGPFDY

SEQ ID NO: 3554 - protein, 215 aa, Artificial Sequence; identical to SEQ ID NO: 2924
  Description of Artificial Sequence: Synthetic polypeptide
  XENP019273 [CTLA-4]_H0.63_L0_Fab Light Chain

SEQ ID NO: 3555 - protein, 108 aa, Artificial Sequence; identical to SEQ ID NO: 23
  Description of Artificial Sequence: Synthetic polypeptide
  VL of XENP019273

SEQ ID NO: 3556 - protein, 12 aa, Artificial Sequence
  Description of Artificial Sequence: Synthetic peptide
  XENP019273 vlCDR1
RASQSVGSSYLA

SEQ ID NO: 3557 - protein, 7 aa, Artificial Sequence
  Description of Artificial Sequence: Synthetic peptide
  XENP019273 vlCDR2
GAFSRAT

SEQ ID NO: 3558 - protein, 9 aa, Artificial Sequence
  Description of Artificial Sequence: Synthetic peptide
  XENP019273 vlCDR3
QQYGSSPWT

SEQ ID NO: 3559 - protein, 221 aa, Artificial Sequence
  Description of Artificial Sequence: Synthetic polypeptide
  XENP019274 [CTLA-4]_H0.64_L0_Fab Heavy Chain
QVQLVESGGGVVQPGRSLRLSCAASGFTFSSYTMHWVRQAPGKGLEWVTFISYDKNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3560 - protein, 118 aa, Artificial Sequence; identical to SEQ ID NO: 760
  Description of Artificial Sequence: Synthetic polypeptide
  VH of XENP019274

SEQ ID NO: 3561 - protein, 5 aa, Artificial Sequence
  Description of Artificial Sequence: Synthetic peptide
  XENP019274 vhCDR1
SYTMH

SEQ ID NO: 3562 - protein, 17 aa, Artificial Sequence
  Description of Artificial Sequence: Synthetic peptide
  XENP019274 vhCDR2
FISYDKNNKYYADSVKG

SEQ ID NO: 3563 - protein, 9 aa, Artificial Sequence
  Description of Artificial Sequence: Synthetic peptide
  XENP019274 vhCDR3
TGWLGPFDY

SEQ ID NO: 3564 - protein, 215 aa, Artificial Sequence; identical to SEQ ID NO: 2924
  Description of Artificial Sequence: Synthetic polypeptide
  XENP019274 [CTLA-4]_H0.64_L0_Fab Light Chain

SEQ ID NO: 3565 - protein, 108 aa, Artificial Sequence; identical to SEQ ID NO: 23
  Description of Artificial Sequence: Synthetic polypeptide
  VL of XENP019274

SEQ ID NO: 3566 - protein, 12 aa, Artificial Sequence
  Description of Artificial Sequence: Synthetic peptide
  XENP019274 vlCDR1
RASQSVGSSYLA

SEQ ID NO: 3567 - protein, 7 aa, Artificial Sequence
  Description of Artificial Sequence: Synthetic peptide
  XENP019274 vlCDR2
GAFSRAT

SEQ ID NO: 3568 - protein, 9 aa, Artificial Sequence
  Description of Artificial Sequence: Synthetic peptide
  XENP019274 vlCDR3
QQYGSSPWT

SEQ ID NO: 3569 - protein, 221 aa, Artificial Sequence
  Description of Artificial Sequence: Synthetic polypeptide
  XENP019275 [CTLA-4]_H0.65_L0_Fab Heavy Chain
QVQLVESGGGVVQPGRSLRLSCAASGFTFSSYTMHWVRQAPGKGLEWVTFISYDKNNKYYADSVKGRFTISEDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3570 - protein, 118 aa, Artificial Sequence; identical to SEQ ID NO: 769
  Description of Artificial Sequence: Synthetic polypeptide
  VH of XENP019275

SEQ ID NO: 3571 - protein, 5 aa, Artificial Sequence
  Description of Artificial Sequence: Synthetic peptide
  XENP019275 vhCDR1
SYTMH

SEQ ID NO: 3572 - protein, 17 aa, Artificial Sequence
  Description of Artificial Sequence: Synthetic peptide
  XENP019275 vhCDR2
FISYDKNNKYYADSVKG

SEQ ID NO: 3573 - protein, 9 aa, Artificial Sequence
  Description of Artificial Sequence: Synthetic peptide
  XENP019275 vhCDR3
TGWLGPFDY

SEQ ID NO: 3574 - protein, 215 aa, Artificial Sequence; identical to SEQ ID NO: 2924
  Description of Artificial Sequence: Synthetic polypeptide
  XENP019275 [CTLA-4]_H0.65_L0_Fab Light Chain

SEQ ID NO: 3575 - protein, 108 aa, Artificial Sequence; identical to SEQ ID NO: 23
  Description of Artificial Sequence: Synthetic polypeptide
  VL of XENP019275

SEQ ID NO: 3576 - protein, 12 aa, Artificial Sequence
  Description of Artificial Sequence: Synthetic peptide
  XENP019275 vlCDR1
RASQSVGSSYLA

SEQ ID NO: 3577 - protein, 7 aa, Artificial Sequence
  Description of Artificial Sequence: Synthetic peptide
  XENP019275 vlCDR2
GAFSRAT

SEQ ID NO: 3578 - protein, 9 aa, Artificial Sequence
  Description of Artificial Sequence: Synthetic peptide
  XENP019275 vlCDR3
QQYGSSPWT

SEQ ID NO: 3579 - protein, 221 aa, Artificial Sequence
  Description of Artificial Sequence: Synthetic polypeptide
  XENP019276 [CTLA-4]_H0.66_L0_Fab Heavy Chain
QVQLVESGGGVVQPGRSLRLSCAASGFTFSSYTMHWVRQAPGKGLEWVTFISYDGDNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3580 - protein, 118 aa, Artificial Sequence; identical to SEQ ID NO: 778
  Description of Artificial Sequence: Synthetic polypeptide
  VH of XENP019276

SEQ ID NO: 3581 - protein, 5 aa, Artificial Sequence
  Description of Artificial Sequence: Synthetic peptide
  XENP019276 vhCDR1
SYTMH

SEQ ID NO: 3582 - protein, 17 aa, Artificial Sequence
  Description of Artificial Sequence: Synthetic peptide
  XENP019276 vhCDR2
FISYDGDNKYYADSVKG

SEQ ID NO: 3583 - protein, 9 aa, Artificial Sequence
  Description of Artificial Sequence: Synthetic peptide
  XENP019276 vhCDR3
TGWLGPFDY

SEQ ID NO: 3584 - protein, 215 aa, Artificial Sequence; identical to SEQ ID NO: 2924
  Description of Artificial Sequence: Synthetic polypeptide
  XENP019276 [CTLA-4]_H0.66_L0_Fab Light Chain

SEQ ID NO: 3585 - protein, 108 aa, Artificial Sequence; identical to SEQ ID NO: 23
  Description of Artificial Sequence: Synthetic polypeptide
  VL of XENP019276

SEQ ID NO: 3586 - protein, 12 aa, Artificial Sequence
  Description of Artificial Sequence: Synthetic peptide
  XENP019276 vlCDR1
RASQSVGSSYLA

SEQ ID NO: 3587 - protein, 7 aa, Artificial Sequence
  Description of Artificial Sequence: Synthetic peptide
  XENP019276 vlCDR2
GAFSRAT

SEQ ID NO: 3588 - protein, 9 aa, Artificial Sequence
  Description of Artificial Sequence: Synthetic peptide
  XENP019276 vlCDR3
QQYGSSPWT

SEQ ID NO: 3589 - protein, 221 aa, Artificial Sequence
  Description of Artificial Sequence: Synthetic polypeptide
  XENP019277 [CTLA-4]_H0.67_L0_Fab Heavy Chain
QVQLVESGGGVVQPGRSLRLSCAASGFTFSSYTMHWVRQAPGKGLEWVTFISYDGGNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3590 - protein, 118 aa, Artificial Sequence; identical to SEQ ID NO: 787
  Description of Artificial Sequence: Synthetic polypeptide
  VH of XENP019277

SEQ ID NO: 3591 - protein, 5 aa, Artificial Sequence
  Description of Artificial Sequence: Synthetic peptide
  XENP019277 vhCDR1
SYTMH

SEQ ID NO: 3592 - protein, 17 aa, Artificial Sequence
  Description of Artificial Sequence: Synthetic peptide
  XENP019277 vhCDR2
FISYDGGNKYYADSVKG

SEQ ID NO: 3593 - protein, 9 aa, Artificial Sequence
  Description of Artificial Sequence: Synthetic peptide
  XENP019277 vhCDR3
TGWLGPFDY

SEQ ID NO: 3594 - protein, 215 aa, Artificial Sequence; identical to SEQ ID NO: 2924
  Description of Artificial Sequence: Synthetic polypeptide
  XENP019277 [CTLA-4]_H0.67_L0_Fab Light Chain

SEQ ID NO: 3595 - protein, 108 aa, Artificial Sequence; identical to SEQ ID NO: 23
  Description of Artificial Sequence: Synthetic polypeptide
  VL of XENP019277

SEQ ID NO: 3596 - protein, 12 aa, Artificial Sequence
  Description of Artificial Sequence: Synthetic peptide
  XENP019277 vlCDR1
RASQSVGSSYLA

SEQ ID NO: 3597 - protein, 7 aa, Artificial Sequence
  Description of Artificial Sequence: Synthetic peptide
  XENP019277 vlCDR2
GAFSRAT

SEQ ID NO: 3598 - protein, 9 aa, Artificial Sequence
  Description of Artificial Sequence: Synthetic peptide
  XENP019277 vlCDR3
QQYGSSPWT

SEQ ID NO: 3599 - protein, 221 aa, Artificial Sequence
  Description of Artificial Sequence: Synthetic polypeptide
  XENP019278 [CTLA-4]_H0.68_L0_Fab Heavy Chain
QVQLVESGGGVVQPGRSLRLSCAASGFTFSSYTMHWVRQAPGKGLEWVTFISYDGHNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3600 - protein, 118 aa, Artificial Sequence; identical to SEQ ID NO: 796
  Description of Artificial Sequence: Synthetic polypeptide
  VH of XENP019278

SEQ ID NO: 3601 - protein, 5 aa, Artificial Sequence
  Description of Artificial Sequence: Synthetic peptide
  XENP019278 vhCDR1
SYTMH

SEQ ID NO: 3602 - protein, 17 aa, Artificial Sequence
  Description of Artificial Sequence: Synthetic peptide
  XENP019278 vhCDR2
FISYDGHNKYYADSVKG

SEQ ID NO: 3603 - protein, 9 aa, Artificial Sequence
  Description of Artificial Sequence: Synthetic peptide
  XENP019278 vhCDR3
TGWLGPFDY

SEQ ID NO: 3604 - protein, 215 aa, Artificial Sequence; identical to SEQ ID NO: 2924
  Description of Artificial Sequence: Synthetic polypeptide
  XENP019278 [CTLA-4]_H0.68_L0_Fab Light Chain

SEQ ID NO: 3605 - protein, 108 aa, Artificial Sequence; identical to SEQ ID NO: 23
  Description of Artificial Sequence: Synthetic polypeptide
  VL of XENP019278

SEQ ID NO: 3606 - protein, 12 aa, Artificial Sequence
  Description of Artificial Sequence: Synthetic peptide
  XENP019278 vlCDR1
RASQSVGSSYLA

SEQ ID NO: 3607 - protein, 7 aa, Artificial Sequence
  Description of Artificial Sequence: Synthetic peptide
  XENP019278 vlCDR2
GAFSRAT

SEQ ID NO: 3608 - protein, 9 aa, Artificial Sequence
  Description of Artificial Sequence: Synthetic peptide
  XENP019278 vlCDR3
QQYGSSPWT

SEQ ID NO: 3609 - protein, 221 aa, Artificial Sequence
  Description of Artificial Sequence: Synthetic polypeptide
  XENP019279 [CTLA-4]_H0.69_L0_Fab Heavy Chain
QVQLVESGGGVVQPGRSLRLSCAASGFTFSSYTMHWVRQAPGKGLEWVTFISYDGQNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3610 - protein, 118 aa, Artificial Sequence; identical to SEQ ID NO: 805
  Description of Artificial Sequence: Synthetic polypeptide
  VH of XENP019279

SEQ ID NO: 3611 - protein, 5 aa, Artificial Sequence
  Description of Artificial Sequence: Synthetic peptide
  XENP019279 vhCDR1
SYTMH

SEQ ID NO: 3612 - protein, 17 aa, Artificial Sequence
  Description of Artificial Sequence: Synthetic peptide
  XENP019279 vhCDR2
FISYDGQNKYYADSVKG

SEQ ID NO: 3613 - protein, 9 aa, Artificial Sequence
  Description of Artificial Sequence: Synthetic peptide
  XENP019279 vhCDR3
TGWLGPFDY

SEQ ID NO: 3614 - protein, 215 aa, Artificial Sequence; identical to SEQ ID NO: 2924
  Description of Artificial Sequence: Synthetic polypeptide
  XENP019279 [CTLA-4]_H0.69_L0_Fab Light Chain

SEQ ID NO: 3615 - protein, 108 aa, Artificial Sequence; identical to SEQ ID NO: 23
  Description of Artificial Sequence: Synthetic polypeptide
  VL of XENP019279

SEQ ID NO: 3616 - protein, 12 aa, Artificial Sequence
  Description of Artificial Sequence: Synthetic peptide
  XENP019279 vlCDR1
RASQSVGSSYLA

SEQ ID NO: 3617 - protein, 7 aa, Artificial Sequence
  Description of Artificial Sequence: Synthetic peptide
  XENP019279 vlCDR2
GAFSRAT

SEQ ID NO: 3618 - protein, 9 aa, Artificial Sequence
  Description of Artificial Sequence: Synthetic peptide
  XENP019279 vlCDR3
QQYGSSPWT

SEQ ID NO: 3619 - protein, 221 aa, Artificial Sequence
  Description of Artificial Sequence: Synthetic polypeptide
  XENP019280 [CTLA-4]_H0.70_L0_Fab Heavy Chain
QVQLVESGGGVVQPGRSLRLSCAASGFTFSSYTMHWVRQAPGKGLEWVTFISYDGSNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3620 - protein, 118 aa, Artificial Sequence; identical to SEQ ID NO: 814
  Description of Artificial Sequence: Synthetic polypeptide
  VH of XENP019280

SEQ ID NO: 3621 - protein, 5 aa, Artificial Sequence
  Description of Artificial Sequence: Synthetic peptide
  XENP019280 vhCDR1
SYTMH

SEQ ID NO: 3622 - protein, 17 aa, Artificial Sequence
  Description of Artificial Sequence: Synthetic peptide
  XENP019280 vhCDR2
FISYDGSNKYYADSVKG

SEQ ID NO: 3623 - protein, 9 aa, Artificial Sequence
  Description of Artificial Sequence: Synthetic peptide
  XENP019280 vhCDR3
TGWLGPFDY

SEQ ID NO: 3624 - protein, 215 aa, Artificial Sequence; identical to SEQ ID NO: 2924
  Description of Artificial Sequence: Synthetic polypeptide
  XENP019280 [CTLA-4]_H0.70_L0_Fab Light Chain

SEQ ID NO: 3625 - protein, 108 aa, Artificial Sequence; identical to SEQ ID NO: 23
  Description of Artificial Sequence: Synthetic polypeptide
  VL of XENP019280

SEQ ID NO: 3626 - protein, 12 aa, Artificial Sequence
  Description of Artificial Sequence: Synthetic peptide
  XENP019280 vlCDR1
RASQSVGSSYLA

SEQ ID NO: 3627 - protein, 7 aa, Artificial Sequence
  Description of Artificial Sequence: Synthetic peptide
  XENP019280 vlCDR2
GAFSRAT

SEQ ID NO: 3628 - protein, 9 aa, Artificial Sequence
  Description of Artificial Sequence: Synthetic peptide
  XENP019280 vlCDR3
QQYGSSPWT

SEQ ID NO: 3629 - protein, 221 aa, Artificial Sequence
  Description of Artificial Sequence: Synthetic polypeptide
  XENP019281 [CTLA-4]_H0.71_L0_Fab Heavy Chain
QVQLVESGGGVVQPGRSLRLSCAASGFTFSSYTMHWVRQAPGKGLEWVTFISYDGNDKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3630 - protein, 118 aa, Artificial Sequence; identical to SEQ ID NO: 823
  Description of Artificial Sequence: Synthetic polypeptide
  VH of XENP019281

SEQ ID NO: 3631 - protein, 5 aa, Artificial Sequence
  Description of Artificial Sequence: Synthetic peptide
  XENP019281 vhCDR1
SYTMH

SEQ ID NO: 3632 - protein, 17 aa, Artificial Sequence
  Description of Artificial Sequence: Synthetic peptide
  XENP019281 vhCDR2
FISYDGNDKYYADSVKG

SEQ ID NO: 3633 - protein, 9 aa, Artificial Sequence
  Description of Artificial Sequence: Synthetic peptide
  XENP019281 vhCDR3
TGWLGPFDY

SEQ ID NO: 3634 - protein, 215 aa, Artificial Sequence; identical to SEQ ID NO: 2924
  Description of Artificial Sequence: Synthetic polypeptide
  XENP019281 [CTLA-4]_H0.71_L0_Fab Light Chain

SEQ ID NO: 3635 - protein, 108 aa, Artificial Sequence; identical to SEQ ID NO: 23
  Description of Artificial Sequence: Synthetic polypeptide
  VL of XENP019281

SEQ ID NO: 3636 - protein, 12 aa, Artificial Sequence
  Description of Artificial Sequence: Synthetic peptide
  XENP019281 vlCDR1
RASQSVGSSYLA

SEQ ID NO: 3637 - protein, 7 aa, Artificial Sequence
  Description of Artificial Sequence: Synthetic peptide
  XENP019281 vlCDR2
GAFSRAT

SEQ ID NO: 3638 - protein, 9 aa, Artificial Sequence
  Description of Artificial Sequence: Synthetic peptide
  XENP019281 vlCDR3
QQYGSSPWT

SEQ ID NO: 3639 - protein, 221 aa, Artificial Sequence
  Description of Artificial Sequence: Synthetic polypeptide
  XENP019282 [CTLA-4]_H0.72_L0_Fab Heavy Chain
QVQLVESGGGVVQPGRSLRLSCAASGFTFSSYTMHWVRQAPGKGLEWVTFISYDGNEKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3640 - protein, 118 aa, Artificial Sequence; identical to SEQ ID NO: 832
  Description of Artificial Sequence: Synthetic polypeptide
  VH of XENP019282

SEQ ID NO: 3641 - protein, 5 aa, Artificial Sequence
  Description of Artificial Sequence: Synthetic peptide
  XENP019282 vhCDR1
SYTMH

SEQ ID NO: 3642 - protein, 17 aa, Artificial Sequence
  Description of Artificial Sequence: Synthetic peptide
  XENP019282 vhCDR2
FISYDGNEKYYADSVKG

SEQ ID NO: 3643 - protein, 9 aa, Artificial Sequence
  Description of Artificial Sequence: Synthetic peptide
  XENP019282 vhCDR3
TGWLGPFDY

SEQ ID NO: 3644 - protein, 215 aa, Artificial Sequence; identical to SEQ ID NO: 2924
  Description of Artificial Sequence: Synthetic polypeptide
  XENP019282 [CTLA-4]_H0.72_L0_Fab Light Chain

SEQ ID NO: 3645 - protein, 108 aa, Artificial Sequence; identical to SEQ ID NO: 23
  Description of Artificial Sequence: Synthetic polypeptide
  VL of XENP019282

SEQ ID NO: 3646 - protein, 12 aa, Artificial Sequence
  Description of Artificial Sequence: Synthetic peptide
  XENP019282 vlCDR1
RASQSVGSSYLA

SEQ ID NO: 3647 - protein, 7 aa, Artificial Sequence
  Description of Artificial Sequence: Synthetic peptide
  XENP019282 vlCDR2
GAFSRAT

SEQ ID NO: 3648 - protein, 9 aa, Artificial Sequence
  Description of Artificial Sequence: Synthetic peptide
  XENP019282 vlCDR3
QQYGSSPWT

SEQ ID NO: 3649 - protein, 221 aa, Artificial Sequence
  Description of Artificial Sequence: Synthetic polypeptide
  XENP019283 [CTLA-4]_H0.73_L0_Fab Heavy Chain
QVQLVESGGGVVQPGRSLRLSCAASGFTFSSYTMHWVRQAPGKGLEWVTFISYDGNHKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3650 - protein, 118 aa, Artificial Sequence; identical to SEQ ID NO: 841
  Description of Artificial Sequence: Synthetic polypeptide
  VH of XENP019283

SEQ ID NO: 3651 - protein, 5 aa, Artificial Sequence
  Description of Artificial Sequence: Synthetic peptide
  XENP019283 vhCDR1
SYTMH

SEQ ID NO: 3652 - protein, 17 aa, Artificial Sequence
  Description of Artificial Sequence: Synthetic peptide
  XENP019283 vhCDR2
FISYDGNHKYYADSVKG

SEQ ID NO: 3653 - protein, 9 aa, Artificial Sequence
  Description of Artificial Sequence: Synthetic peptide
  XENP019283 vhCDR3
TGWLGPFDY

SEQ ID NO: 3654 - protein, 215 aa, Artificial Sequence; identical to SEQ ID NO: 2924
  Description of Artificial Sequence: Synthetic polypeptide
  XENP019283 [CTLA-4]_H0.73_L0_Fab Light Chain

SEQ ID NO: 3655 - protein, 108 aa, Artificial Sequence; identical to SEQ ID NO: 23
  Description of Artificial Sequence: Synthetic polypeptide
  VL of XENP019283

SEQ ID NO: 3656 - protein, 12 aa, Artificial Sequence
  Description of Artificial Sequence: Synthetic peptide
  XENP019283 vlCDR1
RASQSVGSSYLA

SEQ ID NO: 3657 - protein, 7 aa, Artificial Sequence
  Description of Artificial Sequence: Synthetic peptide
  XENP019283 vlCDR2
GAFSRAT

SEQ ID NO: 3658 - protein, 9 aa, Artificial Sequence
  Description of Artificial Sequence: Synthetic peptide
  XENP019283 vlCDR3
QQYGSSPWT

SEQ ID NO: 3659 - protein, 221 aa, Artificial Sequence
  Description of Artificial Sequence: Synthetic polypeptide
  XENP019284 [CTLA-4]_H0.74_L0_Fab Heavy Chain
QVQLVESGGGVVQPGRSLRLSCAASGFTFSSYTMHWVRQAPGKGLEWVTFISYDGNSKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3660 - protein, 118 aa, Artificial Sequence; identical to SEQ ID NO: 850
  Description of Artificial Sequence: Synthetic polypeptide
  VH of XENP019284

SEQ ID NO: 3661 - protein, 5 aa, Artificial Sequence
  Description of Artificial Sequence: Synthetic peptide
  XENP019284 vhCDR1
SYTMH

SEQ ID NO: 3662 - protein, 17 aa, Artificial Sequence
  Description of Artificial Sequence: Synthetic peptide
  XENP019284 vhCDR2
FISYDGNSKYYADSVKG

SEQ ID NO: 3663 - protein, 9 aa, Artificial Sequence
  Description of Artificial Sequence: Synthetic peptide
  XENP019284 vhCDR3
TGWLGPFDY

SEQ ID NO: 3664 - protein, 215 aa, Artificial Sequence; identical to SEQ ID NO: 2924
  Description of Artificial Sequence: Synthetic polypeptide
  XENP019284 [CTLA-4]_H0.74_L0_Fab Light Chain

SEQ ID NO: 3665 - protein, 108 aa, Artificial Sequence; identical to SEQ ID NO: 23
  Description of Artificial Sequence: Synthetic polypeptide
  VL of XENP019284

SEQ ID NO: 3666 - protein, 12 aa, Artificial Sequence
  Description of Artificial Sequence: Synthetic peptide
  XENP019284 vlCDR1
RASQSVGSSYLA

SEQ ID NO: 3667 - protein, 7 aa, Artificial Sequence
  Description of Artificial Sequence: Synthetic peptide
  XENP019284 vlCDR2
GAFSRAT

SEQ ID NO: 3668 - protein, 9 aa, Artificial Sequence
  Description of Artificial Sequence: Synthetic peptide
  XENP019284 vlCDR3
QQYGSSPWT

SEQ ID NO: 3669 - protein, 221 aa, Artificial Sequence
  Description of Artificial Sequence: Synthetic polypeptide
  XENP019285 [CTLA-4]_H0.75_L0_Fab Heavy Chain
QVQLVESGGGVVQPGRSLRLSCAASGFTFSSYTMHWVRQAPGKGLEWVTFISYDGNTKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3670 - protein, 118 aa, Artificial Sequence; identical to SEQ ID NO: 859
  Description of Artificial Sequence: Synthetic polypeptide
  VH of XENP019285

SEQ ID NO: 3671 - protein, 5 aa, Artificial Sequence
  Description of Artificial Sequence: Synthetic peptide
  XENP019285 vhCDR1
SYTMH

SEQ ID NO: 3672 - protein, 17 aa, Artificial Sequence
  Description of Artificial Sequence: Synthetic peptide
  XENP019285 vhCDR2
FISYDGNTKYYADSVKG

SEQ ID NO: 3673 - protein, 9 aa, Artificial Sequence
  Description of Artificial Sequence: Synthetic peptide
  XENP019285 vhCDR3
TGWLGPFDY

SEQ ID NO: 3674 - protein, 215 aa, Artificial Sequence; identical to SEQ ID NO: 2924
  Description of Artificial Sequence: Synthetic polypeptide
  XENP019285 [CTLA-4]_H0.75_L0_Fab Light Chain

SEQ ID NO: 3675 - protein, 108 aa, Artificial Sequence; identical to SEQ ID NO: 23
  Description of Artificial Sequence: Synthetic polypeptide
  VL of XENP019285

SEQ ID NO: 3676 - protein, 12 aa, Artificial Sequence
  Description of Artificial Sequence: Synthetic peptide
  XENP019285 vlCDR1
RASQSVGSSYLA

SEQ ID NO: 3677 - protein, 7 aa, Artificial Sequence
  Description of Artificial Sequence: Synthetic peptide
  XENP019285 vlCDR2
GAFSRAT

SEQ ID NO: 3678 - protein, 9 aa, Artificial Sequence
  Description of Artificial Sequence: Synthetic peptide
  XENP019285 vlCDR3
QQYGSSPWT

SEQ ID NO: 3679 - protein, 221 aa, Artificial Sequence
  Description of Artificial Sequence: Synthetic polypeptide
  XENP019286 [CTLA-4]_H0.76_L0_Fab Heavy Chain
QVQLVESGGGVVQPGRSLRLSCAASGFTFSSYTMHWVRQAPGKGLEWVTFISYDGNQKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3680 - protein, 118 aa, Artificial Sequence; identical to SEQ ID NO: 868
  Description of Artificial Sequence: Synthetic polypeptide
  VH of XENP019286

SEQ ID NO: 3681 - protein, 5 aa, Artificial Sequence
  Description of Artificial Sequence: Synthetic peptide
  XENP019286 vhCDR1
SYTMH

SEQ ID NO: 3682 - protein, 17 aa, Artificial Sequence
  Description of Artificial Sequence: Synthetic peptide
  XENP019286 vhCDR2
FISYDGNQKYYADSVKG

SEQ ID NO: 3683 - protein, 9 aa, Artificial Sequence
  Description of Artificial Sequence: Synthetic peptide
  XENP019286 vhCDR3
TGWLGPFDY

SEQ ID NO: 3684 - protein, 215 aa, Artificial Sequence; identical to SEQ ID NO: 2924
  Description of Artificial Sequence: Synthetic polypeptide
  XENP019286 [CTLA-4]_H0.76_L0_Fab Light Chain

SEQ ID NO: 3685 - protein, 108 aa, Artificial Sequence; identical to SEQ ID NO: 23
  Description of Artificial Sequence: Synthetic polypeptide
  VL of XENP019286

SEQ ID NO: 3686 - protein, 12 aa, Artificial Sequence
  Description of Artificial Sequence: Synthetic peptide
  XENP019286 vlCDR1
RASQSVGSSYLA

SEQ ID NO: 3687 - protein, 7 aa, Artificial Sequence
  Description of Artificial Sequence: Synthetic peptide
  XENP019286 vlCDR2
GAFSRAT

SEQ ID NO: 3688 - protein, 9 aa, Artificial Sequence
  Description of Artificial Sequence: Synthetic peptide
  XENP019286 vlCDR3
QQYGSSPWT

SEQ ID NO: 3689 - protein, 221 aa, Artificial Sequence
  Description of Artificial Sequence: Synthetic polypeptide
  XENP019287 [CTLA-4]_H0.77_L0_Fab Heavy Chain
QVQLVESGGGVVQPGRSLRLSCAASGFTFSSYTMHWVRQAPGKGLEWVTFISYDGNNIYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3690 - protein, 118 aa, Artificial Sequence; identical to SEQ ID NO: 877
  Description of Artificial Sequence: Synthetic polypeptide
  VH of XENP019287

SEQ ID NO: 3691 - protein, 5 aa, Artificial Sequence
  Description of Artificial Sequence: Synthetic peptide
  XENP019287 vhCDR1
SYTMH

SEQ ID NO: 3692 - protein, 17 aa, Artificial Sequence
  Description of Artificial Sequence: Synthetic peptide
  XENP019287 vhCDR2
FISYDGNNIYYADSVKG

SEQ ID NO: 3693 - protein, 9 aa, Artificial Sequence
  Description of Artificial Sequence: Synthetic peptide
  XENP019287 vhCDR3
TGWLGPFDY

SEQ ID NO: 3694 - protein, 215 aa, Artificial Sequence; identical to SEQ ID NO: 2924
  Description of Artificial Sequence: Synthetic polypeptide
  XENP019287 [CTLA-4]_H0.77_L0_Fab Light Chain

SEQ ID NO: 3695 - protein, 108 aa, Artificial Sequence; identical to SEQ ID NO: 23
  Description of Artificial Sequence: Synthetic polypeptide
  VL of XENP019287

SEQ ID NO: 3696 - protein, 12 aa, Artificial Sequence
  Description of Artificial Sequence: Synthetic peptide
  XENP019287 vlCDR1
RASQSVGSSYLA

SEQ ID NO: 3697 - protein, 7 aa, Artificial Sequence
  Description of Artificial Sequence: Synthetic peptide
  XENP019287 vlCDR2
GAFSRAT

SEQ ID NO: 3698 - protein, 9 aa, Artificial Sequence
  Description of Artificial Sequence: Synthetic peptide
  XENP019287 vlCDR3
QQYGSSPWT

SEQ ID NO: 3699 - protein, 221 aa, Artificial Sequence
  Description of Artificial Sequence: Synthetic polypeptide
  XENP019288 [CTLA-4]_H0.78_L0_Fab Heavy Chain
QVQLVESGGGVVQPGRSLRLSCAASGFTFSSYTMHWVRQAPGKGLEWVTFISYDGNNTYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3700 - protein, 118 aa, Artificial Sequence; identical to SEQ ID NO: 886
  Description of Artificial Sequence: Synthetic polypeptide
  VH of XENP019288

SEQ ID NO: 3701 - protein, 5 aa, Artificial Sequence
  Description of Artificial Sequence: Synthetic peptide
  XENP019288 vhCDR1
SYTMH

SEQ ID NO: 3702 - protein, 17 aa, Artificial Sequence
  Description of Artificial Sequence: Synthetic peptide
  XENP019288 vhCDR2
FISYDGNNTYYADSVKG

SEQ ID NO: 3703 - protein, 9 aa, Artificial Sequence
  Description of Artificial Sequence: Synthetic peptide
  XENP019288 vhCDR3
TGWLGPFDY

SEQ ID NO: 3704 - protein, 215 aa, Artificial Sequence; identical to SEQ ID NO: 2924
  Description of Artificial Sequence: Synthetic polypeptide
  XENP019288 [CTLA-4]_H0.78_L0_Fab Light Chain

SEQ ID NO: 3705 - protein, 108 aa, Artificial Sequence; identical to SEQ ID NO: 23
  Description of Artificial Sequence: Synthetic polypeptide
  VL of XENP019288

SEQ ID NO: 3706 - protein, 12 aa, Artificial Sequence
  Description of Artificial Sequence: Synthetic peptide
  XENP019288 vlCDR1
RASQSVGSSYLA

SEQ ID NO: 3707 - protein, 7 aa, Artificial Sequence
  Description of Artificial Sequence: Synthetic peptide
  XENP019288 vlCDR2
GAFSRAT

SEQ ID NO: 3708 - protein, 9 aa, Artificial Sequence
  Description of Artificial Sequence: Synthetic peptide
  XENP019288 vlCDR3
QQYGSSPWT

SEQ ID NO: 3709 - protein, 221 aa, Artificial Sequence
  Description of Artificial Sequence: Synthetic polypeptide
  XENP019289 [CTLA-4]_H0.79_L0_Fab Heavy Chain
QVQLVESGGGVVQPGRSLRLSCAASGFTFSSYTMHWVRQAPGKGLEWVTFISYDGNNKAYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3710 - protein, 118 aa, Artificial Sequence; identical to SEQ ID NO: 895
  Description of Artificial Sequence: Synthetic polypeptide
  VH of XENP019289

SEQ ID NO: 3711 - protein, 5 aa, Artificial Sequence
  Description of Artificial Sequence: Synthetic peptide
  XENP019289 vhCDR1
SYTMH

SEQ ID NO: 3712 - protein, 17 aa, Artificial Sequence
  Description of Artificial Sequence: Synthetic peptide
  XENP019289 vhCDR2
FISYDGNNKAYADSVKG

SEQ ID NO: 3713 - protein, 9 aa, Artificial Sequence
  Description of Artificial Sequence: Synthetic peptide
  XENP019289 vhCDR3
TGWLGPFDY

SEQ ID NO: 3714 - protein, 215 aa, Artificial Sequence; identical to SEQ ID NO: 2924
  Description of Artificial Sequence: Synthetic polypeptide
  XENP019289 [CTLA-4]_H0.79_L0_Fab Light Chain

SEQ ID NO: 3715 - protein, 108 aa, Artificial Sequence; identical to SEQ ID NO: 23
  Description of Artificial Sequence: Synthetic polypeptide
  VL of XENP019289

SEQ ID NO: 3716 - protein, 12 aa, Artificial Sequence
  Description of Artificial Sequence: Synthetic peptide
  XENP019289 vlCDR1
RASQSVGSSYLA

SEQ ID NO: 3717 - protein, 7 aa, Artificial Sequence
  Description of Artificial Sequence: Synthetic peptide
  XENP019289 vlCDR2
GAFSRAT

SEQ ID NO: 3718 - protein, 9 aa, Artificial Sequence
  Description of Artificial Sequence: Synthetic peptide
  XENP019289 vlCDR3
QQYGSSPWT

SEQ ID NO: 3719 - protein, 221 aa, Artificial Sequence
  Description of Artificial Sequence: Synthetic polypeptide
  XENP019290 [CTLA-4]_H0.80_L0_Fab Heavy Chain
QVQLVESGGGVVQPGRSLRLSCAASGFTFSSYTMHWVRQAPGKGLEWVTFISYDGNNKYYAASVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3720 - protein, 118 aa, Artificial Sequence; identical to SEQ ID NO: 904
  Description of Artificial Sequence: Synthetic polypeptide
  VH of XENP019290

SEQ ID NO: 3721 - protein, 5 aa, Artificial Sequence
  Description of Artificial Sequence: Synthetic peptide
  XENP019290 vhCDR1
SYTMH

SEQ ID NO: 3722 - protein, 17 aa, Artificial Sequence
  Description of Artificial Sequence: Synthetic peptide
  XENP019290 vhCDR2
FISYDGNNKYYAASVKG

SEQ ID NO: 3723 - protein, 9 aa, Artificial Sequence
  Description of Artificial Sequence: Synthetic peptide
  XENP019290 vhCDR3
TGWLGPFDY

SEQ ID NO: 3724 - protein, 215 aa, Artificial Sequence; identical to SEQ ID NO: 2924
  Description of Artificial Sequence: Synthetic polypeptide
  XENP019290 [CTLA-4]_H0.80_L0_Fab Light Chain

SEQ ID NO: 3725 - protein, 108 aa, Artificial Sequence; identical to SEQ ID NO: 23
  Description of Artificial Sequence: Synthetic polypeptide
  VL of XENP019290

SEQ ID NO: 3726 - protein, 12 aa, Artificial Sequence
  Description of Artificial Sequence: Synthetic peptide
  XENP019290 vlCDR1
RASQSVGSSYLA

SEQ ID NO: 3727 - protein, 7 aa, Artificial Sequence
  Description of Artificial Sequence: Synthetic peptide
  XENP019290 vlCDR2
GAFSRAT

SEQ ID NO: 3728 - protein, 9 aa, Artificial Sequence
  Description of Artificial Sequence: Synthetic peptide
  XENP019290 vlCDR3
QQYGSSPWT

SEQ ID NO: 3729 - protein, 221 aa, Artificial Sequence
  Description of Artificial Sequence: Synthetic polypeptide
  XENP019291 [CTLA-4]_H0.81_L0_Fab Heavy Chain
QVQLVESGGGVVQPGRSLRLSCAASGFTFSSYTMHWVRQAPGKGLEWVTFISYDGNNKYYAKSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3730 - protein, 118 aa, Artificial Sequence; identical to SEQ ID NO: 913
  Description of Artificial Sequence: Synthetic polypeptide
  VH of XENP019291

SEQ ID NO: 3731 - protein, 5 aa, Artificial Sequence
  Description of Artificial Sequence: Synthetic peptide
  XENP019291 vhCDR1
SYTMH

SEQ ID NO: 3732 - protein, 17 aa, Artificial Sequence
  Description of Artificial Sequence: Synthetic peptide
  XENP019291 vhCDR2
FISYDGNNKYYAKSVKG

SEQ ID NO: 3733 - protein, 9 aa, Artificial Sequence
  Description of Artificial Sequence: Synthetic peptide
  XENP019291 vhCDR3
TGWLGPFDY

SEQ ID NO: 3734 - protein, 215 aa, Artificial Sequence; identical to SEQ ID NO: 2924
  Description of Artificial Sequence: Synthetic polypeptide
  XENP019291 [CTLA-4]_H0.81_L0_Fab Light Chain

SEQ ID NO: 3735 - protein, 108 aa, Artificial Sequence; identical to SEQ ID NO: 23
  Description of Artificial Sequence: Synthetic polypeptide
  VL of XENP019291

SEQ ID NO: 3736 - protein, 12 aa, Artificial Sequence
  Description of Artificial Sequence: Synthetic peptide
  XENP019291 vlCDR1
RASQSVGSSYLA

SEQ ID NO: 3737 - protein, 7 aa, Artificial Sequence
  Description of Artificial Sequence: Synthetic peptide
  XENP019291 vlCDR2
GAFSRAT

SEQ ID NO: 3738 - protein, 9 aa, Artificial Sequence
  Description of Artificial Sequence: Synthetic peptide
  XENP019291 vlCDR3
QQYGSSPWT

SEQ ID NO: 3739 - protein, 221 aa, Artificial Sequence
  Description of Artificial Sequence: Synthetic polypeptide
  XENP019292 [CTLA-4]_H0.82_L0_Fab Heavy Chain
QVQLVESGGGVVQPGRSLRLSCAASGFTFSSYTMHWVRQAPGKGLEWVTFISYDGNNKYYADSVKDRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3740 - protein, 118 aa, Artificial Sequence; identical to SEQ ID NO: 922
  Description of Artificial Sequence: Synthetic polypeptide
  VH of XENP019292

SEQ ID NO: 3741 - protein, 5 aa, Artificial Sequence
  Description of Artificial Sequence: Synthetic peptide
  XENP019292 vhCDR1
SYTMH

SEQ ID NO: 3742 - protein, 17 aa, Artificial Sequence
  Description of Artificial Sequence: Synthetic peptide
  XENP019292 vhCDR2
FISYDGNNKYYADSVKD

SEQ ID NO: 3743 - protein, 9 aa, Artificial Sequence
  Description of Artificial Sequence: Synthetic peptide
  XENP019292 vhCDR3
TGWLGPFDY

SEQ ID NO: 3744 - protein, 215 aa, Artificial Sequence; identical to SEQ ID NO: 2924
  Description of Artificial Sequence: Synthetic polypeptide
  XENP019292 [CTLA-4]_H0.82_L0_Fab Light Chain

SEQ ID NO: 3745 - protein, 108 aa, Artificial Sequence; identical to SEQ ID NO: 23
  Description of Artificial Sequence: Synthetic polypeptide
  VL of XENP019292

SEQ ID NO: 3746 - protein, 12 aa, Artificial Sequence
  Description of Artificial Sequence: Synthetic peptide
  XENP019292 vlCDR1
RASQSVGSSYLA

SEQ ID NO: 3747 - protein, 7 aa, Artificial Sequence
  Description of Artificial Sequence: Synthetic peptide
  XENP019292 vlCDR2
GAFSRAT

SEQ ID NO: 3748 - protein, 9 aa, Artificial Sequence
  Description of Artificial Sequence: Synthetic peptide
  XENP019292 vlCDR3
QQYGSSPWT

SEQ ID NO: 3749 - protein, 221 aa, Artificial Sequence
  Description of Artificial Sequence: Synthetic polypeptide
  XENP019293 [CTLA-4]_H0.83_L0_Fab Heavy Chain
QVQLVESGGGVVQPGRSLRLSCAASGFTFSSYTMHWVRQAPGKGLEWVTFISYDGNNKYYADSVKERFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3750 - protein, 118 aa, Artificial Sequence; identical to SEQ ID NO: 931
  Description of Artificial Sequence: Synthetic polypeptide
  VH of XENP019293

SEQ ID NO: 3751 - protein, 5 aa, Artificial Sequence
  Description of Artificial Sequence: Synthetic peptide
  XENP019293 vhCDR1
SYTMH

SEQ ID NO: 3752 - protein, 17 aa, Artificial Sequence
  Description of Artificial Sequence: Synthetic peptide
  XENP019293 vhCDR2
FISYDGNNKYYADSVKE

SEQ ID NO: 3753 - protein, 9 aa, Artificial Sequence
  Description of Artificial Sequence: Synthetic peptide
  XENP019293 vhCDR3
TGWLGPFDY

SEQ ID NO: 3754 - protein, 215 aa, Artificial Sequence; identical to SEQ ID NO: 2924
  Description of Artificial Sequence: Synthetic polypeptide
  XENP019293 [CTLA-4]_H0.83_L0_Fab Light Chain

SEQ ID NO: 3755 - protein, 108 aa, Artificial Sequence; identical to SEQ ID NO: 23
  Description of Artificial Sequence: Synthetic polypeptide
  VL of XENP019293

SEQ ID NO: 3756 - protein, 12 aa, Artificial Sequence
  Description of Artificial Sequence: Synthetic peptide
  XENP019293 vlCDR1
RASQSVGSSYLA

SEQ ID NO: 3757 - protein, 7 aa, Artificial Sequence
  Description of Artificial Sequence: Synthetic peptide
  XENP019293 vlCDR2
GAFSRAT

SEQ ID NO: 3758 - protein, 9 aa, Artificial Sequence
  Description of Artificial Sequence: Synthetic peptide
  XENP019293 vlCDR3
QQYGSSPWT

SEQ ID NO: 3759 - protein, 221 aa, Artificial Sequence
  Description of Artificial Sequence: Synthetic polypeptide
  XENP019294 [CTLA-4]_H0.84_L0_Fab Heavy Chain
QVQLVESGGGVVQPGRSLRLSCAASGFTFSSYTMHWVRQAPGKGLEWVTFISYDGNNKYYADSVKGQFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3760 - protein, 118 aa, Artificial Sequence; identical to SEQ ID NO: 940
  Description of Artificial Sequence: Synthetic polypeptide
  VH of XENP019294

SEQ ID NO: 3761 - protein, 5 aa, Artificial Sequence
  Description of Artificial Sequence: Synthetic peptide
  XENP019294 vhCDR1
SYTMH

SEQ ID NO: 3762 - protein, 17 aa, Artificial Sequence
  Description of Artificial Sequence: Synthetic peptide
  XENP019294 vhCDR2
FISYDGNNKYYADSVKG

SEQ ID NO: 3763 - protein, 9 aa, Artificial Sequence
  Description of Artificial Sequence: Synthetic peptide
  XENP019294 vhCDR3
TGWLGPFDY

SEQ ID NO: 3764 - protein, 215 aa, Artificial Sequence; identical to SEQ ID NO: 2924
  Description of Artificial Sequence: Synthetic polypeptide
  XENP019294 [CTLA-4]_H0.84_L0_Fab Light Chain

SEQ ID NO: 3765 - protein, 108 aa, Artificial Sequence; identical to SEQ ID NO: 23
  Description of Artificial Sequence: Synthetic polypeptide
  VL of XENP019294

SEQ ID NO: 3766 - protein, 12 aa, Artificial Sequence
  Description of Artificial Sequence: Synthetic peptide
  XENP019294 vlCDR1
RASQSVGSSYLA

SEQ ID NO: 3767 - protein, 7 aa, Artificial Sequence
  Description of Artificial Sequence: Synthetic peptide
  XENP019294 vlCDR2
GAFSRAT

SEQ ID NO: 3768 - protein, 9 aa, Artificial Sequence
  Description of Artificial Sequence: Synthetic peptide
  XENP019294 vlCDR3
QQYGSSPWT

SEQ ID NO: 3769 - protein, 221 aa, Artificial Sequence
  Description of Artificial Sequence: Synthetic polypeptide
  XENP019295 [CTLA-4]_H0.85_L0_Fab Heavy Chain
QVQLVESGGGVVQPGRSLRLSCAASGFTFSSYTMHWVRQAPGKGLEWVTFISYDGNNKYYADSVKGRFTMSRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3770 - protein, 118 aa, Artificial Sequence; identical to SEQ ID NO: 949
  Description of Artificial Sequence: Synthetic polypeptide
  VH of XENP019295

SEQ ID NO: 3771 - protein, 5 aa, Artificial Sequence
  Description of Artificial Sequence: Synthetic peptide
  XENP019295 vhCDR1
SYTMH

SEQ ID NO: 3772 - protein, 17 aa, Artificial Sequence
  Description of Artificial Sequence: Synthetic peptide
  XENP019295 vhCDR2
FISYDGNNKYYADSVKG

SEQ ID NO: 3773 - protein, 9 aa, Artificial Sequence
  Description of Artificial Sequence: Synthetic peptide
  XENP019295 vhCDR3
TGWLGPFDY

SEQ ID NO: 3774 - protein, 215 aa, Artificial Sequence; identical to SEQ ID NO: 2924
  Description of Artificial Sequence: Synthetic polypeptide
  XENP019295 [CTLA-4]_H0.85_L0_Fab Light Chain

SEQ ID NO: 3775 - protein, 108 aa, Artificial Sequence; identical to SEQ ID NO: 23
  Description of Artificial Sequence: Synthetic polypeptide
  VL of XENP019295

SEQ ID NO: 3776 - protein, 12 aa, Artificial Sequence
  Description of Artificial Sequence: Synthetic peptide
  XENP019295 vlCDR1
RASQSVGSSYLA

SEQ ID NO: 3777 - protein, 7 aa, Artificial Sequence
  Description of Artificial Sequence: Synthetic peptide
  XENP019295 vlCDR2
GAFSRAT

SEQ ID NO: 3778 - protein, 9 aa, Artificial Sequence
  Description of Artificial Sequence: Synthetic peptide
  XENP019295 vlCDR3
QQYGSSPWT

SEQ ID NO: 3779 - protein, 221 aa, Artificial Sequence
  Description of Artificial Sequence: Synthetic polypeptide
  XENP019296 [CTLA-4]_H0.86_L0_Fab Heavy Chain
QVQLVESGGGVVQPGRSLRLSCAASGFTFSSYTMHWVRQAPGKGLEWVTFISYDGNNKYYADSVKGRFTVSRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3780 - protein, 118 aa, Artificial Sequence; identical to SEQ ID NO: 958
  Description of Artificial Sequence: Synthetic polypeptide
  VH of XENP019296

SEQ ID NO: 3781 - protein, 5 aa, Artificial Sequence
  Description of Artificial Sequence: Synthetic peptide
  XENP019296 vhCDR1
SYTMH

SEQ ID NO: 3782 - protein, 17 aa, Artificial Sequence
  Description of Artificial Sequence: Synthetic peptide
  XENP019296 vhCDR2
FISYDGNNKYYADSVKG

SEQ ID NO: 3783 - protein, 9 aa, Artificial Sequence
  Description of Artificial Sequence: Synthetic peptide
  XENP019296 vhCDR3
TGWLGPFDY

SEQ ID NO: 3784 - protein, 215 aa, Artificial Sequence; identical to SEQ ID NO: 2924
  Description of Artificial Sequence: Synthetic polypeptide
  XENP019296 [CTLA-4]_H0.86_L0_Fab Light Chain

SEQ ID NO: 3785 - protein, 108 aa, Artificial Sequence; identical to SEQ ID NO: 23
  Description of Artificial Sequence: Synthetic polypeptide
  VL of XENP019296

SEQ ID NO: 3786 - protein, 12 aa, Artificial Sequence
  Description of Artificial Sequence: Synthetic peptide
  XENP019296 vlCDR1
RASQSVGSSYLA

SEQ ID NO: 3787 - protein, 7 aa, Artificial Sequence
  Description of Artificial Sequence: Synthetic peptide
  XENP019296 vlCDR2
GAFSRAT

SEQ ID NO: 3788 - protein, 9 aa, Artificial Sequence
  Description of Artificial Sequence: Synthetic peptide
  XENP019296 vlCDR3
QQYGSSPWT

SEQ ID NO: 3789 - protein, 221 aa, Artificial Sequence
  Description of Artificial Sequence: Synthetic polypeptide
  XENP019301 [CTLA-4]_H0.87_L0_Fab Heavy Chain
QVQLVESGGGVVQPGRSLRLSCAASGFTFSSYTMHWVRQAPGKGLEWVTFISYDGNNKYYADSVKGRFTISEDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3790 - protein, 118 aa, Artificial Sequence; identical to SEQ ID NO: 967
  Description of Artificial Sequence: Synthetic polypeptide
  VH of XENP019301

SEQ ID NO: 3791 - protein, 5 aa, Artificial Sequence
  Description of Artificial Sequence: Synthetic peptide
  XENP019301 vhCDR1
SYTMH

SEQ ID NO: 3792 - protein, 17 aa, Artificial Sequence
  Description of Artificial Sequence: Synthetic peptide
  XENP019301 vhCDR2
FISYDGNNKYYADSVKG

SEQ ID NO: 3793 - protein, 9 aa, Artificial Sequence
  Description of Artificial Sequence: Synthetic peptide
  XENP019301 vhCDR3
TGWLGPFDY

SEQ ID NO: 3794 - protein, 215 aa, Artificial Sequence; identical to SEQ ID NO: 2924
  Description of Artificial Sequence: Synthetic polypeptide
  XENP019301 [CTLA-4]_H0.87_L0_Fab Light Chain

SEQ ID NO: 3795 - protein, 108 aa, Artificial Sequence; identical to SEQ ID NO: 23
  Description of Artificial Sequence: Synthetic polypeptide
  VL of XENP019301

SEQ ID NO: 3796 - protein, 12 aa, Artificial Sequence
  Description of Artificial Sequence: Synthetic peptide
  XENP019301 vlCDR1
RASQSVGSSYLA

SEQ ID NO: 3797 - protein, 7 aa, Artificial Sequence
  Description of Artificial Sequence: Synthetic peptide
  XENP019301 vlCDR2
GAFSRAT

SEQ ID NO: 3798 - protein, 9 aa, Artificial Sequence
  Description of Artificial Sequence: Synthetic peptide
  XENP019301 vlCDR3
QQYGSSPWT

SEQ ID NO: 3799 - protein, 221 aa, Artificial Sequence
  Description of Artificial Sequence: Synthetic polypeptide
  XENP019302 [CTLA-4]_H0.88_L0_Fab Heavy Chain
QVQLVESGGGVVQPGRSLRLSCAASGFTFSSYTMHWVRQAPGKGLEWVTFISYDGNNKYYADSVKGRFTISRENSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3800 - protein, 118 aa, Artificial Sequence; identical to SEQ ID NO: 976
  Description of Artificial Sequence: Synthetic polypeptide
  VH of XENP019302

SEQ ID NO: 3801 - protein, 5 aa, Artificial Sequence
  Description of Artificial Sequence: Synthetic peptide
  XENP019302 vhCDR1
SYTMH

SEQ ID NO: 3802 - protein, 17 aa, Artificial Sequence
  Description of Artificial Sequence: Synthetic peptide
  XENP019302 vhCDR2
FISYDGNNKYYADSVKG

SEQ ID NO: 3803 - protein, 9 aa, Artificial Sequence
  Description of Artificial Sequence: Synthetic peptide
  XENP019302 vhCDR3
TGWLGPFDY

SEQ ID NO: 3804 - protein, 215 aa, Artificial Sequence; identical to SEQ ID NO: 2924
  Description of Artificial Sequence: Synthetic polypeptide
  XENP019302 [CTLA-4]_H0.88_L0_Fab Light Chain

SEQ ID NO: 3805 - protein, 108 aa, Artificial Sequence; identical to SEQ ID NO: 23
  Description of Artificial Sequence: Synthetic polypeptide
  VL of XENP019302

SEQ ID NO: 3806 - protein, 12 aa, Artificial Sequence
  Description of Artificial Sequence: Synthetic peptide
  XENP019302 vlCDR1
RASQSVGSSYLA

SEQ ID NO: 3807 - protein, 7 aa, Artificial Sequence
  Description of Artificial Sequence: Synthetic peptide
  XENP019302 vlCDR2
GAFSRAT

SEQ ID NO: 3808 - protein, 9 aa, Artificial Sequence
  Description of Artificial Sequence: Synthetic peptide
  XENP019302 vlCDR3
QQYGSSPWT

SEQ ID NO: 3809 - protein, 221 aa, Artificial Sequence
  Description of Artificial Sequence: Synthetic polypeptide
  XENP019303 [CTLA-4]_H0.89_L0_Fab Heavy Chain
QVQLVESGGGVVQPGRSLRLSCAASGFTFSSYTMHWVRQAPGKGLEWVTFISYDGNNKYYADSVKGRFTISRDDSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3810 - protein, 118 aa, Artificial Sequence; identical to SEQ ID NO: 985
  Description of Artificial Sequence: Synthetic polypeptide
  VH of XENP019303

SEQ ID NO: 3811 - protein, 5 aa, Artificial Sequence
  Description of Artificial Sequence: Synthetic peptide
  XENP019303 vhCDR1
SYTMH

SEQ ID NO: 3812 - protein, 17 aa, Artificial Sequence
  Description of Artificial Sequence: Synthetic peptide
  XENP019303 vhCDR2
FISYDGNNKYYADSVKG

SEQ ID NO: 3813 - protein, 9 aa, Artificial Sequence
  Description of Artificial Sequence: Synthetic peptide
  XENP019303 vhCDR3
TGWLGPFDY

SEQ ID NO: 3814 - protein, 215 aa, Artificial Sequence; identical to SEQ ID NO: 2924
  Description of Artificial Sequence: Synthetic polypeptide
  XENP019303 [CTLA-4]_H0.89_L0_Fab Light Chain

SEQ ID NO: 3815 - protein, 108 aa, Artificial Sequence; identical to SEQ ID NO: 23
  Description of Artificial Sequence: Synthetic polypeptide
  VL of XENP019303

SEQ ID NO: 3816 - protein, 12 aa, Artificial Sequence
  Description of Artificial Sequence: Synthetic peptide
  XENP019303 vlCDR1
RASQSVGSSYLA

SEQ ID NO: 3817 - protein, 7 aa, Artificial Sequence
  Description of Artificial Sequence: Synthetic peptide
  XENP019303 vlCDR2
GAFSRAT

SEQ ID NO: 3818 - protein, 9 aa, Artificial Sequence
  Description of Artificial Sequence: Synthetic peptide
  XENP019303 vlCDR3
QQYGSSPWT

SEQ ID NO: 3819 - protein, 221 aa, Artificial Sequence
  Description of Artificial Sequence: Synthetic polypeptide
  XENP019304 [CTLA-4]_H0.90_L0_Fab Heavy Chain
QVQLVESGGGVVQPGRSLRLSCAASGFTFSSYTMHWVRQAPGKGLEWVTFISYDGNNKYYADSVKGRFTISRDNAKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3820 - protein, 118 aa, Artificial Sequence; identical to SEQ ID NO: 994
  Description of Artificial Sequence: Synthetic polypeptide
  VH of XENP019304

SEQ ID NO: 3821 - protein, 5 aa, Artificial Sequence
  Description of Artificial Sequence: Synthetic peptide
  XENP019304 vhCDR1
SYTMH

SEQ ID NO: 3822 - protein, 17 aa, Artificial Sequence
  Description of Artificial Sequence: Synthetic peptide
  XENP019304 vhCDR2
FISYDGNNKYYADSVKG

SEQ ID NO: 3823 - protein, 9 aa, Artificial Sequence
  Description of Artificial Sequence: Synthetic peptide
  XENP019304 vhCDR3
TGWLGPFDY

SEQ ID NO: 3824 - protein, 215 aa, Artificial Sequence; identical to SEQ ID NO: 2924
  Description of Artificial Sequence: Synthetic polypeptide
  XENP019304 [CTLA-4]_H0.90_L0_Fab Light Chain

SEQ ID NO: 3825 - protein, 108 aa, Artificial Sequence; identical to SEQ ID NO: 23
  Description of Artificial Sequence: Synthetic polypeptide
  VL of XENP019304

SEQ ID NO: 3826 - protein, 12 aa, Artificial Sequence
  Description of Artificial Sequence: Synthetic peptide
  XENP019304 vlCDR1
RASQSVGSSYLA

SEQ ID NO: 3827 - protein, 7 aa, Artificial Sequence
  Description of Artificial Sequence: Synthetic peptide
  XENP019304 vlCDR2
GAFSRAT

SEQ ID NO: 3828 - protein, 9 aa, Artificial Sequence
  Description of Artificial Sequence: Synthetic peptide
  XENP019304 vlCDR3
QQYGSSPWT

SEQ ID NO: 3829 - protein, 221 aa, Artificial Sequence
  Description of Artificial Sequence: Synthetic polypeptide
  XENP019305 [CTLA-4]_H0.91_L0_Fab Heavy Chain
QVQLVESGGGVVQPGRSLRLSCAASGFTFSSYTMHWVRQAPGKGLEWVTFISYDGNNKYYADSVKGRFTISRDNSRNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3830 - protein, 118 aa, Artificial Sequence; identical to SEQ ID NO: 1003
  Description of Artificial Sequence: Synthetic polypeptide
  VH of XENP019305

SEQ ID NO: 3831 - protein, 5 aa, Artificial Sequence
  Description of Artificial Sequence: Synthetic peptide
  XENP019305 vhCDR1
SYTMH

SEQ ID NO: 3832 - protein, 17 aa, Artificial Sequence
  Description of Artificial Sequence: Synthetic peptide
  XENP019305 vhCDR2
FISYDGNNKYYADSVKG

SEQ ID NO: 3833 - protein, 9 aa, Artificial Sequence
  Description of Artificial Sequence: Synthetic peptide
  XENP019305 vhCDR3
TGWLGPFDY

SEQ ID NO: 3834 - protein, 215 aa, Artificial Sequence; identical to SEQ ID NO: 2924
  Description of Artificial Sequence: Synthetic polypeptide
  XENP019305 [CTLA-4]_H0.91_L0_Fab Light Chain

SEQ ID NO: 3835 - protein, 108 aa, Artificial Sequence; identical to SEQ ID NO: 23
  Description of Artificial Sequence: Synthetic polypeptide
  VL of XENP019305

SEQ ID NO: 3836 - protein, 12 aa, Artificial Sequence
  Description of Artificial Sequence: Synthetic peptide
  XENP019305 vlCDR1
RASQSVGSSYLA

SEQ ID NO: 3837 - protein, 7 aa, Artificial Sequence
  Description of Artificial Sequence: Synthetic peptide
  XENP019305 vlCDR2
GAFSRAT

SEQ ID NO: 3838 - protein, 9 aa, Artificial Sequence
  Description of Artificial Sequence: Synthetic peptide
  XENP019305 vlCDR3
QQYGSSPWT

SEQ ID NO: 3839 - protein, 221 aa, Artificial Sequence
  Description of Artificial Sequence: Synthetic polypeptide
  XENP019306 [CTLA-4]_H0.92_L0_Fab Heavy Chain
QVQLVESGGGVVQPGRSLRLSCAASGFTFSSYTMHWVRQAPGKGLEWVTFISYDGNNKYYADSVKGRFTISRDNSKNSLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3840 - protein, 118 aa, Artificial Sequence; identical to SEQ ID NO: 1012
  Description of Artificial Sequence: Synthetic polypeptide
  VH of XENP019306

SEQ ID NO: 3841 - protein, 5 aa, Artificial Sequence
  Description of Artificial Sequence: Synthetic peptide
  XENP019306 vhCDR1
SYTMH

SEQ ID NO: 3842 - protein, 17 aa, Artificial Sequence
  Description of Artificial Sequence: Synthetic peptide
  XENP019306 vhCDR2
FISYDGNNKYYADSVKG

SEQ ID NO: 3843 - protein, 9 aa, Artificial Sequence
  Description of Artificial Sequence: Synthetic peptide
  XENP019306 vhCDR3
TGWLGPFDY

SEQ ID NO: 3844 - protein, 215 aa, Artificial Sequence; identical to SEQ ID NO: 2924
  Description of Artificial Sequence: Synthetic polypeptide
  XENP019306 [CTLA-4]_H0.92_L0_Fab Light Chain

SEQ ID NO: 3845 - protein, 108 aa, Artificial Sequence; identical to SEQ ID NO: 23
  Description of Artificial Sequence: Synthetic polypeptide
  VL of XENP019306

SEQ ID NO: 3846 - protein, 12 aa, Artificial Sequence
  Description of Artificial Sequence: Synthetic peptide
  XENP019306 vlCDR1
RASQSVGSSYLA

SEQ ID NO: 3847 - protein, 7 aa, Artificial Sequence
  Description of Artificial Sequence: Synthetic peptide
  XENP019306 vlCDR2
GAFSRAT

SEQ ID NO: 3848 - protein, 9 aa, Artificial Sequence
  Description of Artificial Sequence: Synthetic peptide
  XENP019306 vlCDR3
QQYGSSPWT

SEQ ID NO: 3849 - protein, 221 aa, Artificial Sequence
  Description of Artificial Sequence: Synthetic polypeptide
  XENP019307 [CTLA-4]_H0.93_L0_Fab Heavy Chain
QVQLVESGGGVVQPGRSLRLSCAASGFTFSSYTMHWVRQAPGKGLEWVTFISYDGNNKYYADSVKGRFTISRDNSKNQLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3850 - protein, 118 aa, Artificial Sequence; identical to SEQ ID NO: 1021
  Description of Artificial Sequence: Synthetic polypeptide
  VH of XENP019307

SEQ ID NO: 3851 - protein, 5 aa, Artificial Sequence
  Description of Artificial Sequence: Synthetic peptide
  XENP019307 vhCDR1
SYTMH

SEQ ID NO: 3852 - protein, 17 aa, Artificial Sequence
  Description of Artificial Sequence: Synthetic peptide
  XENP019307 vhCDR2
FISYDGNNKYYADSVKG

SEQ ID NO: 3853 - protein, 9 aa, Artificial Sequence
  Description of Artificial Sequence: Synthetic peptide
  XENP019307 vhCDR3
TGWLGPFDY

SEQ ID NO: 3854 - protein, 215 aa, Artificial Sequence; identical to SEQ ID NO: 2924
  Description of Artificial Sequence: Synthetic polypeptide
  XENP019307 [CTLA-4]_H0.93_L0_Fab Light Chain

SEQ ID NO: 3855 - protein, 108 aa, Artificial Sequence; identical to SEQ ID NO: 23
  Description of Artificial Sequence: Synthetic polypeptide
  VL of XENP019307

SEQ ID NO: 3856 - protein, 12 aa, Artificial Sequence
  Description of Artificial Sequence: Synthetic peptide
  XENP019307 vlCDR1
RASQSVGSSYLA

SEQ ID NO: 3857 - protein, 7 aa, Artificial Sequence
  Description of Artificial Sequence: Synthetic peptide
  XENP019307 vlCDR2
GAFSRAT

SEQ ID NO: 3858 - protein, 9 aa, Artificial Sequence
  Description of Artificial Sequence: Synthetic peptide
  XENP019307 vlCDR3
QQYGSSPWT

SEQ ID NO: 3859 - protein, 221 aa, Artificial Sequence
  Description of Artificial Sequence: Synthetic polypeptide
  XENP019308 [CTLA-4]_H0.94_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLEMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3860 - protein, 118 aa, Artificial Sequence; identical to SEQ ID NO: 1030
  Description of Artificial Sequence: Synthetic polypeptide
  VH of XENP019308

SEQ ID NO: 3861 - protein, 5 aa, Artificial Sequence
  Description of Artificial Sequence: Synthetic peptide
  XENP019308 vhCDR1
SYTMH

SEQ ID NO: 3862 - protein, 17 aa, Artificial Sequence
  Description of Artificial Sequence: Synthetic peptide
  XENP019308 vhCDR2
FISYDGNNKYYADSVKG

SEQ ID NO: 3863 - protein, 9 aa, Artificial Sequence
  Description of Artificial Sequence: Synthetic peptide
  XENP019308 vhCDR3
TGWLGPFDY

SEQ ID NO: 3864 - protein, 215 aa, Artificial Sequence; identical to SEQ ID NO: 2924
  Description of Artificial Sequence: Synthetic polypeptide
  XENP019308 [CTLA-4]_H0.94_L0_Fab Light Chain

SEQ ID NO: 3865 - protein, 108 aa, Artificial Sequence; identical to SEQ ID NO: 23
  Description of Artificial Sequence: Synthetic polypeptide
  VL of XENP019308

SEQ ID NO: 3866 - protein, 12 aa, Artificial Sequence
  Description of Artificial Sequence: Synthetic peptide
  XENP019308 vlCDR1
RASQSVGSSYLA

SEQ ID NO: 3867 - protein, 7 aa, Artificial Sequence
  Description of Artificial Sequence: Synthetic peptide
  XENP019308 vlCDR2
GAFSRAT

SEQ ID NO: 3868 - protein, 9 aa, Artificial Sequence
  Description of Artificial Sequence: Synthetic peptide
  XENP019308 vlCDR3
QQYGSSPWT

SEQ ID NO: 3869 - protein, 221 aa, Artificial Sequence
  Description of Artificial Sequence: Synthetic polypeptide
  XENP019309 [CTLA-4]_H0.95_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMDSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3870 - protein, 118 aa, Artificial Sequence; identical to SEQ ID NO: 1039
  Description of Artificial Sequence: Synthetic polypeptide
  VH of XENP019309

SEQ ID NO: 3871 - protein, 5 aa, Artificial Sequence
  Description of Artificial Sequence: Synthetic peptide
  XENP019309 vhCDR1
SYTMH

SEQ ID NO: 3872 - protein, 17 aa, Artificial Sequence
  Description of Artificial Sequence: Synthetic peptide
  XENP019309 vhCDR2
FISYDGNNKYYADSVKG

SEQ ID NO: 3873 - protein, 9 aa, Artificial Sequence
  Description of Artificial Sequence: Synthetic peptide
  XENP019309 vhCDR3
TGWLGPFDY

SEQ ID NO: 3874 - protein, 215 aa, Artificial Sequence; identical to SEQ ID NO: 2924
  Description of Artificial Sequence: Synthetic polypeptide
  XENP019309 [CTLA-4]_H0.95_L0_Fab Light Chain

SEQ ID NO: 3875 - protein, 108 aa, Artificial Sequence; identical to SEQ ID NO: 23
  Description of Artificial Sequence: Synthetic polypeptide
  VL of XENP019309

SEQ ID NO: 3876 - protein, 12 aa, Artificial Sequence
  Description of Artificial Sequence: Synthetic peptide
  XENP019309 vlCDR1
RASQSVGSSYLA

SEQ ID NO: 3877 - protein, 7 aa, Artificial Sequence
  Description of Artificial Sequence: Synthetic peptide
  XENP019309 vlCDR2
GAFSRAT

SEQ ID NO: 3878 - protein, 9 aa, Artificial Sequence
  Description of Artificial Sequence: Synthetic peptide
  XENP019309 vlCDR3
QQYGSSPWT

SEQ ID NO: 3879 - protein, 221 aa, Artificial Sequence
  Description of Artificial Sequence: Synthetic polypeptide
  XENP019310 [CTLA-4]_H0.96_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNDLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3880 - protein, 118 aa, Artificial Sequence; identical to SEQ ID NO: 1048
  Description of Artificial Sequence: Synthetic polypeptide
  VH of XENP019310

SEQ ID NO: 3881 - protein, 5 aa, Artificial Sequence
  Description of Artificial Sequence: Synthetic peptide
  XENP019310 vhCDR1
SYTMH

SEQ ID NO: 3882 - protein, 17 aa, Artificial Sequence
  Description of Artificial Sequence: Synthetic peptide
  XENP019310 vhCDR2
FISYDGNNKYYADSVKG

SEQ ID NO: 3883 - protein, 9 aa, Artificial Sequence
  Description of Artificial Sequence: Synthetic peptide
  XENP019310 vhCDR3
TGWLGPFDY

SEQ ID NO: 3884 - protein, 215 aa, Artificial Sequence; identical to SEQ ID NO: 2924
  Description of Artificial Sequence: Synthetic polypeptide
  XENP019310 [CTLA-4]_H0.96_L0_Fab Light Chain

SEQ ID NO: 3885 - protein, 108 aa, Artificial Sequence; identical to SEQ ID NO: 23
  Description of Artificial Sequence: Synthetic polypeptide
  VL of XENP019310

SEQ ID NO: 3886 - protein, 12 aa, Artificial Sequence
  Description of Artificial Sequence: Synthetic peptide
  XENP019310 vlCDR1
RASQSVGSSYLA

SEQ ID NO: 3887 - protein, 7 aa, Artificial Sequence
  Description of Artificial Sequence: Synthetic peptide
  XENP019310 vlCDR2
GAFSRAT

SEQ ID NO: 3888 - protein, 9 aa, Artificial Sequence
  Description of Artificial Sequence: Synthetic peptide
  XENP019310 vlCDR3
QQYGSSPWT

SEQ ID NO: 3889 - protein, 221 aa, Artificial Sequence
  Description of Artificial Sequence: Synthetic polypeptide
  XENP019311 [CTLA-4]_H0.97_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRTEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3890 - protein, 118 aa, Artificial Sequence; identical to SEQ ID NO: 1057
  Description of Artificial Sequence: Synthetic polypeptide
  VH of XENP019311

SEQ ID NO: 3891 - protein, 5 aa, Artificial Sequence
  Description of Artificial Sequence: Synthetic peptide
  XENP019311 vhCDR1
SYTMH

SEQ ID NO: 3892 - protein, 17 aa, Artificial Sequence
  Description of Artificial Sequence: Synthetic peptide
  XENP019311 vhCDR2
FISYDGNNKYYADSVKG

SEQ ID NO: 3893 - protein, 9 aa, Artificial Sequence
  Description of Artificial Sequence: Synthetic peptide
  XENP019311 vhCDR3
TGWLGPFDY

SEQ ID NO: 3894 - protein, 215 aa, Artificial Sequence; identical to SEQ ID NO: 2924
  Description of Artificial Sequence: Synthetic polypeptide
  XENP019311 [CTLA-4]_H0.97_L0_Fab Light Chain

SEQ ID NO: 3895 - protein, 108 aa, Artificial Sequence; identical to SEQ ID NO: 23
  Description of Artificial Sequence: Synthetic polypeptide
  VL of XENP019311

SEQ ID NO: 3896 - protein, 12 aa, Artificial Sequence
  Description of Artificial Sequence: Synthetic peptide
  XENP019311 vlCDR1
RASQSVGSSYLA

SEQ ID NO: 3897 - protein, 7 aa, Artificial Sequence
  Description of Artificial Sequence: Synthetic peptide
  XENP019311 vlCDR2
GAFSRAT

SEQ ID NO: 3898 - protein, 9 aa, Artificial Sequence
  Description of Artificial Sequence: Synthetic peptide
  XENP019311 vlCDR3
QQYGSSPWT

SEQ ID NO: 3899 - protein, 221 aa, Artificial Sequence
  Description of Artificial Sequence: Synthetic polypeptide
  XENP019312 [CTLA-4]_H0.98_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTALYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3900 - protein, 118 aa, Artificial Sequence; identical to SEQ ID NO: 1066
  Description of Artificial Sequence: Synthetic polypeptide
  VH of XENP019312

SEQ ID NO: 3901 - protein, 5 aa, Artificial Sequence
  Description of Artificial Sequence: Synthetic peptide
  XENP019312 vhCDR1
SYTMH

SEQ ID NO: 3902 - protein, 17 aa, Artificial Sequence
  Description of Artificial Sequence: Synthetic peptide
  XENP019312 vhCDR2
FISYDGNNKYYADSVKG

SEQ ID NO: 3903 - protein, 9 aa, Artificial Sequence
  Description of Artificial Sequence: Synthetic peptide
  XENP019312 vhCDR3
TGWLGPFDY

SEQ ID NO: 3904 - protein, 215 aa, Artificial Sequence; identical to SEQ ID NO: 2924
  Description of Artificial Sequence: Synthetic polypeptide
  XENP019312 [CTLA-4]_H0.98_L0_Fab Light Chain

SEQ ID NO: 3905 - protein, 108 aa, Artificial Sequence; identical to SEQ ID NO: 23
  Description of Artificial Sequence: Synthetic polypeptide
  VL of XENP019312

SEQ ID NO: 3906 - protein, 12 aa, Artificial Sequence
  Description of Artificial Sequence: Synthetic peptide
  XENP019312 vlCDR1
RASQSVGSSYLA

SEQ ID NO: 3907 - protein, 7 aa, Artificial Sequence
  Description of Artificial Sequence: Synthetic peptide
  XENP019312 vlCDR2
GAFSRAT

SEQ ID NO: 3908 - protein, 9 aa, Artificial Sequence
  Description of Artificial Sequence: Synthetic peptide
  XENP019312 vlCDR3
QQYGSSPWT

SEQ ID NO: 3909 - protein, 221 aa, Artificial Sequence
  Description of Artificial Sequence: Synthetic polypeptide
  XENP019313 [CTLA-4]_H0.99_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3910 - protein, 118 aa, Artificial Sequence; identical to SEQ ID NO: 1075
  Description of Artificial Sequence: Synthetic polypeptide
  VH of XENP019313

SEQ ID NO: 3911 - protein, 5 aa, Artificial Sequence
  Description of Artificial Sequence: Synthetic peptide
  XENP019313 vhCDR1
SYTMH

SEQ ID NO: 3912 - protein, 17 aa, Artificial Sequence
  Description of Artificial Sequence: Synthetic peptide
  XENP019313 vhCDR2
FISYDGNNKYYADSVKG

SEQ ID NO: 3913 - protein, 9 aa, Artificial Sequence
  Description of Artificial Sequence: Synthetic peptide
  XENP019313 vhCDR3
TGWLGPFDY

SEQ ID NO: 3914 - protein, 215 aa, Artificial Sequence; identical to SEQ ID NO: 2924
  Description of Artificial Sequence: Synthetic polypeptide
  XENP019313 [CTLA-4]_H0.99_L0_Fab Light Chain

SEQ ID NO: 3915 - protein, 108 aa, Artificial Sequence; identical to SEQ ID NO: 23
  Description of Artificial Sequence: Synthetic polypeptide
  VL of XENP019313

SEQ ID NO: 3916 - protein, 12 aa, Artificial Sequence
  Description of Artificial Sequence: Synthetic peptide
  XENP019313 vlCDR1
RASQSVGSSYLA

SEQ ID NO: 3917 - protein, 7 aa, Artificial Sequence
  Description of Artificial Sequence: Synthetic peptide
  XENP019313 vlCDR2
GAFSRAT

SEQ ID NO: 3918 - protein, 9 aa, Artificial Sequence
  Description of Artificial Sequence: Synthetic peptide
  XENP019313 vlCDR3
QQYGSSPWT

SEQ ID NO: 3919 - protein, 221 aa, Artificial Sequence
  Description of Artificial Sequence: Synthetic polypeptide
  XENP019314 [CTLA-4]_H0.100_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCTRTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3920 - protein, 118 aa, Artificial Sequence; identical to SEQ ID NO: 1084
  Description of Artificial Sequence: Synthetic polypeptide
  VH of XENP019314

SEQ ID NO: 3921 - protein, 5 aa, Artificial Sequence
  Description of Artificial Sequence: Synthetic peptide
  XENP019314 vhCDR1
SYTMH

SEQ ID NO: 3922 - protein, 17 aa, Artificial Sequence
  Description of Artificial Sequence: Synthetic peptide
  XENP019314 vhCDR2
FISYDGNNKYYADSVKG

SEQ ID NO: 3923 - protein, 9 aa, Artificial Sequence
  Description of Artificial Sequence: Synthetic peptide
  XENP019314 vhCDR3
TGWLGPFDY

SEQ ID NO: 3924 - protein, 215 aa, Artificial Sequence; identical to SEQ ID NO: 2924
  Description of Artificial Sequence: Synthetic polypeptide
  XENP019314 [CTLA-4]_H0.100_L0_Fab Light Chain

SEQ ID NO: 3925 - protein, 108 aa, Artificial Sequence; identical to SEQ ID NO: 23
  Description of Artificial Sequence: Synthetic polypeptide
  VL of XENP019314

SEQ ID NO: 3926 - protein, 12 aa, Artificial Sequence
  Description of Artificial Sequence: Synthetic peptide
  XENP019314 vlCDR1
RASQSVGSSYLA

SEQ ID NO: 3927 - protein, 7 aa, Artificial Sequence
  Description of Artificial Sequence: Synthetic peptide
  XENP019314 vlCDR2
GAFSRAT

SEQ ID NO: 3928 - protein, 9 aa, Artificial Sequence
  Description of Artificial Sequence: Synthetic peptide
  XENP019314 vlCDR3
QQYGSSPWT

SEQ ID NO: 3929 - protein, 221 aa, Artificial Sequence
  Description of Artificial Sequence: Synthetic polypeptide
  XENP019315 [CTLA-4]_H0.101_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCAKTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3930 - protein, 118 aa, Artificial Sequence; identical to SEQ ID NO: 1093
  Description of Artificial Sequence: Synthetic polypeptide
  VH of XENP019315

SEQ ID NO: 3931 - protein, 5 aa, Artificial Sequence
  Description of Artificial Sequence: Synthetic peptide
  XENP019315 vhCDR1
SYTMH

SEQ ID NO: 3932 - protein, 17 aa, Artificial Sequence
  Description of Artificial Sequence: Synthetic peptide
  XENP019315 vhCDR2
FISYDGNNKYYADSVKG

SEQ ID NO: 3933 - protein, 9 aa, Artificial Sequence
  Description of Artificial Sequence: Synthetic peptide
  XENP019315 vhCDR3
TGWLGPFDY

SEQ ID NO: 3934 - protein, 215 aa, Artificial Sequence; identical to SEQ ID NO: 2924
  Description of Artificial Sequence: Synthetic polypeptide
  XENP019315 [CTLA-4]_H0.101_L0_Fab Light Chain

SEQ ID NO: 3935 - protein, 108 aa, Artificial Sequence; identical to SEQ ID NO: 23
  Description of Artificial Sequence: Synthetic polypeptide
  VL of XENP019315

SEQ ID NO: 3936 - protein, 12 aa, Artificial Sequence
  Description of Artificial Sequence: Synthetic peptide
  XENP019315 vlCDR1
RASQSVGSSYLA

SEQ ID NO: 3937 - protein, 7 aa, Artificial Sequence
  Description of Artificial Sequence: Synthetic peptide
  XENP019315 vlCDR2
GAFSRAT

SEQ ID NO: 3938 - protein, 9 aa, Artificial Sequence
  Description of Artificial Sequence: Synthetic peptide
  XENP019315 vlCDR3
QQYGSSPWT

SEQ ID NO: 3939 - protein, 221 aa, Artificial Sequence
  Description of Artificial Sequence: Synthetic polypeptide
  XENP019316 [CTLA-4]_H0.102_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARAGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3940 - protein, 118 aa, Artificial Sequence; identical to SEQ ID NO: 1102
  Description of Artificial Sequence: Synthetic polypeptide
  VH of XENP019316

SEQ ID NO: 3941 - protein, 5 aa, Artificial Sequence
  Description of Artificial Sequence: Synthetic peptide
  XENP019316 vhCDR1
SYTMH

SEQ ID NO: 3942 - protein, 17 aa, Artificial Sequence
  Description of Artificial Sequence: Synthetic peptide
  XENP019316 vhCDR2
FISYDGNNKYYADSVKG

SEQ ID NO: 3943 - protein, 9 aa, Artificial Sequence
  Description of Artificial Sequence: Synthetic peptide
  XENP019316 vhCDR3
AGWLGPFDY

SEQ ID NO: 3944 - protein, 215 aa, Artificial Sequence; identical to SEQ ID NO: 2924
  Description of Artificial Sequence: Synthetic polypeptide
  XENP019316 [CTLA-4]_H0.102_L0_Fab Light Chain

SEQ ID NO: 3945 - protein, 108 aa, Artificial Sequence; identical to SEQ ID NO: 23
  Description of Artificial Sequence: Synthetic polypeptide
  VL of XENP019316

SEQ ID NO: 3946 - protein, 12 aa, Artificial Sequence
  Description of Artificial Sequence: Synthetic peptide
  XENP019316 vlCDR1
RASQSVGSSYLA

SEQ ID NO: 3947 - protein, 7 aa, Artificial Sequence
  Description of Artificial Sequence: Synthetic peptide
  XENP019316 vlCDR2
GAFSRAT

SEQ ID NO: 3948 - protein, 9 aa, Artificial Sequence
  Description of Artificial Sequence: Synthetic peptide
  XENP019316 vlCDR3
QQYGSSPWT

SEQ ID NO: 3949 - protein, 221 aa, Artificial Sequence
  Description of Artificial Sequence: Synthetic polypeptide
  XENP019317 [CTLA-4]_H0.103_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARGGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3950 - protein, 118 aa, Artificial Sequence; identical to SEQ ID NO: 1111
  Description of Artificial Sequence: Synthetic polypeptide
  VH of XENP019317

SEQ ID NO: 3951 - protein, 5 aa, Artificial Sequence
  Description of Artificial Sequence: Synthetic peptide
  XENP019317 vhCDR1
SYTMH

SEQ ID NO: 3952 - protein, 17 aa, Artificial Sequence
  Description of Artificial Sequence: Synthetic peptide
  XENP019317 vhCDR2
FISYDGNNKYYADSVKG

SEQ ID NO: 3953 - protein, 9 aa, Artificial Sequence
  Description of Artificial Sequence: Synthetic peptide
  XENP019317 vhCDR3
GGWLGPFDY

SEQ ID NO: 3954 - protein, 215 aa, Artificial Sequence; identical to SEQ ID NO: 2924
  Description of Artificial Sequence: Synthetic polypeptide
  XENP019317 [CTLA-4]_H0.103_L0_Fab Light Chain

SEQ ID NO: 3955 - protein, 108 aa, Artificial Sequence; identical to SEQ ID NO: 23
  Description of Artificial Sequence: Synthetic polypeptide
  VL of XENP019317

SEQ ID NO: 3956 - protein, 12 aa, Artificial Sequence
  Description of Artificial Sequence: Synthetic peptide
  XENP019317 vlCDR1
RASQSVGSSYLA

SEQ ID NO: 3957 - protein, 7 aa, Artificial Sequence
  Description of Artificial Sequence: Synthetic peptide
  XENP019317 vlCDR2
GAFSRAT

SEQ ID NO: 3958 - protein, 9 aa, Artificial Sequence
  Description of Artificial Sequence: Synthetic peptide
  XENP019317 vlCDR3
QQYGSSPWT

SEQ ID NO: 3959 - protein, 221 aa, Artificial Sequence
  Description of Artificial Sequence: Synthetic polypeptide
  XENP019318 [CTLA-4]_H0.104_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARDGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3960 - protein, 118 aa, Artificial Sequence; identical to SEQ ID NO: 1120
  Description of Artificial Sequence: Synthetic polypeptide
  VH of XENP019318

SEQ ID NO: 3961 - protein, 5 aa, Artificial Sequence
  Description of Artificial Sequence: Synthetic peptide
  XENP019318 vhCDR1
SYTMH

SEQ ID NO: 3962 - protein, 17 aa, Artificial Sequence
  Description of Artificial Sequence: Synthetic peptide
  XENP019318 vhCDR2
FISYDGNNKYYADSVKG

SEQ ID NO: 3963 - protein, 9 aa, Artificial Sequence
  Description of Artificial Sequence: Synthetic peptide
  XENP019318 vhCDR3
DGWLGPFDY

SEQ ID NO: 3964 - protein, 215 aa, Artificial Sequence; identical to SEQ ID NO: 2924
  Description of Artificial Sequence: Synthetic polypeptide
  XENP019318 [CTLA-4]_H0.104_L0_Fab Light Chain

SEQ ID NO: 3965 - protein, 108 aa, Artificial Sequence; identical to SEQ ID NO: 23
  Description of Artificial Sequence: Synthetic polypeptide
  VL of XENP019318

SEQ ID NO: 3966 - protein, 12 aa, Artificial Sequence
  Description of Artificial Sequence: Synthetic peptide
  XENP019318 vlCDR1
RASQSVGSSYLA

SEQ ID NO: 3967 - protein, 7 aa, Artificial Sequence
  Description of Artificial Sequence: Synthetic peptide
  XENP019318 vlCDR2
GAFSRAT

SEQ ID NO: 3968 - protein, 9 aa, Artificial Sequence
  Description of Artificial Sequence: Synthetic peptide
  XENP019318 vlCDR3
QQYGSSPWT

SEQ ID NO: 3969 - protein, 221 aa, Artificial Sequence
  Description of Artificial Sequence: Synthetic polypeptide
  XENP019319 [CTLA-4]_H0.105_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARSGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3970 - protein, 118 aa, Artificial Sequence; identical to SEQ ID NO: 1129
  Description of Artificial Sequence: Synthetic polypeptide
  VH of XENP019319

SEQ ID NO: 3971 - protein, 5 aa, Artificial Sequence
  Description of Artificial Sequence: Synthetic peptide
  XENP019319 vhCDR1
SYTMH

SEQ ID NO: 3972 - protein, 17 aa, Artificial Sequence
  Description of Artificial Sequence: Synthetic peptide
  XENP019319 vhCDR2
FISYDGNNKYYADSVKG

SEQ ID NO: 3973 - protein, 9 aa, Artificial Sequence
  Description of Artificial Sequence: Synthetic peptide
  XENP019319 vhCDR3
SGWLGPFDY

SEQ ID NO: 3974 - protein, 215 aa, Artificial Sequence; identical to SEQ ID NO: 2924
  Description of Artificial Sequence: Synthetic polypeptide
  XENP019319 [CTLA-4]_H0.105_L0_Fab Light Chain

SEQ ID NO: 3975 - protein, 108 aa, Artificial Sequence; identical to SEQ ID NO: 23
  Description of Artificial Sequence: Synthetic polypeptide
  VL of XENP019319

SEQ ID NO: 3976 - protein, 12 aa, Artificial Sequence
  Description of Artificial Sequence: Synthetic peptide
  XENP019319 vlCDR1
RASQSVGSSYLA

SEQ ID NO: 3977 - protein, 7 aa, Artificial Sequence
  Description of Artificial Sequence: Synthetic peptide
  XENP019319 vlCDR2
GAFSRAT

SEQ ID NO: 3978 - protein, 9 aa, Artificial Sequence
  Description of Artificial Sequence: Synthetic peptide
  XENP019319 vlCDR3
QQYGSSPWT

SEQ ID NO: 3979 - protein, 221 aa, Artificial Sequence
  Description of Artificial Sequence: Synthetic polypeptide
  XENP019320 [CTLA-4]_H0.106_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARVGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3980 - protein, 118 aa, Artificial Sequence; identical to SEQ ID NO: 1138
  Description of Artificial Sequence: Synthetic polypeptide
  VH of XENP019320

SEQ ID NO: 3981 - protein, 5 aa, Artificial Sequence
  Description of Artificial Sequence: Synthetic peptide
  XENP019320 vhCDR1
SYTMH

SEQ ID NO: 3982 - protein, 17 aa, Artificial Sequence
  Description of Artificial Sequence: Synthetic peptide
  XENP019320 vhCDR2
FISYDGNNKYYADSVKG

SEQ ID NO: 3983 - protein, 9 aa, Artificial Sequence
  Description of Artificial Sequence: Synthetic peptide
  XENP019320 vhCDR3
VGWLGPFDY

SEQ ID NO: 3984 - protein, 215 aa, Artificial Sequence; identical to SEQ ID NO: 2924
  Description of Artificial Sequence: Synthetic polypeptide
  XENP019320 [CTLA-4]_H0.106_L0_Fab Light Chain

SEQ ID NO: 3985 - protein, 108 aa, Artificial Sequence; identical to SEQ ID NO: 23
  Description of Artificial Sequence: Synthetic polypeptide
  VL of XENP019320

SEQ ID NO: 3986 - protein, 12 aa, Artificial Sequence
  Description of Artificial Sequence: Synthetic peptide
  XENP019320 vlCDR1
RASQSVGSSYLA

SEQ ID NO: 3987 - protein, 7 aa, Artificial Sequence
  Description of Artificial Sequence: Synthetic peptide
  XENP019320 vlCDR2
GAFSRAT

SEQ ID NO: 3988 - protein, 9 aa, Artificial Sequence
  Description of Artificial Sequence: Synthetic peptide
  XENP019320 vlCDR3
QQYGSSPWT

SEQ ID NO: 3989 - protein, 221 aa, Artificial Sequence
  Description of Artificial Sequence: Synthetic polypeptide
  XENP019321 [CTLA-4]_H0.107_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARYGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3990 - protein, 118 aa, Artificial Sequence; identical to SEQ ID NO: 1147
  Description of Artificial Sequence: Synthetic polypeptide
  VH of XENP019321

SEQ ID NO: 3991 - protein, 5 aa, Artificial Sequence
  Description of Artificial Sequence: Synthetic peptide
  XENP019321 vhCDR1
SYTMH

SEQ ID NO: 3992 - protein, 17 aa, Artificial Sequence
  Description of Artificial Sequence: Synthetic peptide
  XENP019321 vhCDR2
FISYDGNNKYYADSVKG

SEQ ID NO: 3993 - protein, 9 aa, Artificial Sequence
  Description of Artificial Sequence: Synthetic peptide
  XENP019321 vhCDR3
YGWLGPFDY

SEQ ID NO: 3994 - protein, 215 aa, Artificial Sequence; identical to SEQ ID NO: 2924
  Description of Artificial Sequence: Synthetic polypeptide
  XENP019321 [CTLA-4]_H0.107_L0_Fab Light Chain

SEQ ID NO: 3995 - protein, 108 aa, Artificial Sequence; identical to SEQ ID NO: 23
  Description of Artificial Sequence: Synthetic polypeptide
  VL of XENP019321

SEQ ID NO: 3996 - protein, 12 aa, Artificial Sequence
  Description of Artificial Sequence: Synthetic peptide
  XENP019321 vlCDR1
RASQSVGSSYLA

SEQ ID NO: 3997 - protein, 7 aa, Artificial Sequence
  Description of Artificial Sequence: Synthetic peptide
  XENP019321 vlCDR2
GAFSRAT

SEQ ID NO: 3998 - protein, 9 aa, Artificial Sequence
  Description of Artificial Sequence: Synthetic peptide
  XENP019321 vlCDR3
QQYGSSPWT

SEQ ID NO: 3999 - protein, 221 aa, Artificial Sequence
  Description of Artificial Sequence: Synthetic polypeptide
  XENP019322 [CTLA-4]_H0.108_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTAWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4000 - protein, 118 aa, Artificial Sequence; identical to SEQ ID NO: 1156
  Description of Artificial Sequence: Synthetic polypeptide
  VH of XENP019322

SEQ ID NO: 4001 - protein, 5 aa, Artificial Sequence
  Description of Artificial Sequence: Synthetic peptide
  XENP019322 vhCDR1
SYTMH

SEQ ID NO: 4002 - protein, 17 aa, Artificial Sequence
  Description of Artificial Sequence: Synthetic peptide
  XENP019322 vhCDR2
FISYDGNNKYYADSVKG

SEQ ID NO: 4003 - protein, 9 aa, Artificial Sequence
  Description of Artificial Sequence: Synthetic peptide
  XENP019322 vhCDR3
TAWLGPFDY

SEQ ID NO: 4004 - protein, 215 aa, Artificial Sequence; identical to SEQ ID NO: 2924
  Description of Artificial Sequence: Synthetic polypeptide
  XENP019322 [CTLA-4]_H0.108_L0_Fab Light Chain

SEQ ID NO: 4005 - protein, 108 aa, Artificial Sequence; identical to SEQ ID NO: 23
  Description of Artificial Sequence: Synthetic polypeptide
  VL of XENP019322

SEQ ID NO: 4006 - protein, 12 aa, Artificial Sequence
  Description of Artificial Sequence: Synthetic peptide
  XENP019322 vlCDR1
RASQSVGSSYLA

SEQ ID NO: 4007 - protein, 7 aa, Artificial Sequence
  Description of Artificial Sequence: Synthetic peptide
  XENP019322 vlCDR2
GAFSRAT

SEQ ID NO: 4008 - protein, 9 aa, Artificial Sequence
  Description of Artificial Sequence: Synthetic peptide
  XENP019322 vlCDR3
QQYGSSPWT

SEQ ID NO: 4009 - protein, 221 aa, Artificial Sequence
  Description of Artificial Sequence: Synthetic polypeptide
  XENP019323 [CTLA-4]_H0.109_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTSWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4010 - protein, 118 aa, Artificial Sequence; identical to SEQ ID NO: 1165
  Description of Artificial Sequence: Synthetic polypeptide
  VH of XENP019323

SEQ ID NO: 4011 - protein, 5 aa, Artificial Sequence
  Description of Artificial Sequence: Synthetic peptide
  XENP019323 vhCDR1
SYTMH

SEQ ID NO: 4012 - protein, 17 aa, Artificial Sequence
  Description of Artificial Sequence: Synthetic peptide
  XENP019323 vhCDR2
FISYDGNNKYYADSVKG

SEQ ID NO: 4013 - protein, 9 aa, Artificial Sequence
  Description of Artificial Sequence: Synthetic peptide
  XENP019323 vhCDR3
TSWLGPFDY

SEQ ID NO: 4014 - protein, 215 aa, Artificial Sequence; identical to SEQ ID NO: 2924
  Description of Artificial Sequence: Synthetic polypeptide
  XENP019323 [CTLA-4]_H0.109_L0_Fab Light Chain

SEQ ID NO: 4015 - protein, 108 aa, Artificial Sequence; identical to SEQ ID NO: 23
  Description of Artificial Sequence: Synthetic polypeptide
  VL of XENP019323

SEQ ID NO: 4016 - protein, 12 aa, Artificial Sequence
  Description of Artificial Sequence: Synthetic peptide
  XENP019323 vlCDR1
RASQSVGSSYLA

SEQ ID NO: 4017 - protein, 7 aa, Artificial Sequence
  Description of Artificial Sequence: Synthetic peptide
  XENP019323 vlCDR2
GAFSRAT

SEQ ID NO: 4018 - protein, 9 aa, Artificial Sequence
  Description of Artificial Sequence: Synthetic peptide
  XENP019323 vlCDR3
QQYGSSPWT

SEQ ID NO: 4019 - protein, 221 aa, Artificial Sequence
  Description of Artificial Sequence: Synthetic polypeptide
  XENP019324 [CTLA-4]_H0.110_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTTWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4020 - protein, 118 aa, Artificial Sequence; identical to SEQ ID NO: 1174
  Description of Artificial Sequence: Synthetic polypeptide
  VH of XENP019324

SEQ ID NO: 4021 - protein, 5 aa, Artificial Sequence
  Description of Artificial Sequence: Synthetic peptide
  XENP019324 vhCDR1
SYTMH

SEQ ID NO: 4022 - protein, 17 aa, Artificial Sequence
  Description of Artificial Sequence: Synthetic peptide
  XENP019324 vhCDR2
FISYDGNNKYYADSVKG

SEQ ID NO: 4023 - protein, 9 aa, Artificial Sequence
  Description of Artificial Sequence: Synthetic peptide
  XENP019324 vhCDR3
TTWLGPFDY

SEQ ID NO: 4024 - protein, 215 aa, Artificial Sequence; identical to SEQ ID NO: 2924
  Description of Artificial Sequence: Synthetic polypeptide
  XENP019324 [CTLA-4]_H0.110_L0_Fab Light Chain

SEQ ID NO: 4025 - protein, 108 aa, Artificial Sequence; identical to SEQ ID NO: 23
  Description of Artificial Sequence: Synthetic polypeptide
  VL of XENP019324

SEQ ID NO: 4026 - protein, 12 aa, Artificial Sequence
  Description of Artificial Sequence: Synthetic peptide
  XENP019324 vlCDR1
RASQSVGSSYLA

SEQ ID NO: 4027 - protein, 7 aa, Artificial Sequence
  Description of Artificial Sequence: Synthetic peptide
  XENP019324 vlCDR2
GAFSRAT

SEQ ID NO: 4028 - protein, 9 aa, Artificial Sequence
  Description of Artificial Sequence: Synthetic peptide
  XENP019324 vlCDR3
QQYGSSPWT

SEQ ID NO: 4029 - protein, 221 aa, Artificial Sequence
  Description of Artificial Sequence: Synthetic polypeptide
  XENP019325 [CTLA-4]_H0.111_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGFLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4030 - protein, 118 aa, Artificial Sequence; identical to SEQ ID NO: 1183
  Description of Artificial Sequence: Synthetic polypeptide
  VH of XENP019325

SEQ ID NO: 4031 - protein, 5 aa, Artificial Sequence
  Description of Artificial Sequence: Synthetic peptide
  XENP019325 vhCDR1
SYTMH

SEQ ID NO: 4032 - protein, 17 aa, Artificial Sequence
  Description of Artificial Sequence: Synthetic peptide
  XENP019325 vhCDR2
FISYDGNNKYYADSVKG

SEQ ID NO: 4033 - protein, 9 aa, Artificial Sequence
  Description of Artificial Sequence: Synthetic peptide
  XENP019325 vhCDR3
TGFLGPFDY

SEQ ID NO: 4034 - protein, 215 aa, Artificial Sequence; identical to SEQ ID NO: 2924
  Description of Artificial Sequence: Synthetic polypeptide
  XENP019325 [CTLA-4]_H0.111_L0_Fab Light Chain

SEQ ID NO: 4035 - protein, 108 aa, Artificial Sequence; identical to SEQ ID NO: 23
  Description of Artificial Sequence: Synthetic polypeptide
  VL of XENP019325

SEQ ID NO: 4036 - protein, 12 aa, Artificial Sequence
  Description of Artificial Sequence: Synthetic peptide
  XENP019325 vlCDR1
RASQSVGSSYLA

SEQ ID NO: 4037 - protein, 7 aa, Artificial Sequence
  Description of Artificial Sequence: Synthetic peptide
  XENP019325 vlCDR2
GAFSRAT

SEQ ID NO: 4038 - protein, 9 aa, Artificial Sequence
  Description of Artificial Sequence: Synthetic peptide
  XENP019325 vlCDR3
QQYGSSPWT

SEQ ID NO: 4039 - protein, 221 aa, Artificial Sequence
  Description of Artificial Sequence: Synthetic polypeptide
  XENP019326 [CTLA-4]_H0.112_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGGLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4040 - protein, 118 aa, Artificial Sequence; identical to SEQ ID NO: 1192
  Description of Artificial Sequence: Synthetic polypeptide
  VH of XENP019326

SEQ ID NO: 4041 - protein, 5 aa, Artificial Sequence
  Description of Artificial Sequence: Synthetic peptide
  XENP019326 vhCDR1
SYTMH

SEQ ID NO: 4042 - protein, 17 aa, Artificial Sequence
  Description of Artificial Sequence: Synthetic peptide
  XENP019326 vhCDR2
FISYDGNNKYYADSVKG

SEQ ID NO: 4043 - protein, 9 aa, Artificial Sequence
  Description of Artificial Sequence: Synthetic peptide
  XENP019326 vhCDR3
TGGLGPFDY

SEQ ID NO: 4044 - protein, 215 aa, Artificial Sequence; identical to SEQ ID NO: 2924
  Description of Artificial Sequence: Synthetic polypeptide
  XENP019326 [CTLA-4]_H0.112_L0_Fab Light Chain

SEQ ID NO: 4045 - protein, 108 aa, Artificial Sequence; identical to SEQ ID NO: 23
  Description of Artificial Sequence: Synthetic polypeptide
  VL of XENP019326

SEQ ID NO: 4046 - protein, 12 aa, Artificial Sequence
  Description of Artificial Sequence: Synthetic peptide
  XENP019326 vlCDR1
RASQSVGSSYLA

SEQ ID NO: 4047 - protein, 7 aa, Artificial Sequence
  Description of Artificial Sequence: Synthetic peptide
  XENP019326 vlCDR2
GAFSRAT

SEQ ID NO: 4048 - protein, 9 aa, Artificial Sequence
  Description of Artificial Sequence: Synthetic peptide
  XENP019326 vlCDR3
QQYGSSPWT

SEQ ID NO: 4049 - protein, 221 aa, Artificial Sequence
  Description of Artificial Sequence: Synthetic polypeptide
  XENP019327 [CTLA-4]_H0.113_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGHLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4050 - protein, 118 aa, Artificial Sequence; identical to SEQ ID NO: 1201
  Description of Artificial Sequence: Synthetic polypeptide
  VH of XENP019327

SEQ ID NO: 4051 - protein, 5 aa, Artificial Sequence
  Description of Artificial Sequence: Synthetic peptide
  XENP019327 vhCDR1
SYTMH

SEQ ID NO: 4052 - protein, 17 aa, Artificial Sequence
  Description of Artificial Sequence: Synthetic peptide
  XENP019327 vhCDR2
FISYDGNNKYYADSVKG

SEQ ID NO: 4053 - protein, 9 aa, Artificial Sequence
  Description of Artificial Sequence: Synthetic peptide
  XENP019327 vhCDR3
TGHLGPFDY

SEQ ID NO: 4054 - protein, 215 aa, Artificial Sequence; identical to SEQ ID NO: 2924
  Description of Artificial Sequence: Synthetic polypeptide
  XENP019327 [CTLA-4]_H0.113_L0_Fab Light Chain

SEQ ID NO: 4055 - protein, 108 aa, Artificial Sequence; identical to SEQ ID NO: 23
  Description of Artificial Sequence: Synthetic polypeptide
  VL of XENP019327

SEQ ID NO: 4056 - protein, 12 aa, Artificial Sequence
  Description of Artificial Sequence: Synthetic peptide
  XENP019327 vlCDR1
RASQSVGSSYLA

SEQ ID NO: 4057 - protein, 7 aa, Artificial Sequence
  Description of Artificial Sequence: Synthetic peptide
  XENP019327 vlCDR2
GAFSRAT

SEQ ID NO: 4058 - protein, 9 aa, Artificial Sequence
  Description of Artificial Sequence: Synthetic peptide
  XENP019327 vlCDR3
QQYGSSPWT

SEQ ID NO: 4059 - protein, 221 aa, Artificial Sequence
  Description of Artificial Sequence: Synthetic polypeptide
  XENP019328 [CTLA-4]_H0.114_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGLLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4060 - protein, 118 aa, Artificial Sequence; identical to SEQ ID NO: 1210
  Description of Artificial Sequence: Synthetic polypeptide
  VH of XENP019328

SEQ ID NO: 4061 - protein, 5 aa, Artificial Sequence
  Description of Artificial Sequence: Synthetic peptide
  XENP019328 vhCDR1
SYTMH

SEQ ID NO: 4062 - protein, 17 aa, Artificial Sequence
  Description of Artificial Sequence: Synthetic peptide
  XENP019328 vhCDR2
FISYDGNNKYYADSVKG

SEQ ID NO: 4063 - protein, 9 aa, Artificial Sequence
  Description of Artificial Sequence: Synthetic peptide
  XENP019328 vhCDR3
TGLLGPFDY

SEQ ID NO: 4064 - protein, 215 aa, Artificial Sequence; identical to SEQ ID NO: 2924
  Description of Artificial Sequence: Synthetic polypeptide
  XENP019328 [CTLA-4]_H0.114_L0_Fab Light Chain

SEQ ID NO: 4065 - protein, 108 aa, Artificial Sequence; identical to SEQ ID NO: 23
  Description of Artificial Sequence: Synthetic polypeptide
  VL of XENP019328

SEQ ID NO: 4066 - protein, 12 aa, Artificial Sequence
  Description of Artificial Sequence: Synthetic peptide
  XENP019328 vlCDR1
RASQSVGSSYLA

SEQ ID NO: 4067 - protein, 7 aa, Artificial Sequence
  Description of Artificial Sequence: Synthetic peptide
  XENP019328 vlCDR2
GAFSRAT

SEQ ID NO: 4068 - protein, 9 aa, Artificial Sequence
  Description of Artificial Sequence: Synthetic peptide
  XENP019328 vlCDR3
QQYGSSPWT

SEQ ID NO: 4069 - protein, 221 aa, Artificial Sequence
  Description of Artificial Sequence: Synthetic polypeptide
  XENP019329 [CTLA-4]_H0.115_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGYLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4070 - protein, 118 aa, Artificial Sequence; identical to SEQ ID NO: 1219
  Description of Artificial Sequence: Synthetic polypeptide
  VH of XENP019329

SEQ ID NO: 4071 - protein, 5 aa, Artificial Sequence
  Description of Artificial Sequence: Synthetic peptide
  XENP019329 vhCDR1
SYTMH

SEQ ID NO: 4072 - protein, 17 aa, Artificial Sequence
  Description of Artificial Sequence: Synthetic peptide
  XENP019329 vhCDR2
FISYDGNNKYYADSVKG

SEQ ID NO: 4073 - protein, 9 aa, Artificial Sequence
  Description of Artificial Sequence: Synthetic peptide
  XENP019329 vhCDR3
TGYLGPFDY

SEQ ID NO: 4074 - protein, 215 aa, Artificial Sequence; identical to SEQ ID NO: 2924
  Description of Artificial Sequence: Synthetic polypeptide
  XENP019329 [CTLA-4]_H0.115_L0_Fab Light Chain

SEQ ID NO: 4075 - protein, 108 aa, Artificial Sequence; identical to SEQ ID NO: 23
  Description of Artificial Sequence: Synthetic polypeptide
  VL of XENP019329

SEQ ID NO: 4076 - protein, 12 aa, Artificial Sequence
  Description of Artificial Sequence: Synthetic peptide
  XENP019329 vlCDR1
RASQSVGSSYLA

SEQ ID NO: 4077 - protein, 7 aa, Artificial Sequence
  Description of Artificial Sequence: Synthetic peptide
  XENP019329 vlCDR2
GAFSRAT

SEQ ID NO: 4078 - protein, 9 aa, Artificial Sequence
  Description of Artificial Sequence: Synthetic peptide
  XENP019329 vlCDR3
QQYGSSPWT

SEQ ID NO: 4079 - protein, 221 aa, Artificial Sequence
  Description of Artificial Sequence: Synthetic polypeptide
  XENP019330 [CTLA-4]_H0.116_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWDGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4080 - protein, 118 aa, Artificial Sequence; identical to SEQ ID NO: 1228
  Description of Artificial Sequence: Synthetic polypeptide
  VH of XENP019330

SEQ ID NO: 4081 - protein, 5 aa, Artificial Sequence
  Description of Artificial Sequence: Synthetic peptide
  XENP019330 vhCDR1
SYTMH

SEQ ID NO: 4082 - protein, 17 aa, Artificial Sequence
  Description of Artificial Sequence: Synthetic peptide
  XENP019330 vhCDR2
FISYDGNNKYYADSVKG

SEQ ID NO: 4083 - protein, 9 aa, Artificial Sequence
  Description of Artificial Sequence: Synthetic peptide
  XENP019330 vhCDR3
TGWDGPFDY

SEQ ID NO: 4084 - protein, 215 aa, Artificial Sequence; identical to SEQ ID NO: 2924
  Description of Artificial Sequence: Synthetic polypeptide
  XENP019330 [CTLA-4]_H0.116_L0_Fab Light Chain

SEQ ID NO: 4085 - protein, 108 aa, Artificial Sequence; identical to SEQ ID NO: 23
  Description of Artificial Sequence: Synthetic polypeptide
  VL of XENP019330

SEQ ID NO: 4086 - protein, 12 aa, Artificial Sequence
  Description of Artificial Sequence: Synthetic peptide
  XENP019330 vlCDR1
RASQSVGSSYLA

SEQ ID NO: 4087 - protein, 7 aa, Artificial Sequence
  Description of Artificial Sequence: Synthetic peptide
  XENP019330 vlCDR2
GAFSRAT

SEQ ID NO: 4088 - protein, 9 aa, Artificial Sequence
  Description of Artificial Sequence: Synthetic peptide
  XENP019330 vlCDR3
QQYGSSPWT

SEQ ID NO: 4089 - protein, 221 aa, Artificial Sequence
  Description of Artificial Sequence: Synthetic polypeptide
  XENP019331 [CTLA-4]_H0.117_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWIGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4090 - protein, 118 aa, Artificial Sequence; identical to SEQ ID NO: 1237
  Description of Artificial Sequence: Synthetic polypeptide
  VH of XENP019331

SEQ ID NO: 4091 - protein, 5 aa, Artificial Sequence
  Description of Artificial Sequence: Synthetic peptide
  XENP019331 vhCDR1
SYTMH

SEQ ID NO: 4092 - protein, 17 aa, Artificial Sequence
  Description of Artificial Sequence: Synthetic peptide
  XENP019331 vhCDR2
FISYDGNNKYYADSVKG

SEQ ID NO: 4093 - protein, 9 aa, Artificial Sequence
  Description of Artificial Sequence: Synthetic peptide
  XENP019331 vhCDR3
TGWIGPFDY

SEQ ID NO: 4094 - protein, 215 aa, Artificial Sequence; identical to SEQ ID NO: 2924
  Description of Artificial Sequence: Synthetic polypeptide
  XENP019331 [CTLA-4]_H0.117_L0_Fab Light Chain

SEQ ID NO: 4095 - protein, 108 aa, Artificial Sequence; identical to SEQ ID NO: 23
  Description of Artificial Sequence: Synthetic polypeptide
  VL of XENP019331

SEQ ID NO: 4096 - protein, 12 aa, Artificial Sequence
  Description of Artificial Sequence: Synthetic peptide
  XENP019331 vlCDR1
RASQSVGSSYLA

SEQ ID NO: 4097 - protein, 7 aa, Artificial Sequence
  Description of Artificial Sequence: Synthetic peptide
  XENP019331 vlCDR2
GAFSRAT

SEQ ID NO: 4098 - protein, 9 aa, Artificial Sequence
  Description of Artificial Sequence: Synthetic peptide
  XENP019331 vlCDR3
QQYGSSPWT

SEQ ID NO: 4099 - protein, 221 aa, Artificial Sequence
  Description of Artificial Sequence: Synthetic polypeptide
  XENP019332 [CTLA-4]_H0.118_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWVGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4100 - protein, 118 aa, Artificial Sequence; identical to SEQ ID NO: 1246
  Description of Artificial Sequence: Synthetic polypeptide
  VH of XENP019332

SEQ ID NO: 4101 - protein, 5 aa, Artificial Sequence
  Description of Artificial Sequence: Synthetic peptide
  XENP019332 vhCDR1
SYTMH

SEQ ID NO: 4102 - protein, 17 aa, Artificial Sequence
  Description of Artificial Sequence: Synthetic peptide
  XENP019332 vhCDR2
FISYDGNNKYYADSVKG

SEQ ID NO: 4103 - protein, 9 aa, Artificial Sequence
  Description of Artificial Sequence: Synthetic peptide
  XENP019332 vhCDR3
TGWVGPFDY

SEQ ID NO: 4104 - protein, 215 aa, Artificial Sequence; identical to SEQ ID NO: 2924
  Description of Artificial Sequence: Synthetic polypeptide
  XENP019332 [CTLA-4]_H0.118_L0_Fab Light Chain

SEQ ID NO: 4105 - protein, 108 aa, Artificial Sequence; identical to SEQ ID NO: 23
  Description of Artificial Sequence: Synthetic polypeptide
  VL of XENP019332

SEQ ID NO: 4106 - protein, 12 aa, Artificial Sequence
  Description of Artificial Sequence: Synthetic peptide
  XENP019332 vlCDR1
RASQSVGSSYLA

SEQ ID NO: 4107 - protein, 7 aa, Artificial Sequence
  Description of Artificial Sequence: Synthetic peptide
  XENP019332 vlCDR2
GAFSRAT

SEQ ID NO: 4108 - protein, 9 aa, Artificial Sequence
  Description of Artificial Sequence: Synthetic peptide
  XENP019332 vlCDR3
QQYGSSPWT

SEQ ID NO: 4109 - protein, 221 aa, Artificial Sequence
  Description of Artificial Sequence: Synthetic polypeptide
  XENP019333 [CTLA-4]_H0.119_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLAPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4110 - protein, 118 aa, Artificial Sequence; identical to SEQ ID NO: 1255
  Description of Artificial Sequence: Synthetic polypeptide
  VH of XENP019333

SEQ ID NO: 4111 - protein, 5 aa, Artificial Sequence
  Description of Artificial Sequence: Synthetic peptide
  XENP019333 vhCDR1
SYTMH

SEQ ID NO: 4112 - protein, 17 aa, Artificial Sequence
  Description of Artificial Sequence: Synthetic peptide
  XENP019333 vhCDR2
FISYDGNNKYYADSVKG

SEQ ID NO: 4113 - protein, 9 aa, Artificial Sequence
  Description of Artificial Sequence: Synthetic peptide
  XENP019333 vhCDR3
TGWLAPFDY

SEQ ID NO: 4114 - protein, 215 aa, Artificial Sequence; identical to SEQ ID NO: 2924
  Description of Artificial Sequence: Synthetic polypeptide
  XENP019333 [CTLA-4]_H0.119_L0_Fab Light Chain

SEQ ID NO: 4115 - protein, 108 aa, Artificial Sequence; identical to SEQ ID NO: 23
  Description of Artificial Sequence: Synthetic polypeptide
  VL of XENP019333

SEQ ID NO: 4116 - protein, 12 aa, Artificial Sequence
  Description of Artificial Sequence: Synthetic peptide
  XENP019333 vlCDR1
RASQSVGSSYLA

SEQ ID NO: 4117 - protein, 7 aa, Artificial Sequence
  Description of Artificial Sequence: Synthetic peptide
  XENP019333 vlCDR2
GAFSRAT

SEQ ID NO: 4118 - protein, 9 aa, Artificial Sequence
  Description of Artificial Sequence: Synthetic peptide
  XENP019333 vlCDR3
QQYGSSPWT

SEQ ID NO: 4119 - protein, 221 aa, Artificial Sequence
  Description of Artificial Sequence: Synthetic polypeptide
  XENP019334 [CTLA-4]_H0.120_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4120 - protein, 118 aa, Artificial Sequence; identical to SEQ ID NO: 1264
  Description of Artificial Sequence: Synthetic polypeptide
  VH of XENP019334

SEQ ID NO: 4121 - protein, 5 aa, Artificial Sequence
  Description of Artificial Sequence: Synthetic peptide
  XENP019334 vhCDR1
SYTMH

SEQ ID NO: 4122 - protein, 17 aa, Artificial Sequence
  Description of Artificial Sequence: Synthetic peptide
  XENP019334 vhCDR2
FISYDGNNKYYADSVKG

SEQ ID NO: 4123 - protein, 9 aa, Artificial Sequence
  Description of Artificial Sequence: Synthetic peptide
  XENP019334 vhCDR3
TGWLSPFDY

SEQ ID NO: 4124 - protein, 215 aa, Artificial Sequence; identical to SEQ ID NO: 2924
  Description of Artificial Sequence: Synthetic polypeptide
  XENP019334 [CTLA-4]_H0.120_L0_Fab Light Chain

SEQ ID NO: 4125 - protein, 108 aa, Artificial Sequence; identical to SEQ ID NO: 23
  Description of Artificial Sequence: Synthetic polypeptide
  VL of XENP019334

SEQ ID NO: 4126 - protein, 12 aa, Artificial Sequence
  Description of Artificial Sequence: Synthetic peptide
  XENP019334 vlCDR1
RASQSVGSSYLA

SEQ ID NO: 4127 - protein, 7 aa, Artificial Sequence
  Description of Artificial Sequence: Synthetic peptide
  XENP019334 vlCDR2
GAFSRAT

SEQ ID NO: 4128 - protein, 9 aa, Artificial Sequence
  Description of Artificial Sequence: Synthetic peptide
  XENP019334 vlCDR3
QQYGSSPWT

SEQ ID NO: 4129 - protein, 221 aa, Artificial Sequence
  Description of Artificial Sequence: Synthetic polypeptide
  XENP019335 [CTLA-4]_H0.121_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLTPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4130 - protein, 118 aa, Artificial Sequence; identical to SEQ ID NO: 1273
  Description of Artificial Sequence: Synthetic polypeptide
  VH of XENP019335

SEQ ID NO: 4131 - protein, 5 aa, Artificial Sequence
  Description of Artificial Sequence: Synthetic peptide
  XENP019335 vhCDR1
SYTMH

SEQ ID NO: 4132 - protein, 17 aa, Artificial Sequence
  Description of Artificial Sequence: Synthetic peptide
  XENP019335 vhCDR2
FISYDGNNKYYADSVKG

SEQ ID NO: 4133 - protein, 9 aa, Artificial Sequence
  Description of Artificial Sequence: Synthetic peptide
  XENP019335 vhCDR3
TGWLTPFDY

SEQ ID NO: 4134 - protein, 215 aa, Artificial Sequence; identical to SEQ ID NO: 2924
  Description of Artificial Sequence: Synthetic polypeptide
  XENP019335 [CTLA-4]_H0.121_L0_Fab Light Chain

SEQ ID NO: 4135 - protein, 108 aa, Artificial Sequence; identical to SEQ ID NO: 23
  Description of Artificial Sequence: Synthetic polypeptide
  VL of XENP019335

SEQ ID NO: 4136 - protein, 12 aa, Artificial Sequence
  Description of Artificial Sequence: Synthetic peptide
  XENP019335 vlCDR1
RASQSVGSSYLA

SEQ ID NO: 4137 - protein, 7 aa, Artificial Sequence
  Description of Artificial Sequence: Synthetic peptide
  XENP019335 vlCDR2
GAFSRAT

SEQ ID NO: 4138 - protein, 9 aa, Artificial Sequence
  Description of Artificial Sequence: Synthetic peptide
  XENP019335 vlCDR3
QQYGSSPWT

SEQ ID NO: 4139 - protein, 221 aa, Artificial Sequence
  Description of Artificial Sequence: Synthetic polypeptide
  XENP019336 [CTLA-4]_H0.122_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4140 - protein, 118 aa, Artificial Sequence; identical to SEQ ID NO: 1282
  Description of Artificial Sequence: Synthetic polypeptide
  VH of XENP019336

SEQ ID NO: 4141 - protein, 5 aa, Artificial Sequence
  Description of Artificial Sequence: Synthetic peptide
  XENP019336 vhCDR1
SYTMH

SEQ ID NO: 4142 - protein, 17 aa, Artificial Sequence
  Description of Artificial Sequence: Synthetic peptide
  XENP019336 vhCDR2
FISYDGNNKYYADSVKG

SEQ ID NO: 4143 - protein, 9 aa, Artificial Sequence
  Description of Artificial Sequence: Synthetic peptide
  XENP019336 vhCDR3
TGWLGPLDY

SEQ ID NO: 4144 - protein, 215 aa, Artificial Sequence; identical to SEQ ID NO: 2924
  Description of Artificial Sequence: Synthetic polypeptide
  XENP019336 [CTLA-4]_H0.122_L0_Fab Light Chain

SEQ ID NO: 4145 - protein, 108 aa, Artificial Sequence; identical to SEQ ID NO: 23
  Description of Artificial Sequence: Synthetic polypeptide
  VL of XENP019336

SEQ ID NO: 4146 - protein, 12 aa, Artificial Sequence
  Description of Artificial Sequence: Synthetic peptide
  XENP019336 vlCDR1
RASQSVGSSYLA

SEQ ID NO: 4147 - protein, 7 aa, Artificial Sequence
  Description of Artificial Sequence: Synthetic peptide
  XENP019336 vlCDR2
GAFSRAT

SEQ ID NO: 4148 - protein, 9 aa, Artificial Sequence
  Description of Artificial Sequence: Synthetic peptide
  XENP019336 vlCDR3
QQYGSSPWT

SEQ ID NO: 4149 - protein, 221 aa, Artificial Sequence
  Description of Artificial Sequence: Synthetic polypeptide
  XENP019337 [CTLA-4]_H0.123_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4150 - protein, 118 aa, Artificial Sequence; identical to SEQ ID NO: 1291
  Description of Artificial Sequence: Synthetic polypeptide
  VH of XENP019337

SEQ ID NO: 4151 - protein, 5 aa, Artificial Sequence
  Description of Artificial Sequence: Synthetic peptide
  XENP019337 vhCDR1
SYTMH

SEQ ID NO: 4152 - protein, 17 aa, Artificial Sequence
  Description of Artificial Sequence: Synthetic peptide
  XENP019337 vhCDR2
FISYDGNNKYYADSVKG

SEQ ID NO: 4153 - protein, 9 aa, Artificial Sequence
  Description of Artificial Sequence: Synthetic peptide
  XENP019337 vhCDR3
TGWLGPMDY

SEQ ID NO: 4154 - protein, 215 aa, Artificial Sequence; identical to SEQ ID NO: 2924
  Description of Artificial Sequence: Synthetic polypeptide
  XENP019337 [CTLA-4]_H0.123_L0_Fab Light Chain

SEQ ID NO: 4155 - protein, 108 aa, Artificial Sequence; identical to SEQ ID NO: 23
  Description of Artificial Sequence: Synthetic polypeptide
  VL of XENP019337

SEQ ID NO: 4156 - protein, 12 aa, Artificial Sequence
  Description of Artificial Sequence: Synthetic peptide
  XENP019337 vlCDR1
RASQSVGSSYLA

SEQ ID NO: 4157 - protein, 7 aa, Artificial Sequence
  Description of Artificial Sequence: Synthetic peptide
  XENP019337 vlCDR2
GAFSRAT

SEQ ID NO: 4158 - protein, 9 aa, Artificial Sequence
  Description of Artificial Sequence: Synthetic peptide
  XENP019337 vlCDR3
QQYGSSPWT

SEQ ID NO: 4159 - protein, 221 aa, Artificial Sequence
  Description of Artificial Sequence: Synthetic polypeptide
  XENP019338 [CTLA-4]_H0.124_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4160 - protein, 118 aa, Artificial Sequence; identical to SEQ ID NO: 1300
  Description of Artificial Sequence: Synthetic polypeptide
  VH of XENP019338

SEQ ID NO: 4161 - protein, 5 aa, Artificial Sequence
  Description of Artificial Sequence: Synthetic peptide
  XENP019338 vhCDR1
SYTMH

SEQ ID NO: 4162 - protein, 17 aa, Artificial Sequence
  Description of Artificial Sequence: Synthetic peptide
  XENP019338 vhCDR2
FISYDGNNKYYADSVKG

SEQ ID NO: 4163 - protein, 9 aa, Artificial Sequence
  Description of Artificial Sequence: Synthetic peptide
  XENP019338 vhCDR3
TGWLGPFAY

SEQ ID NO: 4164 - protein, 215 aa, Artificial Sequence; identical to SEQ ID NO: 2924
  Description of Artificial Sequence: Synthetic polypeptide
  XENP019338 [CTLA-4]_H0.124_L0_Fab Light Chain

SEQ ID NO: 4165 - protein, 108 aa, Artificial Sequence; identical to SEQ ID NO: 23
  Description of Artificial Sequence: Synthetic polypeptide
  VL of XENP019338

SEQ ID NO: 4166 - protein, 12 aa, Artificial Sequence
  Description of Artificial Sequence: Synthetic peptide
  XENP019338 vlCDR1
RASQSVGSSYLA

SEQ ID NO: 4167 - protein, 7 aa, Artificial Sequence
  Description of Artificial Sequence: Synthetic peptide
  XENP019338 vlCDR2
GAFSRAT

SEQ ID NO: 4168 - protein, 9 aa, Artificial Sequence
  Description of Artificial Sequence: Synthetic peptide
  XENP019338 vlCDR3
QQYGSSPWT

SEQ ID NO: 4169 - protein, 221 aa, Artificial Sequence
  Description of Artificial Sequence: Synthetic polypeptide
  XENP019339 [CTLA-4]_H0.125_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4170 - protein, 118 aa, Artificial Sequence; identical to SEQ ID NO: 1309
  Description of Artificial Sequence: Synthetic polypeptide
  VH of XENP019339

SEQ ID NO: 4171 - protein, 5 aa, Artificial Sequence
  Description of Artificial Sequence: Synthetic peptide
  XENP019339 vhCDR1
SYTMH

SEQ ID NO: 4172 - protein, 17 aa, Artificial Sequence
  Description of Artificial Sequence: Synthetic peptide
  XENP019339 vhCDR2
FISYDGNNKYYADSVKG

SEQ ID NO: 4173 - protein, 9 aa, Artificial Sequence
  Description of Artificial Sequence: Synthetic peptide
  XENP019339 vhCDR3
TGWLGPFEY

SEQ ID NO: 4174 - protein, 215 aa, Artificial Sequence; identical to SEQ ID NO: 2924
  Description of Artificial Sequence: Synthetic polypeptide
  XENP019339 [CTLA-4]_H0.125_L0_Fab Light Chain

SEQ ID NO: 4175 - protein, 108 aa, Artificial Sequence; identical to SEQ ID NO: 23
  Description of Artificial Sequence: Synthetic polypeptide
  VL of XENP019339

SEQ ID NO: 4176 - protein, 12 aa, Artificial Sequence
  Description of Artificial Sequence: Synthetic peptide
  XENP019339 vlCDR1
RASQSVGSSYLA

SEQ ID NO: 4177 - protein, 7 aa, Artificial Sequence
  Description of Artificial Sequence: Synthetic peptide
  XENP019339 vlCDR2
GAFSRAT

SEQ ID NO: 4178 - protein, 9 aa, Artificial Sequence
  Description of Artificial Sequence: Synthetic peptide
  XENP019339 vlCDR3
QQYGSSPWT

SEQ ID NO: 4179 - protein, 221 aa, Artificial Sequence
  Description of Artificial Sequence: Synthetic polypeptide
  XENP019340 [CTLA-4]_H0.126_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFHYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4180 - protein, 118 aa, Artificial Sequence; identical to SEQ ID NO: 1318
  Description of Artificial Sequence: Synthetic polypeptide
  VH of XENP019340

SEQ ID NO: 4181 - protein, 5 aa, Artificial Sequence
  Description of Artificial Sequence: Synthetic peptide
  XENP019340 vhCDR1
SYTMH

SEQ ID NO: 4182 - protein, 17 aa, Artificial Sequence
  Description of Artificial Sequence: Synthetic peptide
  XENP019340 vhCDR2
FISYDGNNKYYADSVKG

SEQ ID NO: 4183 - protein, 9 aa, Artificial Sequence
  Description of Artificial Sequence: Synthetic peptide
  XENP019340 vhCDR3
TGWLGPFHY

SEQ ID NO: 4184 - protein, 215 aa, Artificial Sequence; identical to SEQ ID NO: 2924
  Description of Artificial Sequence: Synthetic polypeptide
  XENP019340 [CTLA-4]_H0.126_L0_Fab Light Chain

SEQ ID NO: 4185 - protein, 108 aa, Artificial Sequence; identical to SEQ ID NO: 23
  Description of Artificial Sequence: Synthetic polypeptide
  VL of XENP019340

SEQ ID NO: 4186 - protein, 12 aa, Artificial Sequence
  Description of Artificial Sequence: Synthetic peptide
  XENP019340 vlCDR1
RASQSVGSSYLA

SEQ ID NO: 4187 - protein, 7 aa, Artificial Sequence
  Description of Artificial Sequence: Synthetic peptide
  XENP019340 vlCDR2
GAFSRAT

SEQ ID NO: 4188 - protein, 9 aa, Artificial Sequence
  Description of Artificial Sequence: Synthetic peptide
  XENP019340 vlCDR3
QQYGSSPWT

SEQ ID NO: 4189 - protein, 221 aa, Artificial Sequence
  Description of Artificial Sequence: Synthetic polypeptide
  XENP019341 [CTLA-4]_H0.127_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4190 - protein, 118 aa, Artificial Sequence; identical to SEQ ID NO: 1327
  Description of Artificial Sequence: Synthetic polypeptide
  VH of XENP019341

SEQ ID NO: 4191 - protein, 5 aa, Artificial Sequence
  Description of Artificial Sequence: Synthetic peptide
  XENP019341 vhCDR1
SYTMH

SEQ ID NO: 4192 - protein, 17 aa, Artificial Sequence
  Description of Artificial Sequence: Synthetic peptide
  XENP019341 vhCDR2
FISYDGNNKYYADSVKG

SEQ ID NO: 4193 - protein, 9 aa, Artificial Sequence
  Description of Artificial Sequence: Synthetic peptide
  XENP019341 vhCDR3
TGWLGPFNY

SEQ ID NO: 4194 - protein, 215 aa, Artificial Sequence; identical to SEQ ID NO: 2924
  Description of Artificial Sequence: Synthetic polypeptide
  XENP019341 [CTLA-4]_H0.127_L0_Fab Light Chain

SEQ ID NO: 4195 - protein, 108 aa, Artificial Sequence; identical to SEQ ID NO: 23
  Description of Artificial Sequence: Synthetic polypeptide
  VL of XENP019341

SEQ ID NO: 4196 - protein, 12 aa, Artificial Sequence
  Description of Artificial Sequence: Synthetic peptide
  XENP019341 vlCDR1
RASQSVGSSYLA

SEQ ID NO: 4197 - protein, 7 aa, Artificial Sequence
  Description of Artificial Sequence: Synthetic peptide
  XENP019341 vlCDR2
GAFSRAT

SEQ ID NO: 4198 - protein, 9 aa, Artificial Sequence
  Description of Artificial Sequence: Synthetic peptide
  XENP019341 vlCDR3
QQYGSSPWT

SEQ ID NO: 4199 - protein, 221 aa, Artificial Sequence
  Description of Artificial Sequence: Synthetic polypeptide
  XENP019342 [CTLA-4]_H0.128_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFSYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4200 - protein, 118 aa, Artificial Sequence; identical to SEQ ID NO: 1336
  Description of Artificial Sequence: Synthetic polypeptide
  VH of XENP019342

SEQ ID NO: 4201 - protein, 5 aa, Artificial Sequence
  Description of Artificial Sequence: Synthetic peptide
  XENP019342 vhCDR1
SYTMH

SEQ ID NO: 4202 - protein, 17 aa, Artificial Sequence
  Description of Artificial Sequence: Synthetic peptide
  XENP019342 vhCDR2
FISYDGNNKYYADSVKG

SEQ ID NO: 4203 - protein, 9 aa, Artificial Sequence
  Description of Artificial Sequence: Synthetic peptide
  XENP019342 vhCDR3
TGWLGPFSY

SEQ ID NO: 4204 - protein, 215 aa, Artificial Sequence; identical to SEQ ID NO: 2924
  Description of Artificial Sequence: Synthetic polypeptide
  XENP019342 [CTLA-4]_H0.128_L0_Fab Light Chain

SEQ ID NO: 4205 - protein, 108 aa, Artificial Sequence; identical to SEQ ID NO: 23
  Description of Artificial Sequence: Synthetic polypeptide
  VL of XENP019342

SEQ ID NO: 4206 - protein, 12 aa, Artificial Sequence
  Description of Artificial Sequence: Synthetic peptide
  XENP019342 vlCDR1
RASQSVGSSYLA

SEQ ID NO: 4207 - protein, 7 aa, Artificial Sequence
  Description of Artificial Sequence: Synthetic peptide
  XENP019342 vlCDR2
GAFSRAT

SEQ ID NO: 4208 - protein, 9 aa, Artificial Sequence
  Description of Artificial Sequence: Synthetic peptide
  XENP019342 vlCDR3
QQYGSSPWT

SEQ ID NO: 4209 - protein, 221 aa, Artificial Sequence
  Description of Artificial Sequence: Synthetic polypeptide
  XENP019343 [CTLA-4]_H0.129_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFQYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4210 - protein, 118 aa, Artificial Sequence; identical to SEQ ID NO: 1345
  Description of Artificial Sequence: Synthetic polypeptide
  VH of XENP019343

SEQ ID NO: 4211 - protein, 5 aa, Artificial Sequence
  Description of Artificial Sequence: Synthetic peptide
  XENP019343 vhCDR1
SYTMH

SEQ ID NO: 4212 - protein, 17 aa, Artificial Sequence
  Description of Artificial Sequence: Synthetic peptide
  XENP019343 vhCDR2
FISYDGNNKYYADSVKG

SEQ ID NO: 4213 - protein, 9 aa, Artificial Sequence
  Description of Artificial Sequence: Synthetic peptide
  XENP019343 vhCDR3
TGWLGPFQY

SEQ ID NO: 4214 - protein, 215 aa, Artificial Sequence; identical to SEQ ID NO: 2924
  Description of Artificial Sequence: Synthetic polypeptide
  XENP019343 [CTLA-4]_H0.129_L0_Fab Light Chain

SEQ ID NO: 4215 - protein, 108 aa, Artificial Sequence; identical to SEQ ID NO: 23
  Description of Artificial Sequence: Synthetic polypeptide
  VL of XENP019343

SEQ ID NO: 4216 - protein, 12 aa, Artificial Sequence
  Description of Artificial Sequence: Synthetic peptide
  XENP019343 vlCDR1
RASQSVGSSYLA

SEQ ID NO: 4217 - protein, 7 aa, Artificial Sequence
  Description of Artificial Sequence: Synthetic peptide
  XENP019343 vlCDR2
GAFSRAT

SEQ ID NO: 4218 - protein, 9 aa, Artificial Sequence
  Description of Artificial Sequence: Synthetic peptide
  XENP019343 vlCDR3
QQYGSSPWT

SEQ ID NO: 4219 - protein, 221 aa, Artificial Sequence
  Description of Artificial Sequence: Synthetic polypeptide
  XENP019344 [CTLA-4]_H0.130_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4220 - protein, 118 aa, Artificial Sequence; identical to SEQ ID NO: 1354
  Description of Artificial Sequence: Synthetic polypeptide
  VH of XENP019344

SEQ ID NO: 4221 - protein, 5 aa, Artificial Sequence
  Description of Artificial Sequence: Synthetic peptide
  XENP019344 vhCDR1
SYTMH

SEQ ID NO: 4222 - protein, 17 aa, Artificial Sequence
  Description of Artificial Sequence: Synthetic peptide
  XENP019344 vhCDR2
FISYDGNNKYYADSVKG

SEQ ID NO: 4223 - protein, 9 aa, Artificial Sequence
  Description of Artificial Sequence: Synthetic peptide
  XENP019344 vhCDR3
TGWLGPFDH

SEQ ID NO: 4224 - protein, 215 aa, Artificial Sequence; identical to SEQ ID NO: 2924
  Description of Artificial Sequence: Synthetic polypeptide
  XENP019344 [CTLA-4]_H0.130_L0_Fab Light Chain

SEQ ID NO: 4225 - protein, 108 aa, Artificial Sequence; identical to SEQ ID NO: 23
  Description of Artificial Sequence: Synthetic polypeptide
  VL of XENP019344

SEQ ID NO: 4226 - protein, 12 aa, Artificial Sequence
  Description of Artificial Sequence: Synthetic peptide
  XENP019344 vlCDR1
RASQSVGSSYLA

SEQ ID NO: 4227 - protein, 7 aa, Artificial Sequence
  Description of Artificial Sequence: Synthetic peptide
  XENP019344 vlCDR2
GAFSRAT

SEQ ID NO: 4228 - protein, 9 aa, Artificial Sequence
  Description of Artificial Sequence: Synthetic peptide
  XENP019344 vlCDR3
QQYGSSPWT

SEQ ID NO: 4229 - protein, 221 aa, Artificial Sequence
  Description of Artificial Sequence: Synthetic polypeptide
  XENP019345 [CTLA-4]_H0.131_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4230 - protein, 118 aa, Artificial Sequence; identical to SEQ ID NO: 1363
  Description of Artificial Sequence: Synthetic polypeptide
  VH of XENP019345

SEQ ID NO: 4231 - protein, 5 aa, Artificial Sequence
  Description of Artificial Sequence: Synthetic peptide
  XENP019345 vhCDR1
SYTMH

SEQ ID NO: 4232 - protein, 17 aa, Artificial Sequence
  Description of Artificial Sequence: Synthetic peptide
  XENP019345 vhCDR2
FISYDGNNKYYADSVKG

SEQ ID NO: 4233 - protein, 9 aa, Artificial Sequence
  Description of Artificial Sequence: Synthetic peptide
  XENP019345 vhCDR3
TGWLGPFDL

SEQ ID NO: 4234 - protein, 215 aa, Artificial Sequence; identical to SEQ ID NO: 2924
  Description of Artificial Sequence: Synthetic polypeptide
  XENP019345 [CTLA-4]_H0.131_L0_Fab Light Chain

SEQ ID NO: 4235 - protein, 108 aa, Artificial Sequence; identical to SEQ ID NO: 23
  Description of Artificial Sequence: Synthetic polypeptide
  VL of XENP019345

SEQ ID NO: 4236 - protein, 12 aa, Artificial Sequence
  Description of Artificial Sequence: Synthetic peptide
  XENP019345 vlCDR1
RASQSVGSSYLA

SEQ ID NO: 4237 - protein, 7 aa, Artificial Sequence
  Description of Artificial Sequence: Synthetic peptide
  XENP019345 vlCDR2
GAFSRAT

SEQ ID NO: 4238 - protein, 9 aa, Artificial Sequence
  Description of Artificial Sequence: Synthetic peptide
  XENP019345 vlCDR3
QQYGSSPWT

SEQ ID NO: 4239 - protein, 221 aa, Artificial Sequence
  Description of Artificial Sequence: Synthetic polypeptide
  XENP019346 [CTLA-4]_H0.132_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4240 - protein, 118 aa, Artificial Sequence; identical to SEQ ID NO: 1372
  Description of Artificial Sequence: Synthetic polypeptide
  VH of XENP019346

SEQ ID NO: 4241 - protein, 5 aa, Artificial Sequence
  Description of Artificial Sequence: Synthetic peptide
  XENP019346 vhCDR1
SYTMH

SEQ ID NO: 4242 - protein, 17 aa, Artificial Sequence
  Description of Artificial Sequence: Synthetic peptide
  XENP019346 vhCDR2
FISYDGNNKYYADSVKG

SEQ ID NO: 4243 - protein, 9 aa, Artificial Sequence
  Description of Artificial Sequence: Synthetic peptide
  XENP019346 vhCDR3
TGWLGPFDS

SEQ ID NO: 4244 - protein, 215 aa, Artificial Sequence; identical to SEQ ID NO: 2924
  Description of Artificial Sequence: Synthetic polypeptide
  XENP019346 [CTLA-4]_H0.132_L0_Fab Light Chain

SEQ ID NO: 4245 - protein, 108 aa, Artificial Sequence; identical to SEQ ID NO: 23
  Description of Artificial Sequence: Synthetic polypeptide
  VL of XENP019346

SEQ ID NO: 4246 - protein, 12 aa, Artificial Sequence
  Description of Artificial Sequence: Synthetic peptide
  XENP019346 vlCDR1
RASQSVGSSYLA

SEQ ID NO: 4247 - protein, 7 aa, Artificial Sequence
  Description of Artificial Sequence: Synthetic peptide
  XENP019346 vlCDR2
GAFSRAT

SEQ ID NO: 4248 - protein, 9 aa, Artificial Sequence
  Description of Artificial Sequence: Synthetic peptide
  XENP019346 vlCDR3
QQYGSSPWT

SEQ ID NO: 4249 - protein, 221 aa, Artificial Sequence
  Description of Artificial Sequence: Synthetic polypeptide
  XENP019347 [CTLA-4]_H0.133_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4250 - protein, 118 aa, Artificial Sequence; identical to SEQ ID NO: 1381
  Description of Artificial Sequence: Synthetic polypeptide
  VH of XENP019347

SEQ ID NO: 4251 - protein, 5 aa, Artificial Sequence
  Description of Artificial Sequence: Synthetic peptide
  XENP019347 vhCDR1
SYTMH

SEQ ID NO: 4252 - protein, 17 aa, Artificial Sequence
  Description of Artificial Sequence: Synthetic peptide
  XENP019347 vhCDR2
FISYDGNNKYYADSVKG

SEQ ID NO: 4253 - protein, 9 aa, Artificial Sequence
  Description of Artificial Sequence: Synthetic peptide
  XENP019347 vhCDR3
TGWLGPFDV

SEQ ID NO: 4254 - protein, 215 aa, Artificial Sequence; identical to SEQ ID NO: 2924
  Description of Artificial Sequence: Synthetic polypeptide
  XENP019347 [CTLA-4]_H0.133_L0_Fab Light Chain

SEQ ID NO: 4255 - protein, 108 aa, Artificial Sequence; identical to SEQ ID NO: 23
  Description of Artificial Sequence: Synthetic polypeptide
  VL of XENP019347

SEQ ID NO: 4256 - protein, 12 aa, Artificial Sequence
  Description of Artificial Sequence: Synthetic peptide
  XENP019347 vlCDR1
RASQSVGSSYLA

SEQ ID NO: 4257 - protein, 7 aa, Artificial Sequence
  Description of Artificial Sequence: Synthetic peptide
  XENP019347 vlCDR2
GAFSRAT

SEQ ID NO: 4258 - protein, 9 aa, Artificial Sequence
  Description of Artificial Sequence: Synthetic peptide
  XENP019347 vlCDR3
QQYGSSPWT

SEQ ID NO: 4259 - protein, 221 aa, Artificial Sequence
  Description of Artificial Sequence: Synthetic polypeptide
  XENP019348 [CTLA-4]_H0.134_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4260 - protein, 118 aa, Artificial Sequence; identical to SEQ ID NO: 67
  Description of Artificial Sequence: Synthetic polypeptide
  VH of XENP019348

SEQ ID NO: 4261 - protein, 5 aa, Artificial Sequence
  Description of Artificial Sequence: Synthetic peptide
  XENP019348 vhCDR1
SYTMH

SEQ ID NO: 4262 - protein, 17 aa, Artificial Sequence
  Description of Artificial Sequence: Synthetic peptide
  XENP019348 vhCDR2
FISYDGNNKYYADSVKG

SEQ ID NO: 4263 - protein, 9 aa, Artificial Sequence
  Description of Artificial Sequence: Synthetic peptide
  XENP019348 vhCDR3
TGWLGPFDY

SEQ ID NO: 4264 - protein, 215 aa, Artificial Sequence; identical to SEQ ID NO: 2924
  Description of Artificial Sequence: Synthetic polypeptide
  XENP019348 [CTLA-4]_H0.134_L0_Fab Light Chain

SEQ ID NO: 4265 - protein, 108 aa, Artificial Sequence; identical to SEQ ID NO: 23
  Description of Artificial Sequence: Synthetic polypeptide
  VL of XENP019348

SEQ ID NO: 4266 - protein, 12 aa, Artificial Sequence
  Description of Artificial Sequence: Synthetic peptide
  XENP019348 vlCDR1
RASQSVGSSYLA

SEQ ID NO: 4267 - protein, 7 aa, Artificial Sequence
  Description of Artificial Sequence: Synthetic peptide
  XENP019348 vlCDR2
GAFSRAT

SEQ ID NO: 4268 - protein, 9 aa, Artificial Sequence
  Description of Artificial Sequence: Synthetic peptide
  XENP019348 vlCDR3
QQYGSSPWT

SEQ ID NO: 4269 - protein, 221 aa, Artificial Sequence
  Description of Artificial Sequence: Synthetic polypeptide
  XENP019349 [CTLA-4]_H0.135_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4270 - protein, 118 aa, Artificial Sequence; identical to SEQ ID NO: 1399
  Description of Artificial Sequence: Synthetic polypeptide
  VH of XENP019349

SEQ ID NO: 4271 - protein, 5 aa, Artificial Sequence
  Description of Artificial Sequence: Synthetic peptide
  XENP019349 vhCDR1
SYTMH

SEQ ID NO: 4272 - protein, 17 aa, Artificial Sequence
  Description of Artificial Sequence: Synthetic peptide
  XENP019349 vhCDR2
FISYDGNNKYYADSVKG

SEQ ID NO: 4273 - protein, 9 aa, Artificial Sequence
  Description of Artificial Sequence: Synthetic peptide
  XENP019349 vhCDR3
TGWLGPFDY

SEQ ID NO: 4274 - protein, 215 aa, Artificial Sequence; identical to SEQ ID NO: 2924
  Description of Artificial Sequence: Synthetic polypeptide
  XENP019349 [CTLA-4]_H0.135_L0_Fab Light Chain

SEQ ID NO: 4275 - protein, 108 aa, Artificial Sequence; identical to SEQ ID NO: 23
  Description of Artificial Sequence: Synthetic polypeptide
  VL of XENP019349

SEQ ID NO: 4276 - protein, 12 aa, Artificial Sequence
  Description of Artificial Sequence: Synthetic peptide
  XENP019349 vlCDR1
RASQSVGSSYLA

SEQ ID NO: 4277 - protein, 7 aa, Artificial Sequence
  Description of Artificial Sequence: Synthetic peptide
  XENP019349 vlCDR2
GAFSRAT

SEQ ID NO: 4278 - protein, 9 aa, Artificial Sequence
  Description of Artificial Sequence: Synthetic peptide
  XENP019349 vlCDR3
QQYGSSPWT

SEQ ID NO: 4279 - protein, 221 aa, Artificial Sequence
  Description of Artificial Sequence: Synthetic polypeptide
  XENP019350 [CTLA-4]_H0.136_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4280 - protein, 118 aa, Artificial Sequence; identical to SEQ ID NO: 1408
  Description of Artificial Sequence: Synthetic polypeptide
  VH of XENP019350

SEQ ID NO: 4281 - protein, 5 aa, Artificial Sequence
  Description of Artificial Sequence: Synthetic peptide
  XENP019350 vhCDR1
SYTMH

SEQ ID NO: 4282 - protein, 17 aa, Artificial Sequence
  Description of Artificial Sequence: Synthetic peptide
  XENP019350 vhCDR2
FISYDGNNKYYADSVKG

SEQ ID NO: 4283 - protein, 9 aa, Artificial Sequence
  Description of Artificial Sequence: Synthetic peptide
  XENP019350 vhCDR3
TGWLGPFDY

SEQ ID NO: 4284 - protein, 215 aa, Artificial Sequence; identical to SEQ ID NO: 2924
  Description of Artificial Sequence: Synthetic polypeptide
  XENP019350 [CTLA-4]_H0.136_L0_Fab Light Chain

SEQ ID NO: 4285 - protein, 108 aa, Artificial Sequence; identical to SEQ ID NO: 23
  Description of Artificial Sequence: Synthetic polypeptide
  VL of XENP019350

SEQ ID NO: 4286 - protein, 12 aa, Artificial Sequence
  Description of Artificial Sequence: Synthetic peptide
  XENP019350 vlCDR1
RASQSVGSSYLA

SEQ ID NO: 4287 - protein, 7 aa, Artificial Sequence
  Description of Artificial Sequence: Synthetic peptide
  XENP019350 vlCDR2
GAFSRAT

SEQ ID NO: 4288 - protein, 9 aa, Artificial Sequence
  Description of Artificial Sequence: Synthetic peptide
  XENP019350 vlCDR3
QQYGSSPWT

SEQ ID NO: 4289 - protein, 221 aa, Artificial Sequence; identical to SEQ ID NO: 2919
  Description of Artificial Sequence: Synthetic polypeptide
  XENP019416 [CTLA-4]_H0_L0.1_Fab Heavy Chain

SEQ ID NO: 4290 - protein, 118 aa, Artificial Sequence; identical to SEQ ID NO: 22
  Description of Artificial Sequence: Synthetic polypeptide
  VH of XENP019416

SEQ ID NO: 4291 - protein, 5 aa, Artificial Sequence
  Description of Artificial Sequence: Synthetic peptide
  XENP019416 vhCDR1
SYTMH

SEQ ID NO: 4292 - protein, 17 aa, Artificial Sequence
  Description of Artificial Sequence: Synthetic peptide
  XENP019416 vhCDR2
FISYDGNNKYYADSVKG

SEQ ID NO: 4293 - protein, 9 aa, Artificial Sequence
  Description of Artificial Sequence: Synthetic peptide
  XENP019416 vhCDR3
TGWLGPFDY

SEQ ID NO: 4294 - protein, 215 aa, Artificial Sequence
  Description of Artificial Sequence: Synthetic polypeptide
  XENP019416 [CTLA-4]_H0_L0.1_Fab Light Chain
AIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4295 - protein, 108 aa, Artificial Sequence; identical to SEQ ID NO: 1418
  Description of Artificial Sequence: Synthetic polypeptide
  VL of XENP019416

SEQ ID NO: 4296 - protein, 12 aa, Artificial Sequence
  Description of Artificial Sequence: Synthetic peptide
  XENP019416 vlCDR1
RASQSVGSSYLA

SEQ ID NO: 4297 - protein, 7 aa, Artificial Sequence
  Description of Artificial Sequence: Synthetic peptide
  XENP019416 vlCDR2
GAFSRAT

SEQ ID NO: 4298 - protein, 9 aa, Artificial Sequence
  Description of Artificial Sequence: Synthetic peptide
  XENP019416 vlCDR3
QQYGSSPWT

SEQ ID NO: 4299 - protein, 221 aa, Artificial Sequence; identical to SEQ ID NO: 2919
  Description of Artificial Sequence: Synthetic polypeptide
  XENP019417 [CTLA-4]_H0_L0.2_Fab Heavy Chain

SEQ ID NO: 4300 - protein, 118 aa, Artificial Sequence; identical to SEQ ID NO: 22
  Description of Artificial Sequence: Synthetic polypeptide
  VH of XENP019417

SEQ ID NO: 4301 - protein, 5 aa, Artificial Sequence
  Description of Artificial Sequence: Synthetic peptide
  XENP019417 vhCDR1
SYTMH

SEQ ID NO: 4302 - protein, 17 aa, Artificial Sequence
  Description of Artificial Sequence: Synthetic peptide
  XENP019417 vhCDR2
FISYDGNNKYYADSVKG

SEQ ID NO: 4303 - protein, 9 aa, Artificial Sequence
  Description of Artificial Sequence: Synthetic peptide
  XENP019417 vhCDR3
TGWLGPFDY

SEQ ID NO: 4304 - protein, 215 aa, Artificial Sequence
  Description of Artificial Sequence: Synthetic polypeptide
  XENP019417 [CTLA-4]_H0_L0.2_Fab Light Chain
DIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4305 - protein, 108 aa, Artificial Sequence; identical to SEQ ID NO: 1427
  Description of Artificial Sequence: Synthetic polypeptide
  VL of XENP019417

SEQ ID NO: 4306 - protein, 12 aa, Artificial Sequence
  Description of Artificial Sequence: Synthetic peptide
  XENP019417 vlCDR1
RASQSVGSSYLA

SEQ ID NO: 4307 - protein, 7 aa, Artificial Sequence
  Description of Artificial Sequence: Synthetic peptide
  XENP019417 vlCDR2
GAFSRAT

SEQ ID NO: 4308 - protein, 9 aa, Artificial Sequence
  Description of Artificial Sequence: Synthetic peptide
  XENP019417 vlCDR3
QQYGSSPWT

SEQ ID NO: 4309 - protein, 221 aa, Artificial Sequence; identical to SEQ ID NO: 2919
  Description of Artificial Sequence: Synthetic polypeptide
  XENP019418 [CTLA-4]_H0_L0.3_Fab Heavy Chain

SEQ ID NO: 4310 - protein, 118 aa, Artificial Sequence; identical to SEQ ID NO: 22
  Description of Artificial Sequence: Synthetic polypeptide
  VH of XENP019418

SEQ ID NO: 4311 - protein, 5 aa, Artificial Sequence
  Description of Artificial Sequence: Synthetic peptide
  XENP019418 vhCDR1
SYTMH

SEQ ID NO: 4312 - protein, 17 aa, Artificial Sequence
  Description of Artificial Sequence: Synthetic peptide
  XENP019418 vhCDR2
FISYDGNNKYYADSVKG

SEQ ID NO: 4313 - protein, 9 aa, Artificial Sequence
  Description of Artificial Sequence: Synthetic peptide
  XENP019418 vhCDR3
TGWLGPFDY

SEQ ID NO: 4314 - protein, 215 aa, Artificial Sequence
  Description of Artificial Sequence: Synthetic polypeptide
  XENP019418 [CTLA-4]_H0_L0.3_Fab Light Chain
QIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4315 - protein, 108 aa, Artificial Sequence; identical to SEQ ID NO: 1436
  Description of Artificial Sequence: Synthetic polypeptide
  VL of XENP019418

SEQ ID NO: 4316 - protein, 12 aa, Artificial Sequence
  Description of Artificial Sequence: Synthetic peptide
  XENP019418 vlCDR1
RASQSVGSSYLA

SEQ ID NO: 4317 - protein, 7 aa, Artificial Sequence
  Description of Artificial Sequence: Synthetic peptide
  XENP019418 vlCDR2
GAFSRAT

SEQ ID NO: 4318 - protein, 9 aa, Artificial Sequence
  Description of Artificial Sequence: Synthetic peptide
  XENP019418 vlCDR3
QQYGSSPWT

SEQ ID NO: 4319 - protein, 221 aa, Artificial Sequence; identical to SEQ ID NO: 2919
  Description of Artificial Sequence: Synthetic polypeptide
  XENP019419 [CTLA-4]_H0_L0.4_Fab Heavy Chain

SEQ ID NO: 4320 - protein, 118 aa, Artificial Sequence; identical to SEQ ID NO: 22
  Description of Artificial Sequence: Synthetic polypeptide
  VH of XENP019419

SEQ ID NO: 4321 - protein, 5 aa, Artificial Sequence
  Description of Artificial Sequence: Synthetic peptide
  XENP019419 vhCDR1
SYTMH

SEQ ID NO: 4322 - protein, 17 aa, Artificial Sequence
  Description of Artificial Sequence: Synthetic peptide
  XENP019419 vhCDR2
FISYDGNNKYYADSVKG

SEQ ID NO: 4323 - protein, 9 aa, Artificial Sequence
  Description of Artificial Sequence: Synthetic peptide
  XENP019419 vhCDR3
TGWLGPFDY

SEQ ID NO: 4324 - protein, 215 aa, Artificial Sequence
  Description of Artificial Sequence: Synthetic polypeptide
  XENP019419 [CTLA-4]_H0_L0.4_Fab Light Chain
RIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4325 - protein, 108 aa, Artificial Sequence; identical to SEQ ID NO: 1445
  Description of Artificial Sequence: Synthetic polypeptide
  VL of XENP019419

SEQ ID NO: 4326 - protein, 12 aa, Artificial Sequence
  Description of Artificial Sequence: Synthetic peptide
  XENP019419 vlCDR1
RASQSVGSSYLA

SEQ ID NO: 4327 - protein, 7 aa, Artificial Sequence
  Description of Artificial Sequence: Synthetic peptide
  XENP019419 vlCDR2
GAFSRAT

SEQ ID NO: 4328 - protein, 9 aa, Artificial Sequence
  Description of Artificial Sequence: Synthetic peptide
  XENP019419 vlCDR3
QQYGSSPWT

SEQ ID NO: 4329 - protein, 221 aa, Artificial Sequence; identical to SEQ ID NO: 2919
  Description of Artificial Sequence: Synthetic polypeptide
  XENP019420 [CTLA-4]_H0_L0.5_Fab Heavy Chain

SEQ ID NO: 4330 - protein, 118 aa, Artificial Sequence; identical to SEQ ID NO: 22
  Description of Artificial Sequence: Synthetic polypeptide
  VH of XENP019420

SEQ ID NO: 4331 - protein, 5 aa, Artificial Sequence
  Description of Artificial Sequence: Synthetic peptide
  XENP019420 vhCDR1
SYTMH

SEQ ID NO: 4332 - protein, 17 aa, Artificial Sequence
  Description of Artificial Sequence: Synthetic peptide
  XENP019420 vhCDR2
FISYDGNNKYYADSVKG

SEQ ID NO: 4333 - protein, 9 aa, Artificial Sequence
  Description of Artificial Sequence: Synthetic peptide
  XENP019420 vhCDR3
TGWLGPFDY

SEQ ID NO: 4334 - protein, 215 aa, Artificial Sequence
  Description of Artificial Sequence: Synthetic polypeptide
  XENP019420 [CTLA-4]_H0_L0.5_Fab Light Chain
EIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4335 - protein, 108 aa, Artificial Sequence; identical to SEQ ID NO: 1454
  Description of Artificial Sequence: Synthetic polypeptide
  VL of XENP019420

SEQ ID NO: 4336 - protein, 12 aa, Artificial Sequence
  Description of Artificial Sequence: Synthetic peptide
  XENP019420 vlCDR1
RASQSVGSSYLA

SEQ ID NO: 4337 - protein, 7 aa, Artificial Sequence
  Description of Artificial Sequence: Synthetic peptide
  XENP019420 vlCDR2
GAFSRAT

SEQ ID NO: 4338 - protein, 9 aa, Artificial Sequence
  Description of Artificial Sequence: Synthetic peptide
  XENP019420 vlCDR3
QQYGSSPWT

SEQ ID NO: 4339 - protein, 221 aa, Artificial Sequence; identical to SEQ ID NO: 2919
  Description of Artificial Sequence: Synthetic polypeptide
  XENP019421 [CTLA-4]_H0_L0.6_Fab Heavy Chain

SEQ ID NO: 4340 - protein, 118 aa, Artificial Sequence; identical to SEQ ID NO: 22
  Description of Artificial Sequence: Synthetic polypeptide
  VH of XENP019421

SEQ ID NO: 4341 - protein, 5 aa, Artificial Sequence
  Description of Artificial Sequence: Synthetic peptide
  XENP019421 vhCDR1
SYTMH

SEQ ID NO: 4342 - protein, 17 aa, Artificial Sequence
  Description of Artificial Sequence: Synthetic peptide
  XENP019421 vhCDR2
FISYDGNNKYYADSVKG

SEQ ID NO: 4343 - protein, 9 aa, Artificial Sequence
  Description of Artificial Sequence: Synthetic peptide
  XENP019421 vhCDR3
TGWLGPFDY

SEQ ID NO: 4344 - protein, 215 aa, Artificial Sequence
  Description of Artificial Sequence: Synthetic polypeptide
  XENP019421 [CTLA-4]_H0_L0.6_Fab Light Chain
EIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4345 - protein, 108 aa, Artificial Sequence; identical to SEQ ID NO: 1463
  Description of Artificial Sequence: Synthetic polypeptide
  VL of XENP019421

SEQ ID NO: 4346 - protein, 12 aa, Artificial Sequence
  Description of Artificial Sequence: Synthetic peptide
  XENP019421 vlCDR1
RASQSVGSSYLA

SEQ ID NO: 4347 - protein, 7 aa, Artificial Sequence
  Description of Artificial Sequence: Synthetic peptide
  XENP019421 vlCDR2
GAFSRAT

SEQ ID NO: 4348 - protein, 9 aa, Artificial Sequence
  Description of Artificial Sequence: Synthetic peptide
  XENP019421 vlCDR3
QQYGSSPWT

SEQ ID NO: 4349 - protein, 221 aa, Artificial Sequence; identical to SEQ ID NO: 2919
  Description of Artificial Sequence: Synthetic polypeptide
  XENP019422 [CTLA-4]_H0_L0.7_Fab Heavy Chain

SEQ ID NO: 4350 - protein, 118 aa, Artificial Sequence; identical to SEQ ID NO: 22
  Description of Artificial Sequence: Synthetic polypeptide
  VH of XENP019422

SEQ ID NO: 4351 - protein, 5 aa, Artificial Sequence
  Description of Artificial Sequence: Synthetic peptide
  XENP019422 vhCDR1
SYTMH

SEQ ID NO: 4352 - protein, 17 aa, Artificial Sequence
  Description of Artificial Sequence: Synthetic peptide
  XENP019422 vhCDR2
FISYDGNNKYYADSVKG

SEQ ID NO: 4353 - protein, 9 aa, Artificial Sequence
  Description of Artificial Sequence: Synthetic peptide
  XENP019422 vhCDR3
TGWLGPFDY

SEQ ID NO: 4354 - protein, 215 aa, Artificial Sequence
  Description of Artificial Sequence: Synthetic polypeptide
  XENP019422 [CTLA-4]_H0_L0.7_Fab Light Chain
EIVMTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4355 - protein, 108 aa, Artificial Sequence; identical to SEQ ID NO: 1472
  Description of Artificial Sequence: Synthetic polypeptide
  VL of XENP019422

SEQ ID NO: 4356 - protein, 12 aa, Artificial Sequence
  Description of Artificial Sequence: Synthetic peptide
  XENP019422 vlCDR1
RASQSVGSSYLA

SEQ ID NO: 4357 - protein, 7 aa, Artificial Sequence
  Description of Artificial Sequence: Synthetic peptide
  XENP019422 vlCDR2
GAFSRAT

SEQ ID NO: 4358 - protein, 9 aa, Artificial Sequence
  Description of Artificial Sequence: Synthetic peptide
  XENP019422 vlCDR3
QQYGSSPWT

SEQ ID NO: 4359 - protein, 221 aa, Artificial Sequence; identical to SEQ ID NO: 2919
  Description of Artificial Sequence: Synthetic polypeptide
  XENP019423 [CTLA-4]_H0_L0.8_Fab Heavy Chain

SEQ ID NO: 4360 - protein, 118 aa, Artificial Sequence; identical to SEQ ID NO: 22
  Description of Artificial Sequence: Synthetic polypeptide
  VH of XENP019423

SEQ ID NO: 4361 - protein, 5 aa, Artificial Sequence
  Description of Artificial Sequence: Synthetic peptide
  XENP019423 vhCDR1
SYTMH

SEQ ID NO: 4362 - protein, 17 aa, Artificial Sequence
  Description of Artificial Sequence: Synthetic peptide
  XENP019423 vhCDR2
FISYDGNNKYYADSVKG

SEQ ID NO: 4363 - protein, 9 aa, Artificial Sequence
  Description of Artificial Sequence: Synthetic peptide
  XENP019423 vhCDR3
TGWLGPFDY

SEQ ID NO: 4364 - protein, 215 aa, Artificial Sequence
  Description of Artificial Sequence: Synthetic polypeptide
  XENP019423 [CTLA-4]_H0_L0.8_Fab Light Chain
EIVLTQSPATLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4365 - protein, 108 aa, Artificial Sequence; identical to SEQ ID NO: 1481
  Description of Artificial Sequence: Synthetic polypeptide
  VL of XENP019423

SEQ ID NO: 4366 - protein, 12 aa, Artificial Sequence
  Description of Artificial Sequence: Synthetic peptide
  XENP019423 vlCDR1
RASQSVGSSYLA

SEQ ID NO: 4367 - protein, 7 aa, Artificial Sequence
  Description of Artificial Sequence: Synthetic peptide
  XENP019423 vlCDR2
GAFSRAT

SEQ ID NO: 4368 - protein, 9 aa, Artificial Sequence
  Description of Artificial Sequence: Synthetic peptide
  XENP019423 vlCDR3
QQYGSSPWT

SEQ ID NO: 4369 - protein, 221 aa, Artificial Sequence; identical to SEQ ID NO: 2919
  Description of Artificial Sequence: Synthetic polypeptide
  XENP019424 [CTLA-4]_H0_L0.9_Fab Heavy Chain

SEQ ID NO: 4370 - protein, 118 aa, Artificial Sequence; identical to SEQ ID NO: 22
  Description of Artificial Sequence: Synthetic polypeptide
  VH of XENP019424

SEQ ID NO: 4371 - protein, 5 aa, Artificial Sequence
  Description of Artificial Sequence: Synthetic peptide
  XENP019424 vhCDR1
SYTMH

SEQ ID NO: 4372 - protein, 17 aa, Artificial Sequence
  Description of Artificial Sequence: Synthetic peptide
  XENP019424 vhCDR2
FISYDGNNKYYADSVKG

SEQ ID NO: 4373 - protein, 9 aa, Artificial Sequence
  Description of Artificial Sequence: Synthetic peptide
  XENP019424 vhCDR3
TGWLGPFDY

SEQ ID NO: 4374 - protein, 215 aa, Artificial Sequence
  Description of Artificial Sequence: Synthetic polypeptide
  XENP019424 [CTLA-4]_H0_L0.9_Fab Light Chain
EIVLTQSPPTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4375 - protein, 108 aa, Artificial Sequence; identical to SEQ ID NO: 1490
  Description of Artificial Sequence: Synthetic polypeptide
  VL of XENP019424

SEQ ID NO: 4376 - protein, 12 aa, Artificial Sequence
  Description of Artificial Sequence: Synthetic peptide
  XENP019424 vlCDR1
RASQSVGSSYLA

SEQ ID NO: 4377 - protein, 7 aa, Artificial Sequence
  Description of Artificial Sequence: Synthetic peptide
  XENP019424 vlCDR2
GAFSRAT

SEQ ID NO: 4378 - protein, 9 aa, Artificial Sequence
  Description of Artificial Sequence: Synthetic peptide
  XENP019424 vlCDR3
QQYGSSPWT

SEQ ID NO: 4379 - protein, 221 aa, Artificial Sequence; identical to SEQ ID NO: 2919
  Description of Artificial Sequence: Synthetic polypeptide
  XENP019425 [CTLA-4]_H0_L0.10_Fab Heavy Chain

SEQ ID NO: 4380 - protein, 118 aa, Artificial Sequence; identical to SEQ ID NO: 22
  Description of Artificial Sequence: Synthetic polypeptide
  VH of XENP019425

SEQ ID NO: 4381 - protein, 5 aa, Artificial Sequence
  Description of Artificial Sequence: Synthetic peptide
  XENP019425 vhCDR1
SYTMH

SEQ ID NO: 4382 - protein, 17 aa, Artificial Sequence
  Description of Artificial Sequence: Synthetic peptide
  XENP019425 vhCDR2
FISYDGNNKYYADSVKG

SEQ ID NO: 4383 - protein, 9 aa, Artificial Sequence
  Description of Artificial Sequence: Synthetic peptide
  XENP019425 vhCDR3
TGWLGPFDY

SEQ ID NO: 4384 - protein, 215 aa, Artificial Sequence
  Description of Artificial Sequence: Synthetic polypeptide
  XENP019425 [CTLA-4]_H0_L0.10_Fab Light Chain
EIVLTQSPSTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4385 - protein, 108 aa, Artificial Sequence; identical to SEQ ID NO: 1499
  Description of Artificial Sequence: Synthetic polypeptide
  VL of XENP019425

SEQ ID NO: 4386 - protein, 12 aa, Artificial Sequence
  Description of Artificial Sequence: Synthetic peptide
  XENP019425 vlCDR1
RASQSVGSSYLA

SEQ ID NO: 4387 - protein, 7 aa, Artificial Sequence
  Description of Artificial Sequence: Synthetic peptide
  XENP019425 vlCDR2
GAFSRAT

SEQ ID NO: 4388 - protein, 9 aa, Artificial Sequence
  Description of Artificial Sequence: Synthetic peptide
  XENP019425 vlCDR3
QQYGSSPWT

SEQ ID NO: 4389 - protein, 221 aa, Artificial Sequence; identical to SEQ ID NO: 2919
  Description of Artificial Sequence: Synthetic polypeptide
  XENP019426 [CTLA-4]_H0_L0.11_Fab Heavy Chain

SEQ ID NO: 4390 - protein, 118 aa, Artificial Sequence; identical to SEQ ID NO: 22
  Description of Artificial Sequence: Synthetic polypeptide
  VH of XENP019426

SEQ ID NO: 4391 - protein, 5 aa, Artificial Sequence
  Description of Artificial Sequence: Synthetic peptide
  XENP019426 vhCDR1
SYTMH

SEQ ID NO: 4392 - protein, 17 aa, Artificial Sequence
  Description of Artificial Sequence: Synthetic peptide
  XENP019426 vhCDR2
FISYDGNNKYYADSVKG

SEQ ID NO: 4393 - protein, 9 aa, Artificial Sequence
  Description of Artificial Sequence: Synthetic peptide
  XENP019426 vhCDR3
TGWLGPFDY

SEQ ID NO: 4394 - protein, 215 aa, Artificial Sequence
  Description of Artificial Sequence: Synthetic polypeptide
  XENP019426 [CTLA-4]_H0_L0.11_Fab Light Chain
EIVLTQSPGSLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4395 - protein, 108 aa, Artificial Sequence; identical to SEQ ID NO: 1508
  Description of Artificial Sequence: Synthetic polypeptide
  VL of XENP019426

SEQ ID NO: 4396 - protein, 12 aa, Artificial Sequence
  Description of Artificial Sequence: Synthetic peptide
  XENP019426 vlCDR1
RASQSVGSSYLA

SEQ ID NO: 4397 - protein, 7 aa, Artificial Sequence
  Description of Artificial Sequence: Synthetic peptide
  XENP019426 vlCDR2
GAFSRAT

SEQ ID NO: 4398 - protein, 9 aa, Artificial Sequence
  Description of Artificial Sequence: Synthetic peptide
  XENP019426 vlCDR3
QQYGSSPWT

SEQ ID NO: 4399 - protein, 221 aa, Artificial Sequence; identical to SEQ ID NO: 2919
  Description of Artificial Sequence: Synthetic polypeptide
  XENP019427 [CTLA-4]_H0_L0.12_Fab Heavy Chain

SEQ ID NO: 4400 - protein, 118 aa, Artificial Sequence; identical to SEQ ID NO: 22
  Description of Artificial Sequence: Synthetic polypeptide
  VH of XENP019427

SEQ ID NO: 4401 - protein, 5 aa, Artificial Sequence
  Description of Artificial Sequence: Synthetic peptide
  XENP019427 vhCDR1
SYTMH

SEQ ID NO: 4402 - protein, 17 aa, Artificial Sequence
  Description of Artificial Sequence: Synthetic peptide
  XENP019427 vhCDR2
FISYDGNNKYYADSVKG

SEQ ID NO: 4403 - protein, 9 aa, Artificial Sequence
  Description of Artificial Sequence: Synthetic peptide
  XENP019427 vhCDR3
TGWLGPFDY

SEQ ID NO: 4404 - protein, 215 aa, Artificial Sequence
  Description of Artificial Sequence: Synthetic polypeptide
  XENP019427 [CTLA-4]_H0_L0.12_Fab Light Chain
EIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4405 - protein, 108 aa, Artificial Sequence; identical to SEQ ID NO: 1517
  Description of Artificial Sequence: Synthetic polypeptide
  VL of XENP019427

SEQ ID NO: 4406 - protein, 12 aa, Artificial Sequence
  Description of Artificial Sequence: Synthetic peptide
  XENP019427 vlCDR1
RASQSVGSSYLA

SEQ ID NO: 4407 - protein, 7 aa, Artificial Sequence
  Description of Artificial Sequence: Synthetic peptide
  XENP019427 vlCDR2
GAFSRAT

SEQ ID NO: 4408 - protein, 9 aa, Artificial Sequence
  Description of Artificial Sequence: Synthetic peptide
  XENP019427 vlCDR3
QQYGSSPWT

SEQ ID NO: 4409 - protein, 221 aa, Artificial Sequence; identical to SEQ ID NO: 2919
  Description of Artificial Sequence: Synthetic polypeptide
  XENP019428 [CTLA-4]_H0_L0.13_Fab Heavy Chain

SEQ ID NO: 4410 - protein, 118 aa, Artificial Sequence; identical to SEQ ID NO: 22
  Description of Artificial Sequence: Synthetic polypeptide
  VH of XENP019428

SEQ ID NO: 4411 - protein, 5 aa, Artificial Sequence
  Description of Artificial Sequence: Synthetic peptide
  XENP019428 vhCDR1
SYTMH

SEQ ID NO: 4412 - protein, 17 aa, Artificial Sequence
  Description of Artificial Sequence: Synthetic peptide
  XENP019428 vhCDR2
FISYDGNNKYYADSVKG

SEQ ID NO: 4413 - protein, 9 aa, Artificial Sequence
  Description of Artificial Sequence: Synthetic peptide
  XENP019428 vhCDR3
TGWLGPFDY

SEQ ID NO: 4414 - protein, 215 aa, Artificial Sequence
  Description of Artificial Sequence: Synthetic polypeptide
  XENP019428 [CTLA-4]_H0_L0.13_Fab Light Chain
EIVLTQSPGTLSLSPGEPATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4415 - protein, 108 aa, Artificial Sequence; identical to SEQ ID NO: 1526
  Description of Artificial Sequence: Synthetic polypeptide
  VL of XENP019428

SEQ ID NO: 4416 - protein, 12 aa, Artificial Sequence
  Description of Artificial Sequence: Synthetic peptide
  XENP019428 vlCDR1
RASQSVGSSYLA

SEQ ID NO: 4417 - protein, 7 aa, Artificial Sequence
  Description of Artificial Sequence: Synthetic peptide
  XENP019428 vlCDR2
GAFSRAT

SEQ ID NO: 4418 - protein, 9 aa, Artificial Sequence
  Description of Artificial Sequence: Synthetic peptide
  XENP019428 vlCDR3
QQYGSSPWT

SEQ ID NO: 4419 - protein, 221 aa, Artificial Sequence; identical to SEQ ID NO: 2919
  Description of Artificial Sequence: Synthetic polypeptide
  XENP019429 [CTLA-4]_H0_L0.14_Fab Heavy Chain

SEQ ID NO: 4420 - protein, 118 aa, Artificial Sequence; identical to SEQ ID NO: 22
  Description of Artificial Sequence: Synthetic polypeptide
  VH of XENP019429

SEQ ID NO: 4421 - protein, 5 aa, Artificial Sequence
  Description of Artificial Sequence: Synthetic peptide
  XENP019429 vhCDR1
SYTMH

SEQ ID NO: 4422 - protein, 17 aa, Artificial Sequence
  Description of Artificial Sequence: Synthetic peptide
  XENP019429 vhCDR2
FISYDGNNKYYADSVKG

SEQ ID NO: 4423 - protein, 9 aa, Artificial Sequence
  Description of Artificial Sequence: Synthetic peptide
  XENP019429 vhCDR3
TGWLGPFDY

SEQ ID NO: 4424 - protein, 215 aa, Artificial Sequence
  Description of Artificial Sequence: Synthetic polypeptide
  XENP019429 [CTLA-4]_H0_L0.14_Fab Light Chain
EIVLTQSPGTLSLSPGEQATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4425 - protein, 108 aa, Artificial Sequence; identical to SEQ ID NO: 1535
  Description of Artificial Sequence: Synthetic polypeptide
  VL of XENP019429

SEQ ID NO: 4426 - protein, 12 aa, Artificial Sequence
  Description of Artificial Sequence: Synthetic peptide
  XENP019429 vlCDR1
RASQSVGSSYLA

SEQ ID NO: 4427 - protein, 7 aa, Artificial Sequence
  Description of Artificial Sequence: Synthetic peptide
  XENP019429 vlCDR2
GAFSRAT

SEQ ID NO: 4428 - protein, 9 aa, Artificial Sequence
  Description of Artificial Sequence: Synthetic peptide
  XENP019429 vlCDR3
QQYGSSPWT

SEQ ID NO: 4429 - protein, 221 aa, Artificial Sequence; identical to SEQ ID NO: 2919
  Description of Artificial Sequence: Synthetic polypeptide
  XENP019430 [CTLA-4]_H0_L0.15_Fab Heavy Chain

SEQ ID NO: 4430 - protein, 118 aa, Artificial Sequence; identical to SEQ ID NO: 22
  Description of Artificial Sequence: Synthetic polypeptide
  VH of XENP019430

SEQ ID NO: 4431 - protein, 5 aa, Artificial Sequence
  Description of Artificial Sequence: Synthetic peptide
  XENP019430 vhCDR1
SYTMH

SEQ ID NO: 4432 - protein, 17 aa, Artificial Sequence
  Description of Artificial Sequence: Synthetic peptide
  XENP019430 vhCDR2
FISYDGNNKYYADSVKG

SEQ ID NO: 4433 - protein, 9 aa, Artificial Sequence
  Description of Artificial Sequence: Synthetic peptide
  XENP019430 vhCDR3
TGWLGPFDY

SEQ ID NO: 4434 - protein, 215 aa, Artificial Sequence
  Description of Artificial Sequence: Synthetic polypeptide
  XENP019430 [CTLA-4]_H0_L0.15_Fab Light Chain
EIVLTQSPGTLSLSPGERVTLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4435 - protein, 108 aa, Artificial Sequence; identical to SEQ ID NO: 1544
  Description of Artificial Sequence: Synthetic polypeptide
  VL of XENP019430

SEQ ID NO: 4436 - protein, 12 aa, Artificial Sequence
  Description of Artificial Sequence: Synthetic peptide
  XENP019430 vlCDR1
RASQSVGSSYLA

SEQ ID NO: 4437 - protein, 7 aa, Artificial Sequence
  Description of Artificial Sequence: Synthetic peptide
  XENP019430 vlCDR2
GAFSRAT

SEQ ID NO: 4438 - protein, 9 aa, Artificial Sequence
  Description of Artificial Sequence: Synthetic peptide
  XENP019430 vlCDR3
QQYGSSPWT

SEQ ID NO: 4439 - protein, 221 aa, Artificial Sequence; identical to SEQ ID NO: 2919
  Description of Artificial Sequence: Synthetic polypeptide
  XENP019431 [CTLA-4]_H0_L0.16_Fab Heavy Chain

SEQ ID NO: 4440 - protein, 118 aa, Artificial Sequence; identical to SEQ ID NO: 22
  Description of Artificial Sequence: Synthetic polypeptide
  VH of XENP019431

SEQ ID NO: 4441 - protein, 5 aa, Artificial Sequence
  Description of Artificial Sequence: Synthetic peptide
  XENP019431 vhCDR1
SYTMH

SEQ ID NO: 4442 - protein, 17 aa, Artificial Sequence
  Description of Artificial Sequence: Synthetic peptide
  XENP019431 vhCDR2
FISYDGNNKYYADSVKG

SEQ ID NO: 4443 - protein, 9 aa, Artificial Sequence
  Description of Artificial Sequence: Synthetic peptide
  XENP019431 vhCDR3
TGWLGPFDY

SEQ ID NO: 4444 - protein, 215 aa, Artificial Sequence
  Description of Artificial Sequence: Synthetic polypeptide
  XENP019431 [CTLA-4]_H0_L0.16_Fab Light Chain
EIVLTQSPGTLSLSPGERASLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4445 - protein, 108 aa, Artificial Sequence; identical to SEQ ID NO: 1553
  Description of Artificial Sequence: Synthetic polypeptide
  VL of XENP019431

SEQ ID NO: 4446 - protein, 12 aa, Artificial Sequence
  Description of Artificial Sequence: Synthetic peptide
  XENP019431 vlCDR1
RASQSVGSSYLA

SEQ ID NO: 4447 - protein, 7 aa, Artificial Sequence
  Description of Artificial Sequence: Synthetic peptide
  XENP019431 vlCDR2
GAFSRAT

SEQ ID NO: 4448 - protein, 9 aa, Artificial Sequence
  Description of Artificial Sequence: Synthetic peptide
  XENP019431 vlCDR3
QQYGSSPWT

SEQ ID NO: 4449 - protein, 221 aa, Artificial Sequence; identical to SEQ ID NO: 2919
  Description of Artificial Sequence: Synthetic polypeptide
  XENP019432 [CTLA-4]_H0_L0.17_Fab Heavy Chain

SEQ ID NO: 4450 - protein, 118 aa, Artificial Sequence; identical to SEQ ID NO: 22
  Description of Artificial Sequence: Synthetic polypeptide
  VH of XENP019432

SEQ ID NO: 4451 - protein, 5 aa, Artificial Sequence
  Description of Artificial Sequence: Synthetic peptide
  XENP019432 vhCDR1
SYTMH

SEQ ID NO: 4452 - protein, 17 aa, Artificial Sequence
  Description of Artificial Sequence: Synthetic peptide
  XENP019432 vhCDR2
FISYDGNNKYYADSVKG

SEQ ID NO: 4453 - protein, 9 aa, Artificial Sequence
  Description of Artificial Sequence: Synthetic peptide
  XENP019432 vhCDR3
TGWLGPFDY

SEQ ID NO: 4454 - protein, 215 aa, Artificial Sequence
  Description of Artificial Sequence: Synthetic polypeptide
  XENP019432 [CTLA-4]_H0_L0.17_Fab Light Chain
EIVLTQSPGTLSLSPGERATISCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4455 - protein, 108 aa, Artificial Sequence; identical to SEQ ID NO: 1562
  Description of Artificial Sequence: Synthetic polypeptide
  VL of XENP019432

SEQ ID NO: 4456 - protein, 12 aa, Artificial Sequence
  Description of Artificial Sequence: Synthetic peptide
  XENP019432 vlCDR1
RASQSVGSSYLA

SEQ ID NO: 4457 - protein, 7 aa, Artificial Sequence
  Description of Artificial Sequence: Synthetic peptide
  XENP019432 vlCDR2
GAFSRAT

SEQ ID NO: 4458 - protein, 9 aa, Artificial Sequence
  Description of Artificial Sequence: Synthetic peptide
  XENP019432 vlCDR3
QQYGSSPWT

SEQ ID NO: 4459 - protein, 221 aa, Artificial Sequence; identical to SEQ ID NO: 2919
  Description of Artificial Sequence: Synthetic polypeptide
  XENP019433 [CTLA-4]_H0_L0.18_Fab Heavy Chain

SEQ ID NO: 4460 - protein, 118 aa, Artificial Sequence; identical to SEQ ID NO: 22
  Description of Artificial Sequence: Synthetic polypeptide
  VH of XENP019433

SEQ ID NO: 4461 - protein, 5 aa, Artificial Sequence
  Description of Artificial Sequence: Synthetic peptide
  XENP019433 vhCDR1
SYTMH

SEQ ID NO: 4462 - protein, 17 aa, Artificial Sequence
  Description of Artificial Sequence: Synthetic peptide
  XENP019433 vhCDR2
FISYDGNNKYYADSVKG

SEQ ID NO: 4463 - protein, 9 aa, Artificial Sequence
  Description of Artificial Sequence: Synthetic peptide
  XENP019433 vhCDR3
TGWLGPFDY

SEQ ID NO: 4464 - protein, 215 aa, Artificial Sequence
  Description of Artificial Sequence: Synthetic polypeptide
  XENP019433 [CTLA-4]_H0_L0.18_Fab Light Chain
EIVLTQSPGTLSLSPGERATLSCRSSQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4465 - protein, 108 aa, Artificial Sequence; identical to SEQ ID NO: 1571
  Description of Artificial Sequence: Synthetic polypeptide
  VL of XENP019433

SEQ ID NO: 4466 - protein, 12 aa, Artificial Sequence
  Description of Artificial Sequence: Synthetic peptide
  XENP019433 vlCDR1
RSSQSVGSSYLA

SEQ ID NO: 4467 - protein, 7 aa, Artificial Sequence
  Description of Artificial Sequence: Synthetic peptide
  XENP019433 vlCDR2
GAFSRAT

SEQ ID NO: 4468 - protein, 9 aa, Artificial Sequence
  Description of Artificial Sequence: Synthetic peptide
  XENP019433 vlCDR3
QQYGSSPWT

SEQ ID NO: 4469 - protein, 221 aa, Artificial Sequence; identical to SEQ ID NO: 2919
  Description of Artificial Sequence: Synthetic polypeptide
  XENP019434 [CTLA-4]_H0_L0.19_Fab Heavy Chain

SEQ ID NO: 4470 - protein, 118 aa, Artificial Sequence; identical to SEQ ID NO: 22
  Description of Artificial Sequence: Synthetic polypeptide
  VH of XENP019434

SEQ ID NO: 4471 - protein, 5 aa, Artificial Sequence
  Description of Artificial Sequence: Synthetic peptide
  XENP019434 vhCDR1
SYTMH

SEQ ID NO: 4472 - protein, 17 aa, Artificial Sequence
  Description of Artificial Sequence: Synthetic peptide
  XENP019434 vhCDR2
FISYDGNNKYYADSVKG

SEQ ID NO: 4473 - protein, 9 aa, Artificial Sequence
  Description of Artificial Sequence: Synthetic peptide
  XENP019434 vhCDR3
TGWLGPFDY

SEQ ID NO: 4474 - protein, 215 aa, Artificial Sequence
  Description of Artificial Sequence: Synthetic polypeptide
  XENP019434 [CTLA-4]_H0_L0.19_Fab Light Chain
EIVLTQSPGTLSLSPGERATLSCRASQSDGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4475 - protein, 108 aa, Artificial Sequence; identical to SEQ ID NO: 1580
  Description of Artificial Sequence: Synthetic polypeptide
  VL of XENP019434

SEQ ID NO: 4476 - protein, 12 aa, Artificial Sequence
  Description of Artificial Sequence: Synthetic peptide
  XENP019434 vlCDR1
RASQSDGSSYLA

SEQ ID NO: 4477 - protein, 7 aa, Artificial Sequence
  Description of Artificial Sequence: Synthetic peptide
  XENP019434 vlCDR2
GAFSRAT

SEQ ID NO: 4478 - protein, 9 aa, Artificial Sequence
  Description of Artificial Sequence: Synthetic peptide
  XENP019434 vlCDR3
QQYGSSPWT

SEQ ID NO: 4479 - protein, 221 aa, Artificial Sequence; identical to SEQ ID NO: 2919
  Description of Artificial Sequence: Synthetic polypeptide
  XENP019435 [CTLA-4]_H0_L0.20_Fab Heavy Chain

SEQ ID NO: 4480 - protein, 118 aa, Artificial Sequence; identical to SEQ ID NO: 22
  Description of Artificial Sequence: Synthetic polypeptide
  VH of XENP019435

SEQ ID NO: 4481 - protein, 5 aa, Artificial Sequence
  Description of Artificial Sequence: Synthetic peptide
  XENP019435 vhCDR1
SYTMH

SEQ ID NO: 4482 - protein, 17 aa, Artificial Sequence
  Description of Artificial Sequence: Synthetic peptide
  XENP019435 vhCDR2
FISYDGNNKYYADSVKG

SEQ ID NO: 4483 - protein, 9 aa, Artificial Sequence
  Description of Artificial Sequence: Synthetic peptide
  XENP019435 vhCDR3
TGWLGPFDY

SEQ ID NO: 4484 - protein, 215 aa, Artificial Sequence
  Description of Artificial Sequence: Synthetic polypeptide
  XENP019435 [CTLA-4]_H0_L0.20_Fab Light Chain
EIVLTQSPGTLSLSPGERATLSCRASQSSGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4485 - protein, 108 aa, Artificial Sequence; identical to SEQ ID NO: 1589
  Description of Artificial Sequence: Synthetic polypeptide
  VL of XENP019435

SEQ ID NO: 4486 - protein, 12 aa, Artificial Sequence
  Description of Artificial Sequence: Synthetic peptide
  XENP019435 vlCDR1
RASQSSGSSYLA

SEQ ID NO: 4487 - protein, 7 aa, Artificial Sequence
  Description of Artificial Sequence: Synthetic peptide
  XENP019435 vlCDR2
GAFSRAT

SEQ ID NO: 4488 - protein, 9 aa, Artificial Sequence
  Description of Artificial Sequence: Synthetic peptide
  XENP019435 vlCDR3
QQYGSSPWT

SEQ ID NO: 4489 - protein, 221 aa, Artificial Sequence; identical to SEQ ID NO: 2919
  Description of Artificial Sequence: Synthetic polypeptide
  XENP019436 [CTLA-4]_H0_L0.21_Fab Heavy Chain

SEQ ID NO: 4490 - protein, 118 aa, Artificial Sequence; identical to SEQ ID NO: 22
  Description of Artificial Sequence: Synthetic polypeptide
  VH of XENP019436

SEQ ID NO: 4491 - protein, 5 aa, Artificial Sequence
  Description of Artificial Sequence: Synthetic peptide
  XENP019436 vhCDR1
SYTMH

SEQ ID NO: 4492 - protein, 17 aa, Artificial Sequence
  Description of Artificial Sequence: Synthetic peptide
  XENP019436 vhCDR2
FISYDGNNKYYADSVKG

SEQ ID NO: 4493 - protein, 9 aa, Artificial Sequence
  Description of Artificial Sequence: Synthetic peptide
  XENP019436 vhCDR3
TGWLGPFDY

SEQ ID NO: 4494 - protein, 215 aa, Artificial Sequence
  Description of Artificial Sequence: Synthetic polypeptide
  XENP019436 [CTLA-4]_H0_L0.21_Fab Light Chain
EIVLTQSPGTLSLSPGERATLSCRASQSVASSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4495 - protein, 108 aa, Artificial Sequence; identical to SEQ ID NO: 1598
  Description of Artificial Sequence: Synthetic polypeptide
  VL of XENP019436

SEQ ID NO: 4496 - protein, 12 aa, Artificial Sequence
  Description of Artificial Sequence: Synthetic peptide
  XENP019436 vlCDR1
RASQSVASSYLA

SEQ ID NO: 4497 - protein, 7 aa, Artificial Sequence
  Description of Artificial Sequence: Synthetic peptide
  XENP019436 vlCDR2
GAFSRAT

SEQ ID NO: 4498 - protein, 9 aa, Artificial Sequence
  Description of Artificial Sequence: Synthetic peptide
  XENP019436 vlCDR3
QQYGSSPWT

SEQ ID NO: 4499 - protein, 221 aa, Artificial Sequence; identical to SEQ ID NO: 2919
  Description of Artificial Sequence: Synthetic polypeptide
  XENP019437 [CTLA-4]_H0_L0.22_Fab Heavy Chain

SEQ ID NO: 4500 - protein, 118 aa, Artificial Sequence; identical to SEQ ID NO: 22
  Description of Artificial Sequence: Synthetic polypeptide
  VH of XENP019437

SEQ ID NO: 4501 - protein, 5 aa, Artificial Sequence
  Description of Artificial Sequence: Synthetic peptide
  XENP019437 vhCDR1
SYTMH

SEQ ID NO: 4502 - protein, 17 aa, Artificial Sequence
  Description of Artificial Sequence: Synthetic peptide
  XENP019437 vhCDR2
FISYDGNNKYYADSVKG

SEQ ID NO: 4503 - protein, 9 aa, Artificial Sequence
  Description of Artificial Sequence: Synthetic peptide
  XENP019437 vhCDR3
TGWLGPFDY

SEQ ID NO: 4504 - protein, 215 aa, Artificial Sequence
  Description of Artificial Sequence: Synthetic polypeptide
  XENP019437 [CTLA-4]_H0_L0.22_Fab Light Chain
EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4505 - protein, 108 aa, Artificial Sequence; identical to SEQ ID NO: 1607
  Description of Artificial Sequence: Synthetic polypeptide
  VL of XENP019437

SEQ ID NO: 4506 - protein, 12 aa, Artificial Sequence
  Description of Artificial Sequence: Synthetic peptide
  XENP019437 vlCDR1
RASQSVSSSYLA

SEQ ID NO: 4507 - protein, 7 aa, Artificial Sequence
  Description of Artificial Sequence: Synthetic peptide
  XENP019437 vlCDR2
GAFSRAT

SEQ ID NO: 4508 - protein, 9 aa, Artificial Sequence
  Description of Artificial Sequence: Synthetic peptide
  XENP019437 vlCDR3
QQYGSSPWT

SEQ ID NO: 4509 - protein, 221 aa, Artificial Sequence; identical to SEQ ID NO: 2919
  Description of Artificial Sequence: Synthetic polypeptide
  XENP019438 [CTLA-4]_H0_L0.23_Fab Heavy Chain

SEQ ID NO: 4510 - protein, 118 aa, Artificial Sequence; identical to SEQ ID NO: 22
  Description of Artificial Sequence: Synthetic polypeptide
  VH of XENP019438

SEQ ID NO: 4511 - protein, 5 aa, Artificial Sequence
  Description of Artificial Sequence: Synthetic peptide
  XENP019438 vhCDR1
SYTMH

SEQ ID NO: 4512 - protein, 17 aa, Artificial Sequence
  Description of Artificial Sequence: Synthetic peptide
  XENP019438 vhCDR2
FISYDGNNKYYADSVKG

SEQ ID NO: 4513 - protein, 9 aa, Artificial Sequence
  Description of Artificial Sequence: Synthetic peptide
  XENP019438 vhCDR3
TGWLGPFDY

SEQ ID NO: 4514 - protein, 215 aa, Artificial Sequence
  Description of Artificial Sequence: Synthetic polypeptide
  XENP019438 [CTLA-4]_H0_L0.23_Fab Light Chain
EIVLTQSPGTLSLSPGERATLSCRASQSVTSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4515 - protein, 108 aa, Artificial Sequence; identical to SEQ ID NO: 1616
  Description of Artificial Sequence: Synthetic polypeptide
  VL of XENP019438

SEQ ID NO: 4516 - protein, 12 aa, Artificial Sequence
  Description of Artificial Sequence: Synthetic peptide
  XENP019438 vlCDR1
RASQSVTSSYLA

SEQ ID NO: 4517 - protein, 7 aa, Artificial Sequence
  Description of Artificial Sequence: Synthetic peptide
  XENP019438 vlCDR2
GAFSRAT

SEQ ID NO: 4518 - protein, 9 aa, Artificial Sequence
  Description of Artificial Sequence: Synthetic peptide
  XENP019438 vlCDR3
QQYGSSPWT

SEQ ID NO: 4519 - protein, 221 aa, Artificial Sequence; identical to SEQ ID NO: 2919
  Description of Artificial Sequence: Synthetic polypeptide
  XENP019439 [CTLA-4]_H0_L0.24_Fab Heavy Chain

SEQ ID NO: 4520 - protein, 118 aa, Artificial Sequence; identical to SEQ ID NO: 22
  Description of Artificial Sequence: Synthetic polypeptide
  VH of XENP019439

SEQ ID NO: 4521 - protein, 5 aa, Artificial Sequence
  Description of Artificial Sequence: Synthetic peptide
  XENP019439 vhCDR1
SYTMH

SEQ ID NO: 4522 - protein, 17 aa, Artificial Sequence
  Description of Artificial Sequence: Synthetic peptide
  XENP019439 vhCDR2
FISYDGNNKYYADSVKG

SEQ ID NO: 4523 - protein, 9 aa, Artificial Sequence
  Description of Artificial Sequence: Synthetic peptide
  XENP019439 vhCDR3
TGWLGPFDY

SEQ ID NO: 4524 - protein, 215 aa, Artificial Sequence
  Description of Artificial Sequence: Synthetic polypeptide
  XENP019439 [CTLA-4]_H0_L0.24_Fab Light Chain
EIVLTQSPGTLSLSPGERATLSCRASQSVGASYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4525 - protein, 108 aa, Artificial Sequence; identical to SEQ ID NO: 1625
  Description of Artificial Sequence: Synthetic polypeptide
  VL of XENP019439

SEQ ID NO: 4526 - protein, 12 aa, Artificial Sequence
  Description of Artificial Sequence: Synthetic peptide
  XENP019439 vlCDR1
RASQSVGASYLA

SEQ ID NO: 4527 - protein, 7 aa, Artificial Sequence
  Description of Artificial Sequence: Synthetic peptide
  XENP019439 vlCDR2
GAFSRAT

SEQ ID NO: 4528 - protein, 9 aa, Artificial Sequence
  Description of Artificial Sequence: Synthetic peptide
  XENP019439 vlCDR3
QQYGSSPWT

SEQ ID NO: 4529 - protein, 221 aa, Artificial Sequence; identical to SEQ ID NO: 2919
  Description of Artificial Sequence: Synthetic polypeptide
  XENP019440 [CTLA-4]_H0_L0.25_Fab Heavy Chain

SEQ ID NO: 4530 - protein, 118 aa, Artificial Sequence; identical to SEQ ID NO: 22
  Description of Artificial Sequence: Synthetic polypeptide
  VH of XENP019440

SEQ ID NO: 4531 - protein, 5 aa, Artificial Sequence
  Description of Artificial Sequence: Synthetic peptide
  XENP019440 vhCDR1
SYTMH

SEQ ID NO: 4532 - protein, 17 aa, Artificial Sequence
  Description of Artificial Sequence: Synthetic peptide
  XENP019440 vhCDR2
FISYDGNNKYYADSVKG

SEQ ID NO: 4533 - protein, 9 aa, Artificial Sequence
  Description of Artificial Sequence: Synthetic peptide
  XENP019440 vhCDR3
TGWLGPFDY

SEQ ID NO: 4534 - protein, 215 aa, Artificial Sequence
  Description of Artificial Sequence: Synthetic polypeptide
  XENP019440 [CTLA-4]_H0_L0.25_Fab Light Chain
EIVLTQSPGTLSLSPGERATLSCRASQSVGGSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4535 - protein, 108 aa, Artificial Sequence; identical to SEQ ID NO: 1634
  Description of Artificial Sequence: Synthetic polypeptide
  VL of XENP019440

SEQ ID NO: 4536 - protein, 12 aa, Artificial Sequence
  Description of Artificial Sequence: Synthetic peptide
  XENP019440 vlCDR1
RASQSVGGSYLA

SEQ ID NO: 4537 - protein, 7 aa, Artificial Sequence
  Description of Artificial Sequence: Synthetic peptide
  XENP019440 vlCDR2
GAFSRAT

SEQ ID NO: 4538 - protein, 9 aa, Artificial Sequence
  Description of Artificial Sequence: Synthetic peptide
  XENP019440 vlCDR3
QQYGSSPWT

SEQ ID NO: 4539 - protein, 221 aa, Artificial Sequence; identical to SEQ ID NO: 2919
  Description of Artificial Sequence: Synthetic polypeptide
  XENP019441 [CTLA-4]_H0_L0.26_Fab Heavy Chain

SEQ ID NO: 4540 - protein, 118 aa, Artificial Sequence; identical to SEQ ID NO: 22
  Description of Artificial Sequence: Synthetic polypeptide
  VH of XENP019441

SEQ ID NO: 4541 - protein, 5 aa, Artificial Sequence
  Description of Artificial Sequence: Synthetic peptide
  XENP019441 vhCDR1
SYTMH

SEQ ID NO: 4542 - protein, 17 aa, Artificial Sequence
  Description of Artificial Sequence: Synthetic peptide
  XENP019441 vhCDR2
FISYDGNNKYYADSVKG

SEQ ID NO: 4543 - protein, 9 aa, Artificial Sequence
  Description of Artificial Sequence: Synthetic peptide
  XENP019441 vhCDR3
TGWLGPFDY

SEQ ID NO: 4544 - protein, 215 aa, Artificial Sequence
  Description of Artificial Sequence: Synthetic polypeptide
  XENP019441 [CTLA-4]_H0_L0.26_Fab Light Chain
EIVLTQSPGTLSLSPGERATLSCRASQSVGNSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4545 - protein, 108 aa, Artificial Sequence; identical to SEQ ID NO: 1643
  Description of Artificial Sequence: Synthetic polypeptide
  VL of XENP019441

SEQ ID NO: 4546 - protein, 12 aa, Artificial Sequence
  Description of Artificial Sequence: Synthetic peptide
  XENP019441 vlCDR1
RASQSVGNSYLA

SEQ ID NO: 4547 - protein, 7 aa, Artificial Sequence
  Description of Artificial Sequence: Synthetic peptide
  XENP019441 vlCDR2
GAFSRAT

SEQ ID NO: 4548 - protein, 9 aa, Artificial Sequence
  Description of Artificial Sequence: Synthetic peptide
  XENP019441 vlCDR3
QQYGSSPWT

SEQ ID NO: 4549 - protein, 221 aa, Artificial Sequence; identical to SEQ ID NO: 2919
  Description of Artificial Sequence: Synthetic polypeptide
  XENP019442 [CTLA-4]_H0_L0.27_Fab Heavy Chain

SEQ ID NO: 4550 - protein, 118 aa, Artificial Sequence; identical to SEQ ID NO: 22
  Description of Artificial Sequence: Synthetic polypeptide
  VH of XENP019442

SEQ ID NO: 4551 - protein, 5 aa, Artificial Sequence
  Description of Artificial Sequence: Synthetic peptide
  XENP019442 vhCDR1
SYTMH

SEQ ID NO: 4552 - protein, 17 aa, Artificial Sequence
  Description of Artificial Sequence: Synthetic peptide
  XENP019442 vhCDR2
FISYDGNNKYYADSVKG

SEQ ID NO: 4553 - protein, 9 aa, Artificial Sequence
  Description of Artificial Sequence: Synthetic peptide
  XENP019442 vhCDR3
TGWLGPFDY

SEQ ID NO: 4554 - protein, 215 aa, Artificial Sequence
  Description of Artificial Sequence: Synthetic polypeptide
  XENP019442 [CTLA-4]_H0_L0.27_Fab Light Chain
EIVLTQSPGTLSLSPGERATLSCRASQSVGQSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4555 - protein, 108 aa, Artificial Sequence; identical to SEQ ID NO: 1652
  Description of Artificial Sequence: Synthetic polypeptide
  VL of XENP019442

SEQ ID NO: 4556 - protein, 12 aa, Artificial Sequence
  Description of Artificial Sequence: Synthetic peptide
  XENP019442 vlCDR1
RASQSVGQSYLA

SEQ ID NO: 4557 - protein, 7 aa, Artificial Sequence
  Description of Artificial Sequence: Synthetic peptide
  XENP019442 vlCDR2
GAFSRAT

SEQ ID NO: 4558 - protein, 9 aa, Artificial Sequence
  Description of Artificial Sequence: Synthetic peptide
  XENP019442 vlCDR3
QQYGSSPWT

SEQ ID NO: 4559 - protein, 221 aa, Artificial Sequence; identical to SEQ ID NO: 2919
  Description of Artificial Sequence: Synthetic polypeptide
  XENP019443 [CTLA-4]_H0_L0.28_Fab Heavy Chain

SEQ ID NO: 4560 - protein, 118 aa, Artificial Sequence; identical to SEQ ID NO: 22
  Description of Artificial Sequence: Synthetic polypeptide
  VH of XENP019443

SEQ ID NO: 4561 - protein, 5 aa, Artificial Sequence
  Description of Artificial Sequence: Synthetic peptide
  XENP019443 vhCDR1
SYTMH

SEQ ID NO: 4562 - protein, 17 aa, Artificial Sequence
  Description of Artificial Sequence: Synthetic peptide
  XENP019443 vhCDR2
FISYDGNNKYYADSVKG

SEQ ID NO: 4563 - protein, 9 aa, Artificial Sequence
  Description of Artificial Sequence: Synthetic peptide
  XENP019443 vhCDR3
TGWLGPFDY

SEQ ID NO: 4564 - protein, 215 aa, Artificial Sequence
  Description of Artificial Sequence: Synthetic polypeptide
  XENP019443 [CTLA-4]_H0_L0.28_Fab Light Chain
EIVLTQSPGTLSLSPGERATLSCRASQSVGTSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4565 - protein, 108 aa, Artificial Sequence; identical to SEQ ID NO: 1661
  Description of Artificial Sequence: Synthetic polypeptide
  VL of XENP019443

SEQ ID NO: 4566 - protein, 12 aa, Artificial Sequence
  Description of Artificial Sequence: Synthetic peptide
  XENP019443 vlCDR1
RASQSVGTSYLA

SEQ ID NO: 4567 - protein, 7 aa, Artificial Sequence
  Description of Artificial Sequence: Synthetic peptide
  XENP019443 vlCDR2
GAFSRAT

SEQ ID NO: 4568 - protein, 9 aa, Artificial Sequence
  Description of Artificial Sequence: Synthetic peptide
  XENP019443 vlCDR3
QQYGSSPWT

SEQ ID NO: 4569 - protein, 221 aa, Artificial Sequence; identical to SEQ ID NO: 2919
  Description of Artificial Sequence: Synthetic polypeptide
  XENP019444 [CTLA-4]_H0_L0.29_Fab Heavy Chain

SEQ ID NO: 4570 - protein, 118 aa, Artificial Sequence; identical to SEQ ID NO: 22
  Description of Artificial Sequence: Synthetic polypeptide
  VH of XENP019444

SEQ ID NO: 4571 - protein, 5 aa, Artificial Sequence
  Description of Artificial Sequence: Synthetic peptide
  XENP019444 vhCDR1
SYTMH

SEQ ID NO: 4572 - protein, 17 aa, Artificial Sequence
  Description of Artificial Sequence: Synthetic peptide
  XENP019444 vhCDR2
FISYDGNNKYYADSVKG

SEQ ID NO: 4573 - protein, 9 aa, Artificial Sequence
  Description of Artificial Sequence: Synthetic peptide
  XENP019444 vhCDR3
TGWLGPFDY

SEQ ID NO: 4574 - protein, 215 aa, Artificial Sequence
  Description of Artificial Sequence: Synthetic polypeptide
  XENP019444 [CTLA-4]_H0_L0.29_Fab Light Chain
EIVLTQSPGTLSLSPGERATLSCRASQSVGSAYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4575 - protein, 108 aa, Artificial Sequence; identical to SEQ ID NO: 1670
  Description of Artificial Sequence: Synthetic polypeptide
  VL of XENP019444

SEQ ID NO: 4576 - protein, 12 aa, Artificial Sequence
  Description of Artificial Sequence: Synthetic peptide
  XENP019444 vlCDR1
RASQSVGSAYLA

SEQ ID NO: 4577 - protein, 7 aa, Artificial Sequence
  Description of Artificial Sequence: Synthetic peptide
  XENP019444 vlCDR2
GAFSRAT

SEQ ID NO: 4578 - protein, 9 aa, Artificial Sequence
  Description of Artificial Sequence: Synthetic peptide
  XENP019444 vlCDR3
QQYGSSPWT

SEQ ID NO: 4579 - protein, 221 aa, Artificial Sequence; identical to SEQ ID NO: 2919
  Description of Artificial Sequence: Synthetic polypeptide
  XENP019445 [CTLA-4]_H0_L0.30_Fab Heavy Chain

SEQ ID NO: 4580 - protein, 118 aa, Artificial Sequence; identical to SEQ ID NO: 22
  Description of Artificial Sequence: Synthetic polypeptide
  VH of XENP019445

SEQ ID NO: 4581 - protein, 5 aa, Artificial Sequence
  Description of Artificial Sequence: Synthetic peptide
  XENP019445 vhCDR1
SYTMH

SEQ ID NO: 4582 - protein, 17 aa, Artificial Sequence
  Description of Artificial Sequence: Synthetic peptide
  XENP019445 vhCDR2
FISYDGNNKYYADSVKG

SEQ ID NO: 4583 - protein, 9 aa, Artificial Sequence
  Description of Artificial Sequence: Synthetic peptide
  XENP019445 vhCDR3
TGWLGPFDY

SEQ ID NO: 4584 - protein, 215 aa, Artificial Sequence
  Description of Artificial Sequence: Synthetic polypeptide
  XENP019445 [CTLA-4]_H0_L0.30_Fab Light Chain
EIVLTQSPGTLSLSPGERATLSCRASQSVGSGYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4585 - protein, 108 aa, Artificial Sequence; identical to SEQ ID NO: 1679
  Description of Artificial Sequence: Synthetic polypeptide
  VL of XENP019445

SEQ ID NO: 4586 - protein, 12 aa, Artificial Sequence
  Description of Artificial Sequence: Synthetic peptide
  XENP019445 vlCDR1
RASQSVGSGYLA

SEQ ID NO: 4587 - protein, 7 aa, Artificial Sequence
  Description of Artificial Sequence: Synthetic peptide
  XENP019445 vlCDR2
GAFSRAT

SEQ ID NO: 4588 - protein, 9 aa, Artificial Sequence
  Description of Artificial Sequence: Synthetic peptide
  XENP019445 vlCDR3
QQYGSSPWT

SEQ ID NO: 4589 - protein, 221 aa, Artificial Sequence; identical to SEQ ID NO: 2919
  Description of Artificial Sequence: Synthetic polypeptide
  XENP019446 [CTLA-4]_H0_L0.31_Fab Heavy Chain

SEQ ID NO: 4590 - protein, 118 aa, Artificial Sequence; identical to SEQ ID NO: 22
  Description of Artificial Sequence: Synthetic polypeptide
  VH of XENP019446

SEQ ID NO: 4591 - protein, 5 aa, Artificial Sequence
  Description of Artificial Sequence: Synthetic peptide
  XENP019446 vhCDR1
SYTMH

SEQ ID NO: 4592 - protein, 17 aa, Artificial Sequence
  Description of Artificial Sequence: Synthetic peptide
  XENP019446 vhCDR2
FISYDGNNKYYADSVKG

SEQ ID NO: 4593 - protein, 9 aa, Artificial Sequence
  Description of Artificial Sequence: Synthetic peptide
  XENP019446 vhCDR3
TGWLGPFDY

SEQ ID NO: 4594 - protein, 215 aa, Artificial Sequence
  Description of Artificial Sequence: Synthetic polypeptide
  XENP019446 [CTLA-4]_H0_L0.31_Fab Light Chain
EIVLTQSPGTLSLSPGERATLSCRASQSVGSNYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4595 - protein, 108 aa, Artificial Sequence; identical to SEQ ID NO: 1688
  Description of Artificial Sequence: Synthetic polypeptide
  VL of XENP019446

SEQ ID NO: 4596 - protein, 12 aa, Artificial Sequence
  Description of Artificial Sequence: Synthetic peptide
  XENP019446 vlCDR1
RASQSVGSNYLA

SEQ ID NO: 4597 - protein, 7 aa, Artificial Sequence
  Description of Artificial Sequence: Synthetic peptide
  XENP019446 vlCDR2
GAFSRAT

SEQ ID NO: 4598 - protein, 9 aa, Artificial Sequence
  Description of Artificial Sequence: Synthetic peptide
  XENP019446 vlCDR3
QQYGSSPWT

SEQ ID NO: 4599 - protein, 221 aa, Artificial Sequence; identical to SEQ ID NO: 2919
  Description of Artificial Sequence: Synthetic polypeptide
  XENP019447 [CTLA-4]_H0_L0.32_Fab Heavy Chain

SEQ ID NO: 4600 - protein, 118 aa, Artificial Sequence; identical to SEQ ID NO: 22
  Description of Artificial Sequence: Synthetic polypeptide
  VH of XENP019447

SEQ ID NO: 4601 - protein, 5 aa, Artificial Sequence
  Description of Artificial Sequence: Synthetic peptide
  XENP019447 vhCDR1
SYTMH

SEQ ID NO: 4602 - protein, 17 aa, Artificial Sequence
  Description of Artificial Sequence: Synthetic peptide
  XENP019447 vhCDR2
FISYDGNNKYYADSVKG

SEQ ID NO: 4603 - protein, 9 aa, Artificial Sequence
  Description of Artificial Sequence: Synthetic peptide
  XENP019447 vhCDR3
TGWLGPFDY

SEQ ID NO: 4604 - protein, 215 aa, Artificial Sequence
  Description of Artificial Sequence: Synthetic polypeptide
  XENP019447 [CTLA-4]_H0_L0.32_Fab Light Chain
EIVLTQSPGTLSLSPGERATLSCRASQSVGSQYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4605 - protein, 108 aa, Artificial Sequence; identical to SEQ ID NO: 1697
  Description of Artificial Sequence: Synthetic polypeptide
  VL of XENP019447

SEQ ID NO: 4606 - protein, 12 aa, Artificial Sequence
  Description of Artificial Sequence: Synthetic peptide
  XENP019447 vlCDR1
RASQSVGSQYLA

SEQ ID NO: 4607 - protein, 7 aa, Artificial Sequence
  Description of Artificial Sequence: Synthetic peptide
  XENP019447 vlCDR2
GAFSRAT

SEQ ID NO: 4608 - protein, 9 aa, Artificial Sequence
  Description of Artificial Sequence: Synthetic peptide
  XENP019447 vlCDR3
QQYGSSPWT

SEQ ID NO: 4609 - protein, 221 aa, Artificial Sequence; identical to SEQ ID NO: 2919
  Description of Artificial Sequence: Synthetic polypeptide
  XENP019448 [CTLA-4]_H0_L0.33_Fab Heavy Chain

SEQ ID NO: 4610 - protein, 118 aa, Artificial Sequence; identical to SEQ ID NO: 22
  Description of Artificial Sequence: Synthetic polypeptide
  VH of XENP019448

SEQ ID NO: 4611 - protein, 5 aa, Artificial Sequence
  Description of Artificial Sequence: Synthetic peptide
  XENP019448 vhCDR1
SYTMH

SEQ ID NO: 4612 - protein, 17 aa, Artificial Sequence
  Description of Artificial Sequence: Synthetic peptide
  XENP019448 vhCDR2
FISYDGNNKYYADSVKG

SEQ ID NO: 4613 - protein, 9 aa, Artificial Sequence
  Description of Artificial Sequence: Synthetic peptide
  XENP019448 vhCDR3
TGWLGPFDY

SEQ ID NO: 4614 - protein, 215 aa, Artificial Sequence
  Description of Artificial Sequence: Synthetic polypeptide
  XENP019448 [CTLA-4]_H0_L0.33_Fab Light Chain
EIVLTQSPGTLSLSPGERATLSCRASQSVGSTYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4615 - protein, 108 aa, Artificial Sequence; identical to SEQ ID NO: 1706
  Description of Artificial Sequence: Synthetic polypeptide
  VL of XENP019448

SEQ ID NO: 4616 - protein, 12 aa, Artificial Sequence
  Description of Artificial Sequence: Synthetic peptide
  XENP019448 vlCDR1
RASQSVGSTYLA

SEQ ID NO: 4617 - protein, 7 aa, Artificial Sequence
  Description of Artificial Sequence: Synthetic peptide
  XENP019448 vlCDR2
GAFSRAT

SEQ ID NO: 4618 - protein, 9 aa, Artificial Sequence
  Description of Artificial Sequence: Synthetic peptide
  XENP019448 vlCDR3
QQYGSSPWT

SEQ ID NO: 4619 - protein, 221 aa, Artificial Sequence; identical to SEQ ID NO: 2919
  Description of Artificial Sequence: Synthetic polypeptide
  XENP019449 [CTLA-4]_H0_L0.34_Fab Heavy Chain

SEQ ID NO: 4620 - protein, 118 aa, Artificial Sequence; identical to SEQ ID NO: 22
  Description of Artificial Sequence: Synthetic polypeptide
  VH of XENP019449

SEQ ID NO: 4621 - protein, 5 aa, Artificial Sequence
  Description of Artificial Sequence: Synthetic peptide
  XENP019449 vhCDR1
SYTMH

SEQ ID NO: 4622 - protein, 17 aa, Artificial Sequence
  Description of Artificial Sequence: Synthetic peptide
  XENP019449 vhCDR2
FISYDGNNKYYADSVKG

SEQ ID NO: 4623 - protein, 9 aa, Artificial Sequence
  Description of Artificial Sequence: Synthetic peptide
  XENP019449 vhCDR3
TGWLGPFDY

SEQ ID NO: 4624 - protein, 215 aa, Artificial Sequence
  Description of Artificial Sequence: Synthetic polypeptide
  XENP019449 [CTLA-4]_H0_L0.34_Fab Light Chain
EIVLTQSPGTLSLSPGERATLSCRASQSVGSSALAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4625 - protein, 108 aa, Artificial Sequence; identical to SEQ ID NO: 1715
  Description of Artificial Sequence: Synthetic polypeptide
  VL of XENP019449

SEQ ID NO: 4626 - protein, 12 aa, Artificial Sequence
  Description of Artificial Sequence: Synthetic peptide
  XENP019449 vlCDR1
RASQSVGSSALA

SEQ ID NO: 4627 - protein, 7 aa, Artificial Sequence
  Description of Artificial Sequence: Synthetic peptide
  XENP019449 vlCDR2
GAFSRAT

SEQ ID NO: 4628 - protein, 9 aa, Artificial Sequence
  Description of Artificial Sequence: Synthetic peptide
  XENP019449 vlCDR3
QQYGSSPWT

SEQ ID NO: 4629 - protein, 221 aa, Artificial Sequence; identical to SEQ ID NO: 2919
  Description of Artificial Sequence: Synthetic polypeptide
  XENP019450 [CTLA-4]_H0_L0.35_Fab Heavy Chain

SEQ ID NO: 4630 - protein, 118 aa, Artificial Sequence; identical to SEQ ID NO: 22
  Description of Artificial Sequence: Synthetic polypeptide
  VH of XENP019450

SEQ ID NO: 4631 - protein, 5 aa, Artificial Sequence
  Description of Artificial Sequence: Synthetic peptide
  XENP019450 vhCDR1
SYTMH

SEQ ID NO: 4632 - protein, 17 aa, Artificial Sequence
  Description of Artificial Sequence: Synthetic peptide
  XENP019450 vhCDR2
FISYDGNNKYYADSVKG

SEQ ID NO: 4633 - protein, 9 aa, Artificial Sequence
  Description of Artificial Sequence: Synthetic peptide
  XENP019450 vhCDR3
TGWLGPFDY

SEQ ID NO: 4634 - protein, 215 aa, Artificial Sequence
  Description of Artificial Sequence: Synthetic polypeptide
  XENP019450 [CTLA-4]_H0_L0.35_Fab Light Chain
EIVLTQSPGTLSLSPGERATLSCRASQSVGSSFLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4635 - protein, 108 aa, Artificial Sequence; identical to SEQ ID NO: 1724
  Description of Artificial Sequence: Synthetic polypeptide
  VL of XENP019450

SEQ ID NO: 4636 - protein, 12 aa, Artificial Sequence
  Description of Artificial Sequence: Synthetic peptide
  XENP019450 vlCDR1
RASQSVGSSFLA

SEQ ID NO: 4637 - protein, 7 aa, Artificial Sequence
  Description of Artificial Sequence: Synthetic peptide
  XENP019450 vlCDR2
GAFSRAT

SEQ ID NO: 4638 - protein, 9 aa, Artificial Sequence
  Description of Artificial Sequence: Synthetic peptide
  XENP019450 vlCDR3
QQYGSSPWT

SEQ ID NO: 4639 - protein, 221 aa, Artificial Sequence; identical to SEQ ID NO: 2919
  Description of Artificial Sequence: Synthetic polypeptide
  XENP019451 [CTLA-4]_H0_L0.36_Fab Heavy Chain

SEQ ID NO: 4640 - protein, 118 aa, Artificial Sequence; identical to SEQ ID NO: 22
  Description of Artificial Sequence: Synthetic polypeptide
  VH of XENP019451

SEQ ID NO: 4641 - protein, 5 aa, Artificial Sequence
  Description of Artificial Sequence: Synthetic peptide
  XENP019451 vhCDR1
SYTMH

SEQ ID NO: 4642 - protein, 17 aa, Artificial Sequence
  Description of Artificial Sequence: Synthetic peptide
  XENP019451 vhCDR2
FISYDGNNKYYADSVKG

SEQ ID NO: 4643 - protein, 9 aa, Artificial Sequence
  Description of Artificial Sequence: Synthetic peptide
  XENP019451 vhCDR3
TGWLGPFDY

SEQ ID NO: 4644 - protein, 215 aa, Artificial Sequence
  Description of Artificial Sequence: Synthetic polypeptide
  XENP019451 [CTLA-4]_H0_L0.36_Fab Light Chain
EIVLTQSPGTLSLSPGERATLSCRASQSVGSSHLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4645 - protein, 108 aa, Artificial Sequence; identical to SEQ ID NO: 1733
  Description of Artificial Sequence: Synthetic polypeptide
  VL of XENP019451

SEQ ID NO: 4646 - protein, 12 aa, Artificial Sequence
  Description of Artificial Sequence: Synthetic peptide
  XENP019451 vlCDR1
RASQSVGSSHLA

SEQ ID NO: 4647 - protein, 7 aa, Artificial Sequence
  Description of Artificial Sequence: Synthetic peptide
  XENP019451 vlCDR2
GAFSRAT

SEQ ID NO: 4648 - protein, 9 aa, Artificial Sequence
  Description of Artificial Sequence: Synthetic peptide
  XENP019451 vlCDR3
QQYGSSPWT

SEQ ID NO: 4649 - protein, 221 aa, Artificial Sequence; identical to SEQ ID NO: 2919
  Description of Artificial Sequence: Synthetic polypeptide
  XENP019452 [CTLA-4]_H0_L0.37_Fab Heavy Chain

SEQ ID NO: 4650 - protein, 118 aa, Artificial Sequence; identical to SEQ ID NO: 22
  Description of Artificial Sequence: Synthetic polypeptide
  VH of XENP019452

SEQ ID NO: 4651 - protein, 5 aa, Artificial Sequence
  Description of Artificial Sequence: Synthetic peptide
  XENP019452 vhCDR1
SYTMH

SEQ ID NO: 4652 - protein, 17 aa, Artificial Sequence
  Description of Artificial Sequence: Synthetic peptide
  XENP019452 vhCDR2
FISYDGNNKYYADSVKG

SEQ ID NO: 4653 - protein, 9 aa, Artificial Sequence
  Description of Artificial Sequence: Synthetic peptide
  XENP019452 vhCDR3
TGWLGPFDY

SEQ ID NO: 4654 - protein, 215 aa, Artificial Sequence
  Description of Artificial Sequence: Synthetic polypeptide
  XENP019452 [CTLA-4]_H0_L0.37_Fab Light Chain
EIVLTQSPGTLSLSPGERATLSCRASQSVGSSLLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4655 - protein, 108 aa, Artificial Sequence; identical to SEQ ID NO: 1742
  Description of Artificial Sequence: Synthetic polypeptide
  VL of XENP019452

SEQ ID NO: 4656 - protein, 12 aa, Artificial Sequence
  Description of Artificial Sequence: Synthetic peptide
  XENP019452 vlCDR1
RASQSVGSSLLA

SEQ ID NO: 4657 - protein, 7 aa, Artificial Sequence
  Description of Artificial Sequence: Synthetic peptide
  XENP019452 vlCDR2
GAFSRAT

SEQ ID NO: 4658 - protein, 9 aa, Artificial Sequence
  Description of Artificial Sequence: Synthetic peptide
  XENP019452 vlCDR3
QQYGSSPWT

SEQ ID NO: 4659 - protein, 221 aa, Artificial Sequence; identical to SEQ ID NO: 2919
  Description of Artificial Sequence: Synthetic polypeptide
  XENP019453 [CTLA-4]_H0_L0.38_Fab Heavy Chain

SEQ ID NO: 4660 - protein, 118 aa, Artificial Sequence; identical to SEQ ID NO: 22
  Description of Artificial Sequence: Synthetic polypeptide
  VH of XENP019453

SEQ ID NO: 4661 - protein, 5 aa, Artificial Sequence
  Description of Artificial Sequence: Synthetic peptide
  XENP019453 vhCDR1
SYTMH

SEQ ID NO: 4662 - protein, 17 aa, Artificial Sequence
  Description of Artificial Sequence: Synthetic peptide
  XENP019453 vhCDR2
FISYDGNNKYYADSVKG

SEQ ID NO: 4663 - protein, 9 aa, Artificial Sequence
  Description of Artificial Sequence: Synthetic peptide
  XENP019453 vhCDR3
TGWLGPFDY

SEQ ID NO: 4664 - protein, 215 aa, Artificial Sequence
  Description of Artificial Sequence: Synthetic polypeptide
  XENP019453 [CTLA-4]_H0_L0.38_Fab Light Chain
EIVLTQSPGTLSLSPGERATLSCRASQSVGSSNLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4665 - protein, 108 aa, Artificial Sequence; identical to SEQ ID NO: 1751
  Description of Artificial Sequence: Synthetic polypeptide
  VL of XENP019453

SEQ ID NO: 4666 - protein, 12 aa, Artificial Sequence
  Description of Artificial Sequence: Synthetic peptide
  XENP019453 vlCDR1
RASQSVGSSNLA

SEQ ID NO: 4667 - protein, 7 aa, Artificial Sequence
  Description of Artificial Sequence: Synthetic peptide
  XENP019453 vlCDR2
GAFSRAT

SEQ ID NO: 4668 - protein, 9 aa, Artificial Sequence
  Description of Artificial Sequence: Synthetic peptide
  XENP019453 vlCDR3
QQYGSSPWT

SEQ ID NO: 4669 - protein, 221 aa, Artificial Sequence; identical to SEQ ID NO: 2919
  Description of Artificial Sequence: Synthetic polypeptide
  XENP019454 [CTLA-4]_H0_L0.39_Fab Heavy Chain

SEQ ID NO: 4670 - protein, 118 aa, Artificial Sequence; identical to SEQ ID NO: 22
  Description of Artificial Sequence: Synthetic polypeptide
  VH of XENP019454

SEQ ID NO: 4671 - protein, 5 aa, Artificial Sequence
  Description of Artificial Sequence: Synthetic peptide
  XENP019454 vhCDR1
SYTMH

SEQ ID NO: 4672 - protein, 17 aa, Artificial Sequence
  Description of Artificial Sequence: Synthetic peptide
  XENP019454 vhCDR2
FISYDGNNKYYADSVKG

SEQ ID NO: 4673 - protein, 9 aa, Artificial Sequence
  Description of Artificial Sequence: Synthetic peptide
  XENP019454 vhCDR3
TGWLGPFDY

SEQ ID NO: 4674 - protein, 215 aa, Artificial Sequence
  Description of Artificial Sequence: Synthetic polypeptide
  XENP019454 [CTLA-4]_H0_L0.39_Fab Light Chain
EIVLTQSPGTLSLSPGERATLSCRASQSVGSSSLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4675 - protein, 108 aa, Artificial Sequence; identical to SEQ ID NO: 1760
  Description of Artificial Sequence: Synthetic polypeptide
  VL of XENP019454

SEQ ID NO: 4676 - protein, 12 aa, Artificial Sequence
  Description of Artificial Sequence: Synthetic peptide
  XENP019454 vlCDR1
RASQSVGSSSLA

SEQ ID NO: 4677 - protein, 7 aa, Artificial Sequence
  Description of Artificial Sequence: Synthetic peptide
  XENP019454 vlCDR2
GAFSRAT

SEQ ID NO: 4678 - protein, 9 aa, Artificial Sequence
  Description of Artificial Sequence: Synthetic peptide
  XENP019454 vlCDR3
QQYGSSPWT

SEQ ID NO: 4679 - protein, 221 aa, Artificial Sequence; identical to SEQ ID NO: 2919
  Description of Artificial Sequence: Synthetic polypeptide
  XENP019455 [CTLA-4]_H0_L0.40_Fab Heavy Chain

SEQ ID NO: 4680 - protein, 118 aa, Artificial Sequence; identical to SEQ ID NO: 22
  Description of Artificial Sequence: Synthetic polypeptide
  VH of XENP019455

SEQ ID NO: 4681 - protein, 5 aa, Artificial Sequence
  Description of Artificial Sequence: Synthetic peptide
  XENP019455 vhCDR1
SYTMH

SEQ ID NO: 4682 - protein, 17 aa, Artificial Sequence
  Description of Artificial Sequence: Synthetic peptide
  XENP019455 vhCDR2
FISYDGNNKYYADSVKG

SEQ ID NO: 4683 - protein, 9 aa, Artificial Sequence
  Description of Artificial Sequence: Synthetic peptide
  XENP019455 vhCDR3
TGWLGPFDY

SEQ ID NO: 4684 - protein, 215 aa, Artificial Sequence
  Description of Artificial Sequence: Synthetic polypeptide
  XENP019455 [CTLA-4]_H0_L0.40_Fab Light Chain
EIVLTQSPGTLSLSPGERATLSCRASQSVGSSVLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4685 - protein, 108 aa, Artificial Sequence; identical to SEQ ID NO: 1769
  Description of Artificial Sequence: Synthetic polypeptide
  VL of XENP019455

SEQ ID NO: 4686 - protein, 12 aa, Artificial Sequence
  Description of Artificial Sequence: Synthetic peptide
  XENP019455 vlCDR1
RASQSVGSSVLA

SEQ ID NO: 4687 - protein, 7 aa, Artificial Sequence
  Description of Artificial Sequence: Synthetic peptide
  XENP019455 vlCDR2
GAFSRAT

SEQ ID NO: 4688 - protein, 9 aa, Artificial Sequence
  Description of Artificial Sequence: Synthetic peptide
  XENP019455 vlCDR3
QQYGSSPWT

SEQ ID NO: 4689 - protein, 221 aa, Artificial Sequence; identical to SEQ ID NO: 2919
  Description of Artificial Sequence: Synthetic polypeptide
  XENP019456 [CTLA-4]_H0_L0.41_Fab Heavy Chain

SEQ ID NO: 4690 - protein, 118 aa, Artificial Sequence; identical to SEQ ID NO: 22
  Description of Artificial Sequence: Synthetic polypeptide
  VH of XENP019456

SEQ ID NO: 4691 - protein, 5 aa, Artificial Sequence
  Description of Artificial Sequence: Synthetic peptide
  XENP019456 vhCDR1
SYTMH

SEQ ID NO: 4692 - protein, 17 aa, Artificial Sequence
  Description of Artificial Sequence: Synthetic peptide
  XENP019456 vhCDR2
FISYDGNNKYYADSVKG

SEQ ID NO: 4693 - protein, 9 aa, Artificial Sequence
  Description of Artificial Sequence: Synthetic peptide
  XENP019456 vhCDR3
TGWLGPFDY

SEQ ID NO: 4694 - protein, 215 aa, Artificial Sequence
  Description of Artificial Sequence: Synthetic polypeptide
  XENP019456 [CTLA-4]_H0_L0.41_Fab Light Chain
EIVLTQSPGTLSLSPGERATLSCRASQSVGSSYMAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4695 - protein, 108 aa, Artificial Sequence; identical to SEQ ID NO: 1778
  Description of Artificial Sequence: Synthetic polypeptide
  VL of XENP019456

SEQ ID NO: 4696 - protein, 12 aa, Artificial Sequence
  Description of Artificial Sequence: Synthetic peptide
  XENP019456 vlCDR1
RASQSVGSSYMA

SEQ ID NO: 4697 - protein, 7 aa, Artificial Sequence
  Description of Artificial Sequence: Synthetic peptide
  XENP019456 vlCDR2
GAFSRAT

SEQ ID NO: 4698 - protein, 9 aa, Artificial Sequence
  Description of Artificial Sequence: Synthetic peptide
  XENP019456 vlCDR3
QQYGSSPWT

SEQ ID NO: 4699 - protein, 221 aa, Artificial Sequence; identical to SEQ ID NO: 2919
  Description of Artificial Sequence: Synthetic polypeptide
  XENP019457 [CTLA-4]_H0_L0.42_Fab Heavy Chain

SEQ ID NO: 4700 - protein, 118 aa, Artificial Sequence; identical to SEQ ID NO: 22
  Description of Artificial Sequence: Synthetic polypeptide
  VH of XENP019457

SEQ ID NO: 4701 - protein, 5 aa, Artificial Sequence
  Description of Artificial Sequence: Synthetic peptide
  XENP019457 vhCDR1
SYTMH

SEQ ID NO: 4702 - protein, 17 aa, Artificial Sequence
  Description of Artificial Sequence: Synthetic peptide
  XENP019457 vhCDR2
FISYDGNNKYYADSVKG

SEQ ID NO: 4703 - protein, 9 aa, Artificial Sequence
  Description of Artificial Sequence: Synthetic peptide
  XENP019457 vhCDR3
TGWLGPFDY

SEQ ID NO: 4704 - protein, 215 aa, Artificial Sequence
  Description of Artificial Sequence: Synthetic polypeptide
  XENP019457 [CTLA-4]_H0_L0.42_Fab Light Chain
EIVLTQSPGTLSLSPGERATLSCRASQSVGSSYLDWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4705 - protein, 108 aa, Artificial Sequence; identical to SEQ ID NO: 1787
  Description of Artificial Sequence: Synthetic polypeptide
  VL of XENP019457

SEQ ID NO: 4706 - protein, 12 aa, Artificial Sequence
  Description of Artificial Sequence: Synthetic peptide
  XENP019457 vlCDR1
RASQSVGSSYLD

SEQ ID NO: 4707 - protein, 7 aa, Artificial Sequence
  Description of Artificial Sequence: Synthetic peptide
  XENP019457 vlCDR2
GAFSRAT

SEQ ID NO: 4708 - protein, 9 aa, Artificial Sequence
  Description of Artificial Sequence: Synthetic peptide
  XENP019457 vlCDR3
QQYGSSPWT

SEQ ID NO: 4709 - protein, 221 aa, Artificial Sequence; identical to SEQ ID NO: 2919
  Description of Artificial Sequence: Synthetic polypeptide
  XENP019458 [CTLA-4]_H0_L0.43_Fab Heavy Chain

SEQ ID NO: 4710 - protein, 118 aa, Artificial Sequence; identical to SEQ ID NO: 22
  Description of Artificial Sequence: Synthetic polypeptide
  VH of XENP019458

SEQ ID NO: 4711 - protein, 5 aa, Artificial Sequence
  Description of Artificial Sequence: Synthetic peptide
  XENP019458 vhCDR1
SYTMH

SEQ ID NO: 4712 - protein, 17 aa, Artificial Sequence
  Description of Artificial Sequence: Synthetic peptide
  XENP019458 vhCDR2
FISYDGNNKYYADSVKG

SEQ ID NO: 4713 - protein, 9 aa, Artificial Sequence
  Description of Artificial Sequence: Synthetic peptide
  XENP019458 vhCDR3
TGWLGPFDY

SEQ ID NO: 4714 - protein, 215 aa, Artificial Sequence
  Description of Artificial Sequence: Synthetic polypeptide
  XENP019458 [CTLA-4]_H0_L0.43_Fab Light Chain
EIVLTQSPGTLSLSPGERATLSCRASQSVGSSYLDWYQQKPGQAPRLLIYGAFSRATGIPDRFSGSGSGTDFTLTISRLEPEDFAVYYCKQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4715 - protein, 108 aa, Artificial Sequence; identical to SEQ ID NO: 1796
  Description of Artificial Sequence: Synthetic polypeptide
  VL of XENP019458

SEQ ID NO: 4716 - protein, 12 aa, Artificial Sequence
  Description of Artificial Sequence: Synthetic peptide
  XENP019458 vlCDR1
RASQSVGSSYLD

SEQ ID NO: 4717 - protein, 7 aa, Artificial Sequence
  Description of Artificial Sequence: Synthetic peptide
  XENP019458 vlCDR2
GAFSRAT

SEQ ID NO: 4718 - protein, 9 aa, Artificial Sequence
  Description of Artificial Sequence: Synthetic peptide
  XENP019458 vlCDR3
KQYGSSPWT

SEQ ID NO: 4719 - protein, 221 aa, Artificial Sequence; identical to SEQ ID NO: 2919
  Description of Artificial Sequence: Synthetic polypeptide
  XENP019459 [CTLA-4]_H0_L0.44_Fab Heavy Chain

SEQ ID NO: 4720 - protein, 118 aa, Artificial Sequence; identical to SEQ ID NO: 22
  Description of Artificial Sequence: Synthetic polypeptide
  VH of XENP019459

SEQ ID NO: 4721 - protein, 5 aa, Artificial Sequence
  Description of Artificial Sequence: Synthetic peptide
  XENP019459 vhCDR1
SYTMH

SEQ ID NO: 4722 - protein, 17 aa, Artificial Sequence
  Description of Artificial Sequence: Synthetic peptide
  XENP019459 vhCDR2
FISYDGNNKYYADSVKG

SEQ ID NO: 4723 - protein, 9 aa, Artificial Sequence
  Description of Artificial Sequence: Synthetic peptide
  XENP019459 vhCDR3
TGWLGPFDY

SEQ ID NO: 4724 - protein, 215 aa, Artificial Sequence
  Description of Artificial Sequence: Synthetic polypeptide
  XENP019459 [CTLA-4]_H0_L0.44_Fab Light Chain
EIVLTQSPGTLSLSPGERATLSCRASQSVGSSYLSWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4725 - protein, 108 aa, Artificial Sequence; identical to SEQ ID NO: 1805
  Description of Artificial Sequence: Synthetic polypeptide
  VL of XENP019459

SEQ ID NO: 4726 - protein, 12 aa, Artificial Sequence
  Description of Artificial Sequence: Synthetic peptide
  XENP019459 vlCDR1
RASQSVGSSYLS

SEQ ID NO: 4727 - protein, 7 aa, Artificial Sequence
  Description of Artificial Sequence: Synthetic peptide
  XENP019459 vlCDR2
GAFSRAT

SEQ ID NO: 4728 - protein, 9 aa, Artificial Sequence
  Description of Artificial Sequence: Synthetic peptide
  XENP019459 vlCDR3
QQYGSSPWT

SEQ ID NO: 4729 - protein, 221 aa, Artificial Sequence; identical to SEQ ID NO: 2919
  Description of Artificial Sequence: Synthetic polypeptide
  XENP019460 [CTLA-4]_H0_L0.45_Fab Heavy Chain

SEQ ID NO: 4730 - protein, 118 aa, Artificial Sequence; identical to SEQ ID NO: 22
  Description of Artificial Sequence: Synthetic polypeptide
  VH of XENP019460

SEQ ID NO: 4731 - protein, 5 aa, Artificial Sequence
  Description of Artificial Sequence: Synthetic peptide
  XENP019460 vhCDR1
SYTMH

SEQ ID NO: 4732 - protein, 17 aa, Artificial Sequence
  Description of Artificial Sequence: Synthetic peptide
  XENP019460 vhCDR2
FISYDGNNKYYADSVKG

SEQ ID NO: 4733 - protein, 9 aa, Artificial Sequence
  Description of Artificial Sequence: Synthetic peptide
  XENP019460 vhCDR3
TGWLGPFDY

SEQ ID NO: 4734 - protein, 215 aa, Artificial Sequence
  Description of Artificial Sequence: Synthetic polypeptide
  XENP019460 [CTLA-4]_H0_L0.45_Fab Light Chain
EIVLTQSPGTLSLSPGERATLSCRASQSVGSSYLTWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4735 - protein, 108 aa, Artificial Sequence; identical to SEQ ID NO: 1814
  Description of Artificial Sequence: Synthetic polypeptide
  VL of XENP019460

SEQ ID NO: 4736 - protein, 12 aa, Artificial Sequence
  Description of Artificial Sequence: Synthetic peptide
  XENP019460 vlCDR1
RASQSVGSSYLT

SEQ ID NO: 4737 - protein, 7 aa, Artificial Sequence
  Description of Artificial Sequence: Synthetic peptide
  XENP019460 vlCDR2
GAFSRAT

SEQ ID NO: 4738 - protein, 9 aa, Artificial Sequence
  Description of Artificial Sequence: Synthetic peptide
  XENP019460 vlCDR3
QQYGSSPWT

SEQ ID NO: 4739 - protein, 221 aa, Artificial Sequence; identical to SEQ ID NO: 2919
  Description of Artificial Sequence: Synthetic polypeptide
  XENP019461 [CTLA-4]_H0_L0.46_Fab Heavy Chain

SEQ ID NO: 4740 - protein, 118 aa, Artificial Sequence; identical to SEQ ID NO: 22
  Description of Artificial Sequence: Synthetic polypeptide
  VH of XENP019461

SEQ ID NO: 4741 - protein, 5 aa, Artificial Sequence
  Description of Artificial Sequence: Synthetic peptide
  XENP019461 vhCDR1
SYTMH

SEQ ID NO: 4742 - protein, 17 aa, Artificial Sequence
  Description of Artificial Sequence: Synthetic peptide
  XENP019461 vhCDR2
FISYDGNNKYYADSVKG

SEQ ID NO: 4743 - protein, 9 aa, Artificial Sequence
  Description of Artificial Sequence: Synthetic peptide
  XENP019461 vhCDR3
TGWLGPFDY

SEQ ID NO: 4744 - protein, 215 aa, Artificial Sequence
  Description of Artificial Sequence: Synthetic polypeptide
  XENP019461 [CTLA-4]_H0_L0.46_Fab Light Chain
EIVLTQSPGTLSLSPGERATLSCRASQSVGSSYLAWYEQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4745 - protein, 108 aa, Artificial Sequence; identical to SEQ ID NO: 1823
  Description of Artificial Sequence: Synthetic polypeptide
  VL of XENP019461

SEQ ID NO: 4746 - protein, 12 aa, Artificial Sequence
  Description of Artificial Sequence: Synthetic peptide
  XENP019461 vlCDR1
RASQSVGSSYLA

SEQ ID NO: 4747 - protein, 7 aa, Artificial Sequence
  Description of Artificial Sequence: Synthetic peptide
  XENP019461 vlCDR2
GAFSRAT

SEQ ID NO: 4748 - protein, 9 aa, Artificial Sequence
  Description of Artificial Sequence: Synthetic peptide
  XENP019461 vlCDR3
QQYGSSPWT

SEQ ID NO: 4749 - protein, 221 aa, Artificial Sequence; identical to SEQ ID NO: 2919
  Description of Artificial Sequence: Synthetic polypeptide
  XENP019462 [CTLA-4]_H0_L0.47_Fab Heavy Chain

SEQ ID NO: 4750 - protein, 118 aa, Artificial Sequence; identical to SEQ ID NO: 22
  Description of Artificial Sequence: Synthetic polypeptide
  VH of XENP019462

SEQ ID NO: 4751 - protein, 5 aa, Artificial Sequence
  Description of Artificial Sequence: Synthetic peptide
  XENP019462 vhCDR1
SYTMH

SEQ ID NO: 4752 - protein, 17 aa, Artificial Sequence
  Description of Artificial Sequence: Synthetic peptide
  XENP019462 vhCDR2
FISYDGNNKYYADSVKG

SEQ ID NO: 4753 - protein, 9 aa, Artificial Sequence
  Description of Artificial Sequence: Synthetic peptide
  XENP019462 vhCDR3
TGWLGPFDY

SEQ ID NO: 4754 - protein, 215 aa, Artificial Sequence
  Description of Artificial Sequence: Synthetic polypeptide
  XENP019462 [CTLA-4]_H0_L0.47_Fab Light Chain
EIVLTQSPGTLSLSPGERATLSCRASQSVGSSYLAWYLQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4755 - protein, 108 aa, Artificial Sequence; identical to SEQ ID NO: 1832
  Description of Artificial Sequence: Synthetic polypeptide
  VL of XENP019462

SEQ ID NO: 4756 - protein, 12 aa, Artificial Sequence
  Description of Artificial Sequence: Synthetic peptide
  XENP019462 vlCDR1
RASQSVGSSYLA

SEQ ID NO: 4757 - protein, 7 aa, Artificial Sequence
  Description of Artificial Sequence: Synthetic peptide
  XENP019462 vlCDR2
GAFSRAT

SEQ ID NO: 4758 - protein, 9 aa, Artificial Sequence
  Description of Artificial Sequence: Synthetic peptide
  XENP019462 vlCDR3
QQYGSSPWT

SEQ ID NO: 4759 - protein, 221 aa, Artificial Sequence; identical to SEQ ID NO: 2919
  Description of Artificial Sequence: Synthetic polypeptide
  XENP019463 [CTLA-4]_H0_L0.48_Fab Heavy Chain

SEQ ID NO: 4760 - protein, 118 aa, Artificial Sequence; identical to SEQ ID NO: 22
  Description of Artificial Sequence: Synthetic polypeptide
  VH of XENP019463

SEQ ID NO: 4761 - protein, 5 aa, Artificial Sequence
  Description of Artificial Sequence: Synthetic peptide
  XENP019463 vhCDR1
SYTMH

SEQ ID NO: 4762 - protein, 17 aa, Artificial Sequence
  Description of Artificial Sequence: Synthetic peptide
  XENP019463 vhCDR2
FISYDGNNKYYADSVKG

SEQ ID NO: 4763 - protein, 9 aa, Artificial Sequence
  Description of Artificial Sequence: Synthetic peptide
  XENP019463 vhCDR3
TGWLGPFDY

SEQ ID NO: 4764 - protein, 215 aa, Artificial Sequence
  Description of Artificial Sequence: Synthetic polypeptide
  XENP019463 [CTLA-4]_H0_L0.48_Fab Light Chain
EIVLTQSPGTLSLSPGERATLSCRASQSVGSSYLAWYRQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4765 - protein, 108 aa, Artificial Sequence; identical to SEQ ID NO: 1841
  Description of Artificial Sequence: Synthetic polypeptide
  VL of XENP019463

SEQ ID NO: 4766 - protein, 12 aa, Artificial Sequence
  Description of Artificial Sequence: Synthetic peptide
  XENP019463 vlCDR1
RASQSVGSSYLA

SEQ ID NO: 4767 - protein, 7 aa, Artificial Sequence
  Description of Artificial Sequence: Synthetic peptide
  XENP019463 vlCDR2
GAFSRAT

SEQ ID NO: 4768 - protein, 9 aa, Artificial Sequence
  Description of Artificial Sequence: Synthetic peptide
  XENP019463 vlCDR3
QQYGSSPWT

SEQ ID NO: 4769 - protein, 221 aa, Artificial Sequence; identical to SEQ ID NO: 2919
  Description of Artificial Sequence: Synthetic polypeptide
  XENP019464 [CTLA-4]_H0_L0.49_Fab Heavy Chain

SEQ ID NO: 4770 - protein, 118 aa, Artificial Sequence; identical to SEQ ID NO: 22
  Description of Artificial Sequence: Synthetic polypeptide
  VH of XENP019464

SEQ ID NO: 4771 - protein, 5 aa, Artificial Sequence
  Description of Artificial Sequence: Synthetic peptide
  XENP019464 vhCDR1
SYTMH

SEQ ID NO: 4772 - protein, 17 aa, Artificial Sequence
  Description of Artificial Sequence: Synthetic peptide
  XENP019464 vhCDR2
FISYDGNNKYYADSVKG

SEQ ID NO: 4773 - protein, 9 aa, Artificial Sequence
  Description of Artificial Sequence: Synthetic peptide
  XENP019464 vhCDR3
TGWLGPFDY

SEQ ID NO: 4774 - protein, 215 aa, Artificial Sequence
  Description of Artificial Sequence: Synthetic polypeptide
  XENP019464 [CTLA-4]_H0_L0.49_Fab Light Chain
EIVLTQSPGTLSLSPGERATLSCRASQSVGSSYLAWYRQKPGQAPELLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4775 - protein, 108 aa, Artificial Sequence; identical to SEQ ID NO: 1850
  Description of Artificial Sequence: Synthetic polypeptide
  VL of XENP019464

SEQ ID NO: 4776 - protein, 12 aa, Artificial Sequence
  Description of Artificial Sequence: Synthetic peptide
  XENP019464 vlCDR1
RASQSVGSSYLA

SEQ ID NO: 4777 - protein, 7 aa, Artificial Sequence
  Description of Artificial Sequence: Synthetic peptide
  XENP019464 vlCDR2
GAFSRAT

SEQ ID NO: 4778 - protein, 9 aa, Artificial Sequence
  Description of Artificial Sequence: Synthetic peptide
  XENP019464 vlCDR3
QQYGSSPWT

SEQ ID NO: 4779 - protein, 221 aa, Artificial Sequence; identical to SEQ ID NO: 2919
  Description of Artificial Sequence: Synthetic polypeptide
  XENP019465 [CTLA-4]_H0_L0.50_Fab Heavy Chain

SEQ ID NO: 4780 - protein, 118 aa, Artificial Sequence; identical to SEQ ID NO: 22
  Description of Artificial Sequence: Synthetic polypeptide
  VH of XENP019465

SEQ ID NO: 4781 - protein, 5 aa, Artificial Sequence
  Description of Artificial Sequence: Synthetic peptide
  XENP019465 vhCDR1
SYTMH

SEQ ID NO: 4782 - protein, 17 aa, Artificial Sequence
  Description of Artificial Sequence: Synthetic peptide
  XENP019465 vhCDR2
FISYDGNNKYYADSVKG

SEQ ID NO: 4783 - protein, 9 aa, Artificial Sequence
  Description of Artificial Sequence: Synthetic peptide
  XENP019465 vhCDR3
TGWLGPFDY

SEQ ID NO: 4784 - protein, 215 aa, Artificial Sequence
  Description of Artificial Sequence: Synthetic polypeptide
  XENP019465 [CTLA-4]_H0_L0.50_Fab Light Chain
EIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4785 - protein, 108 aa, Artificial Sequence; identical to SEQ ID NO: 32
  Description of Artificial Sequence: Synthetic polypeptide
  VL of XENP019465

SEQ ID NO: 4786 - protein, 12 aa, Artificial Sequence
  Description of Artificial Sequence: Synthetic peptide
  XENP019465 vlCDR1
RASQSVGSSYLA

SEQ ID NO: 4787 - protein, 7 aa, Artificial Sequence
  Description of Artificial Sequence: Synthetic peptide
  XENP019465 vlCDR2
GAFSRAT

SEQ ID NO: 4788 - protein, 9 aa, Artificial Sequence
  Description of Artificial Sequence: Synthetic peptide
  XENP019465 vlCDR3
QQYGSSPWT

SEQ ID NO: 4789 - protein, 221 aa, Artificial Sequence; identical to SEQ ID NO: 2919
  Description of Artificial Sequence: Synthetic polypeptide
  XENP019466 [CTLA-4]_H0_L0.51_Fab Heavy Chain

SEQ ID NO: 4790 - protein, 118 aa, Artificial Sequence; identical to SEQ ID NO: 22
  Description of Artificial Sequence: Synthetic polypeptide
  VH of XENP019466

SEQ ID NO: 4791 - protein, 5 aa, Artificial Sequence
  Description of Artificial Sequence: Synthetic peptide
  XENP019466 vhCDR1
SYTMH

SEQ ID NO: 4792 - protein, 17 aa, Artificial Sequence
  Description of Artificial Sequence: Synthetic peptide
  XENP019466 vhCDR2
FISYDGNNKYYADSVKG

SEQ ID NO: 4793 - protein, 9 aa, Artificial Sequence
  Description of Artificial Sequence: Synthetic peptide
  XENP019466 vhCDR3
TGWLGPFDY

SEQ ID NO: 4794 - protein, 215 aa, Artificial Sequence
  Description of Artificial Sequence: Synthetic polypeptide
  XENP019466 [CTLA-4]_H0_L0.51_Fab Light Chain
EIVLTQSPGTLSLSPGERATLSCRASQSVGSSYLAWYQQKPDQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4795 - protein, 108 aa, Artificial Sequence; identical to SEQ ID NO: 41
  Description of Artificial Sequence: Synthetic polypeptide
  VL of XENP019466

SEQ ID NO: 4796 - protein, 12 aa, Artificial Sequence
  Description of Artificial Sequence: Synthetic peptide
  XENP019466 vlCDR1
RASQSVGSSYLA

SEQ ID NO: 4797 - protein, 7 aa, Artificial Sequence
  Description of Artificial Sequence: Synthetic peptide
  XENP019466 vlCDR2
GAFSRAT

SEQ ID NO: 4798 - protein, 9 aa, Artificial Sequence
  Description of Artificial Sequence: Synthetic peptide
  XENP019466 vlCDR3
QQYGSSPWT

SEQ ID NO: 4799 - protein, 221 aa, Artificial Sequence; identical to SEQ ID NO: 2919
  Description of Artificial Sequence: Synthetic polypeptide
  XENP019467 [CTLA-4]_H0_L0.52_Fab Heavy Chain

SEQ ID NO: 4800 - protein, 118 aa, Artificial Sequence; identical to SEQ ID NO: 22
  Description of Artificial Sequence: Synthetic polypeptide
  VH of XENP019467

SEQ ID NO: 4801 - protein, 5 aa, Artificial Sequence
  Description of Artificial Sequence: Synthetic peptide
  XENP019467 vhCDR1
SYTMH

SEQ ID NO: 4802 - protein, 17 aa, Artificial Sequence
  Description of Artificial Sequence: Synthetic peptide
  XENP019467 vhCDR2
FISYDGNNKYYADSVKG

SEQ ID NO: 4803 - protein, 9 aa, Artificial Sequence
  Description of Artificial Sequence: Synthetic peptide
  XENP019467 vhCDR3
TGWLGPFDY

SEQ ID NO: 4804 - protein, 215 aa, Artificial Sequence
  Description of Artificial Sequence: Synthetic polypeptide
  XENP019467 [CTLA-4]_H0_L0.52_Fab Light Chain
EIVLTQSPGTLSLSPGERATLSCRASQSVGSSYLAWYQQKPEQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4805 - protein, 108 aa, Artificial Sequence; identical to SEQ ID NO: 1877
  Description of Artificial Sequence: Synthetic polypeptide
  VL of XENP019467

SEQ ID NO: 4806 - protein, 12 aa, Artificial Sequence
  Description of Artificial Sequence: Synthetic peptide
  XENP019467 vlCDR1
RASQSVGSSYLA

SEQ ID NO: 4807 - protein, 7 aa, Artificial Sequence
  Description of Artificial Sequence: Synthetic peptide
  XENP019467 vlCDR2
GAFSRAT

SEQ ID NO: 4808 - protein, 9 aa, Artificial Sequence
  Description of Artificial Sequence: Synthetic peptide
  XENP019467 vlCDR3
QQYGSSPWT

SEQ ID NO: 4809 - protein, 221 aa, Artificial Sequence; identical to SEQ ID NO: 2919
  Description of Artificial Sequence: Synthetic polypeptide
  XENP019468 [CTLA-4]_H0_L0.53_Fab Heavy Chain

SEQ ID NO: 4810 - protein, 118 aa, Artificial Sequence; identical to SEQ ID NO: 22
  Description of Artificial Sequence: Synthetic polypeptide
  VH of XENP019468

SEQ ID NO: 4811 - protein, 5 aa, Artificial Sequence
  Description of Artificial Sequence: Synthetic peptide
  XENP019468 vhCDR1
SYTMH

SEQ ID NO: 4812 - protein, 17 aa, Artificial Sequence
  Description of Artificial Sequence: Synthetic peptide
  XENP019468 vhCDR2
FISYDGNNKYYADSVKG

SEQ ID NO: 4813 - protein, 9 aa, Artificial Sequence
  Description of Artificial Sequence: Synthetic peptide
  XENP019468 vhCDR3
TGWLGPFDY

SEQ ID NO: 4814 - protein, 215 aa, Artificial Sequence
  Description of Artificial Sequence: Synthetic polypeptide
  XENP019468 [CTLA-4]_H0_L0.53_Fab Light Chain
EIVLTQSPGTLSLSPGERATLSCRASQSVGSSYLAWYQQKPGEAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4815 - protein, 108 aa, Artificial Sequence; identical to SEQ ID NO: 77
  Description of Artificial Sequence: Synthetic polypeptide
  VL of XENP019468

SEQ ID NO: 4816 - protein, 12 aa, Artificial Sequence
  Description of Artificial Sequence: Synthetic peptide
  XENP019468 vlCDR1
RASQSVGSSYLA

SEQ ID NO: 4817 - protein, 7 aa, Artificial Sequence
  Description of Artificial Sequence: Synthetic peptide
  XENP019468 vlCDR2
GAFSRAT

SEQ ID NO: 4818 - protein, 9 aa, Artificial Sequence
  Description of Artificial Sequence: Synthetic peptide
  XENP019468 vlCDR3
QQYGSSPWT

SEQ ID NO: 4819 - protein, 221 aa, Artificial Sequence; identical to SEQ ID NO: 2919
  Description of Artificial Sequence: Synthetic polypeptide
  XENP019469 [CTLA-4]_H0_L0.54_Fab Heavy Chain

SEQ ID NO: 4820 - protein, 118 aa, Artificial Sequence; identical to SEQ ID NO: 22
  Description of Artificial Sequence: Synthetic polypeptide
  VH of XENP019469

SEQ ID NO: 4821 - protein, 5 aa, Artificial Sequence
  Description of Artificial Sequence: Synthetic peptide
  XENP019469 vhCDR1
SYTMH

SEQ ID NO: 4822 - protein, 17 aa, Artificial Sequence
  Description of Artificial Sequence: Synthetic peptide
  XENP019469 vhCDR2
FISYDGNNKYYADSVKG

SEQ ID NO: 4823 - protein, 9 aa, Artificial Sequence
  Description of Artificial Sequence: Synthetic peptide
  XENP019469 vhCDR3
TGWLGPFDY

SEQ ID NO: 4824 - protein, 215 aa, Artificial Sequence
  Description of Artificial Sequence: Synthetic polypeptide
  XENP019469 [CTLA-4]_H0_L0.54_Fab Light Chain
EIVLTQSPGTLSLSPGERATLSCRASQSVGSSYLAWYQQKPGKAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4825 - protein, 108 aa, Artificial Sequence; identical to SEQ ID NO: 1895
  Description of Artificial Sequence: Synthetic polypeptide
  VL of XENP019469

SEQ ID NO: 4826 - protein, 12 aa, Artificial Sequence
  Description of Artificial Sequence: Synthetic peptide
  XENP019469 vlCDR1
RASQSVGSSYLA

SEQ ID NO: 4827 - protein, 7 aa, Artificial Sequence
  Description of Artificial Sequence: Synthetic peptide
  XENP019469 vlCDR2
GAFSRAT

SEQ ID NO: 4828 - protein, 9 aa, Artificial Sequence
  Description of Artificial Sequence: Synthetic peptide
  XENP019469 vlCDR3
QQYGSSPWT

SEQ ID NO: 4829 - protein, 221 aa, Artificial Sequence; identical to SEQ ID NO: 2919
  Description of Artificial Sequence: Synthetic polypeptide
  XENP019470 [CTLA-4]_H0_L0.55_Fab Heavy Chain

SEQ ID NO: 4830 - protein, 118 aa, Artificial Sequence; identical to SEQ ID NO: 22
  Description of Artificial Sequence: Synthetic polypeptide
  VH of XENP019470

SEQ ID NO: 4831 - protein, 5 aa, Artificial Sequence
  Description of Artificial Sequence: Synthetic peptide
  XENP019470 vhCDR1
SYTMH

SEQ ID NO: 4832 - protein, 17 aa, Artificial Sequence
  Description of Artificial Sequence: Synthetic peptide
  XENP019470 vhCDR2
FISYDGNNKYYADSVKG

SEQ ID NO: 4833 - protein, 9 aa, Artificial Sequence
  Description of Artificial Sequence: Synthetic peptide
  XENP019470 vhCDR3
TGWLGPFDY

SEQ ID NO: 4834 - protein, 215 aa, Artificial Sequence
  Description of Artificial Sequence: Synthetic polypeptide
  XENP019470 [CTLA-4]_H0_L0.55_Fab Light Chain
EIVLTQSPGTLSLSPGERATLSCRASQSVGSSYLAWYQQKPGKSPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4835 - protein, 108 aa, Artificial Sequence; identical to SEQ ID NO: 1904
  Description of Artificial Sequence: Synthetic polypeptide
  VL of XENP019470

SEQ ID NO: 4836 - protein, 12 aa, Artificial Sequence
  Description of Artificial Sequence: Synthetic peptide
  XENP019470 vlCDR1
RASQSVGSSYLA

SEQ ID NO: 4837 - protein, 7 aa, Artificial Sequence
  Description of Artificial Sequence: Synthetic peptide
  XENP019470 vlCDR2
GAFSRAT

SEQ ID NO: 4838 - protein, 9 aa, Artificial Sequence
  Description of Artificial Sequence: Synthetic peptide
  XENP019470 vlCDR3
QQYGSSPWT

SEQ ID NO: 4839 - protein, 221 aa, Artificial Sequence; identical to SEQ ID NO: 2919
  Description of Artificial Sequence: Synthetic polypeptide
  XENP019471 [CTLA-4]_H0_L0.56_Fab Heavy Chain

SEQ ID NO: 4840 - protein, 118 aa, Artificial Sequence; identical to SEQ ID NO: 22
  Description of Artificial Sequence: Synthetic polypeptide
  VH of XENP019471

SEQ ID NO: 4841 - protein, 5 aa, Artificial Sequence
  Description of Artificial Sequence: Synthetic peptide
  XENP019471 vhCDR1
SYTMH

SEQ ID NO: 4842 - protein, 17 aa, Artificial Sequence
  Description of Artificial Sequence: Synthetic peptide
  XENP019471 vhCDR2
FISYDGNNKYYADSVKG

SEQ ID NO: 4843 - protein, 9 aa, Artificial Sequence
  Description of Artificial Sequence: Synthetic peptide
  XENP019471 vhCDR3
TGWLGPFDY

SEQ ID NO: 4844 - protein, 215 aa, Artificial Sequence
  Description of Artificial Sequence: Synthetic polypeptide
  XENP019471 [CTLA-4]_H0_L0.56_Fab Light Chain
EIVLTQSPGTLSLSPGERATLSCRASQSVGSSYLAWYQQKPGQSPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4845 - protein, 108 aa, Artificial Sequence; identical to SEQ ID NO: 1913
  Description of Artificial Sequence: Synthetic polypeptide
  VL of XENP019471

SEQ ID NO: 4846 - protein, 12 aa, Artificial Sequence
  Description of Artificial Sequence: Synthetic peptide
  XENP019471 vlCDR1
RASQSVGSSYLA

SEQ ID NO: 4847 - protein, 7 aa, Artificial Sequence
  Description of Artificial Sequence: Synthetic peptide
  XENP019471 vlCDR2
GAFSRAT

SEQ ID NO: 4848 - protein, 9 aa, Artificial Sequence
  Description of Artificial Sequence: Synthetic peptide
  XENP019471 vlCDR3
QQYGSSPWT

SEQ ID NO: 4849 - protein, 221 aa, Artificial Sequence; identical to SEQ ID NO: 2919
  Description of Artificial Sequence: Synthetic polypeptide
  XENP019472 [CTLA-4]_H0_L0.57_Fab Heavy Chain

SEQ ID NO: 4850 - protein, 118 aa, Artificial Sequence; identical to SEQ ID NO: 22
  Description of Artificial Sequence: Synthetic polypeptide
  VH of XENP019472

SEQ ID NO: 4851 - protein, 5 aa, Artificial Sequence
  Description of Artificial Sequence: Synthetic peptide
  XENP019472 vhCDR1
SYTMH

SEQ ID NO: 4852 - protein, 17 aa, Artificial Sequence
  Description of Artificial Sequence: Synthetic peptide
  XENP019472 vhCDR2
FISYDGNNKYYADSVKG

SEQ ID NO: 4853 - protein, 9 aa, Artificial Sequence
  Description of Artificial Sequence: Synthetic peptide
  XENP019472 vhCDR3
TGWLGPFDY

SEQ ID NO: 4854 - protein, 215 aa, Artificial Sequence
  Description of Artificial Sequence: Synthetic polypeptide
  XENP019472 [CTLA-4]_H0_L0.57_Fab Light Chain
EIVLTQSPGTLSLSPGERATLSCRASQSVGSSYLAWYQQKPGQAPELLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4855 - protein, 108 aa, Artificial Sequence; identical to SEQ ID NO: 86
  Description of Artificial Sequence: Synthetic polypeptide
  VL of XENP019472

SEQ ID NO: 4856 - protein, 12 aa, Artificial Sequence
  Description of Artificial Sequence: Synthetic peptide
  XENP019472 vlCDR1
RASQSVGSSYLA

SEQ ID NO: 4857 - protein, 7 aa, Artificial Sequence
  Description of Artificial Sequence: Synthetic peptide
  XENP019472 vlCDR2
GAFSRAT

SEQ ID NO: 4858 - protein, 9 aa, Artificial Sequence
  Description of Artificial Sequence: Synthetic peptide
  XENP019472 vlCDR3
QQYGSSPWT

SEQ ID NO: 4859 - protein, 221 aa, Artificial Sequence; identical to SEQ ID NO: 2919
  Description of Artificial Sequence: Synthetic polypeptide
  XENP019473 [CTLA-4]_H0_L0.58_Fab Heavy Chain

SEQ ID NO: 4860 - protein, 118 aa, Artificial Sequence; identical to SEQ ID NO: 22
  Description of Artificial Sequence: Synthetic polypeptide
  VH of XENP019473

SEQ ID NO: 4861 - protein, 5 aa, Artificial Sequence
  Description of Artificial Sequence: Synthetic peptide
  XENP019473 vhCDR1
SYTMH

SEQ ID NO: 4862 - protein, 17 aa, Artificial Sequence
  Description of Artificial Sequence: Synthetic peptide
  XENP019473 vhCDR2
FISYDGNNKYYADSVKG

SEQ ID NO: 4863 - protein, 9 aa, Artificial Sequence
  Description of Artificial Sequence: Synthetic peptide
  XENP019473 vhCDR3
TGWLGPFDY

SEQ ID NO: 4864 - protein, 215 aa, Artificial Sequence
  Description of Artificial Sequence: Synthetic polypeptide
  XENP019473 [CTLA-4]_H0_L0.58_Fab Light Chain
EIVLTQSPGTLSLSPGERATLSCRASQSVGSSYLAWYQQKPGQAPELLIYGAFSRATGIPDRFSGSGSGTDFTLTISRLEPQDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4865 - protein, 108 aa, Artificial Sequence; identical to SEQ ID NO: 1931
  Description of Artificial Sequence: Synthetic polypeptide
  VL of XENP019473

SEQ ID NO: 4866 - protein, 12 aa, Artificial Sequence
  Description of Artificial Sequence: Synthetic peptide
  XENP019473 vlCDR1
RASQSVGSSYLA

SEQ ID NO: 4867 - protein, 7 aa, Artificial Sequence
  Description of Artificial Sequence: Synthetic peptide
  XENP019473 vlCDR2
GAFSRAT

SEQ ID NO: 4868 - protein, 9 aa, Artificial Sequence
  Description of Artificial Sequence: Synthetic peptide
  XENP019473 vlCDR3
QQYGSSPWT

SEQ ID NO: 4869 - protein, 221 aa, Artificial Sequence; identical to SEQ ID NO: 2919
  Description of Artificial Sequence: Synthetic polypeptide
  XENP019474 [CTLA-4]_H0_L0.59_Fab Heavy Chain

SEQ ID NO: 4870 - protein, 118 aa, Artificial Sequence; identical to SEQ ID NO: 22
  Description of Artificial Sequence: Synthetic polypeptide
  VH of XENP019474

SEQ ID NO: 4871 - protein, 5 aa, Artificial Sequence
  Description of Artificial Sequence: Synthetic peptide
  XENP019474 vhCDR1
SYTMH

SEQ ID NO: 4872 - protein, 17 aa, Artificial Sequence
  Description of Artificial Sequence: Synthetic peptide
  XENP019474 vhCDR2
FISYDGNNKYYADSVKG

SEQ ID NO: 4873 - protein, 9 aa, Artificial Sequence
  Description of Artificial Sequence: Synthetic peptide
  XENP019474 vhCDR3
TGWLGPFDY

SEQ ID NO: 4874 - protein, 215 aa, Artificial Sequence
  Description of Artificial Sequence: Synthetic polypeptide
  XENP019474 [CTLA-4]_H0_L0.59_Fab Light Chain
EIVLTQSPGTLSLSPGERATLSCRASQSVGSSYLAWYQQKPGQAPKLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4875 - protein, 108 aa, Artificial Sequence; identical to SEQ ID NO: 1940
  Description of Artificial Sequence: Synthetic polypeptide
  VL of XENP019474

SEQ ID NO: 4876 - protein, 12 aa, Artificial Sequence
  Description of Artificial Sequence: Synthetic peptide
  XENP019474 vlCDR1
RASQSVGSSYLA

SEQ ID NO: 4877 - protein, 7 aa, Artificial Sequence
  Description of Artificial Sequence: Synthetic peptide
  XENP019474 vlCDR2
GAFSRAT

SEQ ID NO: 4878 - protein, 9 aa, Artificial Sequence
  Description of Artificial Sequence: Synthetic peptide
  XENP019474 vlCDR3
QQYGSSPWT

SEQ ID NO: 4879 - protein, 221 aa, Artificial Sequence; identical to SEQ ID NO: 2919
  Description of Artificial Sequence: Synthetic polypeptide
  XENP019475 [CTLA-4]_H0_L0.60_Fab Heavy Chain

SEQ ID NO: 4880 - protein, 118 aa, Artificial Sequence; identical to SEQ ID NO: 22
  Description of Artificial Sequence: Synthetic polypeptide
  VH of XENP019475

SEQ ID NO: 4881 - protein, 5 aa, Artificial Sequence
  Description of Artificial Sequence: Synthetic peptide
  XENP019475 vhCDR1
SYTMH

SEQ ID NO: 4882 - protein, 17 aa, Artificial Sequence
  Description of Artificial Sequence: Synthetic peptide
  XENP019475 vhCDR2
FISYDGNNKYYADSVKG

SEQ ID NO: 4883 - protein, 9 aa, Artificial Sequence
  Description of Artificial Sequence: Synthetic peptide
  XENP019475 vhCDR3
TGWLGPFDY

SEQ ID NO: 4884 - protein, 215 aa, Artificial Sequence
  Description of Artificial Sequence: Synthetic polypeptide
  XENP019475 [CTLA-4]_H0_L0.60_Fab Light Chain
EIVLTQSPGTLSLSPGERATLSCRASQSVGSSYLAWYQQKPGQAPRRLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4885 - protein, 108 aa, Artificial Sequence; identical to SEQ ID NO: 1949
  Description of Artificial Sequence: Synthetic polypeptide
  VL of XENP019475

SEQ ID NO: 4886 - protein, 12 aa, Artificial Sequence
  Description of Artificial Sequence: Synthetic peptide
  XENP019475 vlCDR1
RASQSVGSSYLA

SEQ ID NO: 4887 - protein, 7 aa, Artificial Sequence
  Description of Artificial Sequence: Synthetic peptide
  XENP019475 vlCDR2
GAFSRAT

SEQ ID NO: 4888 - protein, 9 aa, Artificial Sequence
  Description of Artificial Sequence: Synthetic peptide
  XENP019475 vlCDR3
QQYGSSPWT

SEQ ID NO: 4889 - protein, 221 aa, Artificial Sequence; identical to SEQ ID NO: 2919
  Description of Artificial Sequence: Synthetic polypeptide
  XENP019476 [CTLA-4]_H0_L0.61_Fab Heavy Chain

SEQ ID NO: 4890 - protein, 118 aa, Artificial Sequence; identical to SEQ ID NO: 22
  Description of Artificial Sequence: Synthetic polypeptide
  VH of XENP019476

SEQ ID NO: 4891 - protein, 5 aa, Artificial Sequence
  Description of Artificial Sequence: Synthetic peptide
  XENP019476 vhCDR1
SYTMH

SEQ ID NO: 4892 - protein, 17 aa, Artificial Sequence
  Description of Artificial Sequence: Synthetic peptide
  XENP019476 vhCDR2
FISYDGNNKYYADSVKG

SEQ ID NO: 4893 - protein, 9 aa, Artificial Sequence
  Description of Artificial Sequence: Synthetic peptide
  XENP019476 vhCDR3
TGWLGPFDY

SEQ ID NO: 4894 - protein, 215 aa, Artificial Sequence
  Description of Artificial Sequence: Synthetic polypeptide
  XENP019476 [CTLA-4]_H0_L0.61_Fab Light Chain
EIVLTQSPGTLSLSPGERATLSCRASQSVGSSYLAWYQQKPGQAPRRLIYGAFSRDTGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4895 - protein, 108 aa, Artificial Sequence; identical to SEQ ID NO: 1958
  Description of Artificial Sequence: Synthetic polypeptide
  VL of XENP019476

SEQ ID NO: 4896 - protein, 12 aa, Artificial Sequence
  Description of Artificial Sequence: Synthetic peptide
  XENP019476 vlCDR1
RASQSVGSSYLA

SEQ ID NO: 4897 - protein, 7 aa, Artificial Sequence
  Description of Artificial Sequence: Synthetic peptide
  XENP019476 vlCDR2
GAFSRDT

SEQ ID NO: 4898 - protein, 9 aa, Artificial Sequence
  Description of Artificial Sequence: Synthetic peptide
  XENP019476 vlCDR3
QQYGSSPWT

SEQ ID NO: 4899 - protein, 221 aa, Artificial Sequence; identical to SEQ ID NO: 2919
  Description of Artificial Sequence: Synthetic polypeptide
  XENP019477 [CTLA-4]_H0_L0.62_Fab Heavy Chain

SEQ ID NO: 4900 - protein, 118 aa, Artificial Sequence; identical to SEQ ID NO: 22
  Description of Artificial Sequence: Synthetic polypeptide
  VH of XENP019477

SEQ ID NO: 4901 - protein, 5 aa, Artificial Sequence
  Description of Artificial Sequence: Synthetic peptide
  XENP019477 vhCDR1
SYTMH

SEQ ID NO: 4902 - protein, 17 aa, Artificial Sequence
  Description of Artificial Sequence: Synthetic peptide
  XENP019477 vhCDR2
FISYDGNNKYYADSVKG

SEQ ID NO: 4903 - protein, 9 aa, Artificial Sequence
  Description of Artificial Sequence: Synthetic peptide
  XENP019477 vhCDR3
TGWLGPFDY

SEQ ID NO: 4904 - protein, 215 aa, Artificial Sequence
  Description of Artificial Sequence: Synthetic polypeptide
  XENP019477 [CTLA-4]_H0_L0.62_Fab Light Chain
EIVLTQSPGTLSLSPGERATLSCRASQSVGSSYLAWYQQKPGQAPRLLIAGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4905 - protein, 108 aa, Artificial Sequence; identical to SEQ ID NO: 1967
  Description of Artificial Sequence: Synthetic polypeptide
  VL of XENP019477

SEQ ID NO: 4906 - protein, 12 aa, Artificial Sequence
  Description of Artificial Sequence: Synthetic peptide
  XENP019477 vlCDR1
RASQSVGSSYLA

SEQ ID NO: 4907 - protein, 7 aa, Artificial Sequence
  Description of Artificial Sequence: Synthetic peptide
  XENP019477 vlCDR2
GAFSRAT

SEQ ID NO: 4908 - protein, 9 aa, Artificial Sequence
  Description of Artificial Sequence: Synthetic peptide
  XENP019477 vlCDR3
QQYGSSPWT

SEQ ID NO: 4909 - protein, 221 aa, Artificial Sequence; identical to SEQ ID NO: 2919
  Description of Artificial Sequence: Synthetic polypeptide
  XENP019478 [CTLA-4]_H0_L0.63_Fab Heavy Chain

SEQ ID NO: 4910 - protein, 118 aa, Artificial Sequence; identical to SEQ ID NO: 22
  Description of Artificial Sequence: Synthetic polypeptide
  VH of XENP019478

SEQ ID NO: 4911 - protein, 5 aa, Artificial Sequence
  Description of Artificial Sequence: Synthetic peptide
  XENP019478 vhCDR1
SYTMH

SEQ ID NO: 4912 - protein, 17 aa, Artificial Sequence
  Description of Artificial Sequence: Synthetic peptide
  XENP019478 vhCDR2
FISYDGNNKYYADSVKG

SEQ ID NO: 4913 - protein, 9 aa, Artificial Sequence
  Description of Artificial Sequence: Synthetic peptide
  XENP019478 vhCDR3
TGWLGPFDY

SEQ ID NO: 4914 - protein, 215 aa, Artificial Sequence
  Description of Artificial Sequence: Synthetic polypeptide
  XENP019478 [CTLA-4]_H0_L0.63_Fab Light Chain
EIVLTQSPGTLSLSPGERATLSCRASQSVGSSYLAWYQQKPGQAPRLLIFGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4915 - protein, 108 aa, Artificial Sequence; identical to SEQ ID NO: 1976
  Description of Artificial Sequence: Synthetic polypeptide
  VL of XENP019478

SEQ ID NO: 4916 - protein, 12 aa, Artificial Sequence
  Description of Artificial Sequence: Synthetic peptide
  XENP019478 vlCDR1
RASQSVGSSYLA

SEQ ID NO: 4917 - protein, 7 aa, Artificial Sequence
  Description of Artificial Sequence: Synthetic peptide
  XENP019478 vlCDR2
GAFSRAT

SEQ ID NO: 4918 - protein, 9 aa, Artificial Sequence
  Description of Artificial Sequence: Synthetic peptide
  XENP019478 vlCDR3
QQYGSSPWT

SEQ ID NO: 4919 - protein, 221 aa, Artificial Sequence; identical to SEQ ID NO: 2919
  Description of Artificial Sequence: Synthetic polypeptide
  XENP019479 [CTLA-4]_H0_L0.64_Fab Heavy Chain

SEQ ID NO: 4920 - protein, 118 aa, Artificial Sequence; identical to SEQ ID NO: 22
  Description of Artificial Sequence: Synthetic polypeptide
  VH of XENP019479

SEQ ID NO: 4921 - protein, 5 aa, Artificial Sequence
  Description of Artificial Sequence: Synthetic peptide
  XENP019479 vhCDR1
SYTMH

SEQ ID NO: 4922 - protein, 17 aa, Artificial Sequence
  Description of Artificial Sequence: Synthetic peptide
  XENP019479 vhCDR2
FISYDGNNKYYADSVKG

SEQ ID NO: 4923 - protein, 9 aa, Artificial Sequence
  Description of Artificial Sequence: Synthetic peptide
  XENP019479 vhCDR3
TGWLGPFDY

SEQ ID NO: 4924 - protein, 215 aa, Artificial Sequence
  Description of Artificial Sequence: Synthetic polypeptide
  XENP019479 [CTLA-4]_H0_L0.64_Fab Light Chain
EIVLTQSPGTLSLSPGERATLSCRASQSVGSSYLAWYQQKPGQAPRLLIHGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4925 - protein, 108 aa, Artificial Sequence; identical to SEQ ID NO: 1985
  Description of Artificial Sequence: Synthetic polypeptide
  VL of XENP019479

SEQ ID NO: 4926 - protein, 12 aa, Artificial Sequence
  Description of Artificial Sequence: Synthetic peptide
  XENP019479 vlCDR1
RASQSVGSSYLA

SEQ ID NO: 4927 - protein, 7 aa, Artificial Sequence
  Description of Artificial Sequence: Synthetic peptide
  XENP019479 vlCDR2
GAFSRAT

SEQ ID NO: 4928 - protein, 9 aa, Artificial Sequence
  Description of Artificial Sequence: Synthetic peptide
  XENP019479 vlCDR3
QQYGSSPWT

SEQ ID NO: 4929 - protein, 221 aa, Artificial Sequence; identical to SEQ ID NO: 2919
  Description of Artificial Sequence: Synthetic polypeptide
  XENP019480 [CTLA-4]_H0_L0.65_Fab Heavy Chain

SEQ ID NO: 4930 - protein, 118 aa, Artificial Sequence; identical to SEQ ID NO: 22
  Description of Artificial Sequence: Synthetic polypeptide
  VH of XENP019480

SEQ ID NO: 4931 - protein, 5 aa, Artificial Sequence
  Description of Artificial Sequence: Synthetic peptide
  XENP019480 vhCDR1
SYTMH

SEQ ID NO: 4932 - protein, 17 aa, Artificial Sequence
  Description of Artificial Sequence: Synthetic peptide
  XENP019480 vhCDR2
FISYDGNNKYYADSVKG

SEQ ID NO: 4933 - protein, 9 aa, Artificial Sequence
  Description of Artificial Sequence: Synthetic peptide
  XENP019480 vhCDR3
TGWLGPFDY

SEQ ID NO: 4934 - protein, 215 aa, Artificial Sequence
  Description of Artificial Sequence: Synthetic polypeptide
  XENP019480 [CTLA-4]_H0_L0.65_Fab Light Chain
EIVLTQSPGTLSLSPGERATLSCRASQSVGSSYLAWYQQKPGQAPRLLILGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4935 - protein, 108 aa, Artificial Sequence; identical to SEQ ID NO: 1994
  Description of Artificial Sequence: Synthetic polypeptide
  VL of XENP019480

SEQ ID NO: 4936 - protein, 12 aa, Artificial Sequence
  Description of Artificial Sequence: Synthetic peptide
  XENP019480 vlCDR1
RASQSVGSSYLA

SEQ ID NO: 4937 - protein, 7 aa, Artificial Sequence
  Description of Artificial Sequence: Synthetic peptide
  XENP019480 vlCDR2
GAFSRAT

SEQ ID NO: 4938 - protein, 9 aa, Artificial Sequence
  Description of Artificial Sequence: Synthetic peptide
  XENP019480 vlCDR3
QQYGSSPWT

SEQ ID NO: 4939 - protein, 221 aa, Artificial Sequence; identical to SEQ ID NO: 2919
  Description of Artificial Sequence: Synthetic polypeptide
  XENP019481 [CTLA-4]_H0_L0.66_Fab Heavy Chain

SEQ ID NO: 4940 - protein, 118 aa, Artificial Sequence; identical to SEQ ID NO: 22
  Description of Artificial Sequence: Synthetic polypeptide
  VH of XENP019481

SEQ ID NO: 4941 - protein, 5 aa, Artificial Sequence
  Description of Artificial Sequence: Synthetic peptide
  XENP019481 vhCDR1
SYTMH

SEQ ID NO: 4942 - protein, 17 aa, Artificial Sequence
  Description of Artificial Sequence: Synthetic peptide
  XENP019481 vhCDR2
FISYDGNNKYYADSVKG

SEQ ID NO: 4943 - protein, 9 aa, Artificial Sequence
  Description of Artificial Sequence: Synthetic peptide
  XENP019481 vhCDR3
TGWLGPFDY

SEQ ID NO: 4944 - protein, 215 aa, Artificial Sequence
  Description of Artificial Sequence: Synthetic polypeptide
  XENP019481 [CTLA-4]_H0_L0.66_Fab Light Chain
EIVLTQSPGTLSLSPGERATLSCRASQSVGSSYLAWYQQKPGQAPRLLIVGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4945 - protein, 108 aa, Artificial Sequence; identical to SEQ ID NO: 2003
  Description of Artificial Sequence: Synthetic polypeptide
  VL of XENP019481

SEQ ID NO: 4946 - protein, 12 aa, Artificial Sequence
  Description of Artificial Sequence: Synthetic peptide
  XENP019481 vlCDR1
RASQSVGSSYLA

SEQ ID NO: 4947 - protein, 7 aa, Artificial Sequence
  Description of Artificial Sequence: Synthetic peptide
  XENP019481 vlCDR2
GAFSRAT

SEQ ID NO: 4948 - protein, 9 aa, Artificial Sequence
  Description of Artificial Sequence: Synthetic peptide
  XENP019481 vlCDR3
QQYGSSPWT

SEQ ID NO: 4949 - protein, 221 aa, Artificial Sequence; identical to SEQ ID NO: 2919
  Description of Artificial Sequence: Synthetic polypeptide
  XENP019482 [CTLA-4]_H0_L0.67_Fab Heavy Chain

SEQ ID NO: 4950 - protein, 118 aa, Artificial Sequence; identical to SEQ ID NO: 22
  Description of Artificial Sequence: Synthetic polypeptide
  VH of XENP019482

SEQ ID NO: 4951 - protein, 5 aa, Artificial Sequence
  Description of Artificial Sequence: Synthetic peptide
  XENP019482 vhCDR1
SYTMH

SEQ ID NO: 4952 - protein, 17 aa, Artificial Sequence
  Description of Artificial Sequence: Synthetic peptide
  XENP019482 vhCDR2
FISYDGNNKYYADSVKG

SEQ ID NO: 4953 - protein, 9 aa, Artificial Sequence
  Description of Artificial Sequence: Synthetic peptide
  XENP019482 vhCDR3
TGWLGPFDY

SEQ ID NO: 4954 - protein, 215 aa, Artificial Sequence
  Description of Artificial Sequence: Synthetic polypeptide
  XENP019482 [CTLA-4]_H0_L0.67_Fab Light Chain
EIVLTQSPGTLSLSPGERATLSCRASQSVGSSYLAWYQQKPGQAPRLLIYDAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4955 - protein, 108 aa, Artificial Sequence; identical to SEQ ID NO: 2012
  Description of Artificial Sequence: Synthetic polypeptide
  VL of XENP019482

SEQ ID NO: 4956 - protein, 12 aa, Artificial Sequence
  Description of Artificial Sequence: Synthetic peptide
  XENP019482 vlCDR1
RASQSVGSSYLA

SEQ ID NO: 4957 - protein, 7 aa, Artificial Sequence
  Description of Artificial Sequence: Synthetic peptide
  XENP019482 vlCDR2
DAFSRAT

SEQ ID NO: 4958 - protein, 9 aa, Artificial Sequence
  Description of Artificial Sequence: Synthetic peptide
  XENP019482 vlCDR3
QQYGSSPWT

SEQ ID NO: 4959 - protein, 221 aa, Artificial Sequence; identical to SEQ ID NO: 2919
  Description of Artificial Sequence: Synthetic polypeptide
  XENP019483 [CTLA-4]_H0_L0.68_Fab Heavy Chain

SEQ ID NO: 4960 - protein, 118 aa, Artificial Sequence; identical to SEQ ID NO: 22
  Description of Artificial Sequence: Synthetic polypeptide
  VH of XENP019483

SEQ ID NO: 4961 - protein, 5 aa, Artificial Sequence
  Description of Artificial Sequence: Synthetic peptide
  XENP019483 vhCDR1
SYTMH

SEQ ID NO: 4962 - protein, 17 aa, Artificial Sequence
  Description of Artificial Sequence: Synthetic peptide
  XENP019483 vhCDR2
FISYDGNNKYYADSVKG

SEQ ID NO: 4963 - protein, 9 aa, Artificial Sequence
  Description of Artificial Sequence: Synthetic peptide
  XENP019483 vhCDR3
TGWLGPFDY

SEQ ID NO: 4964 - protein, 215 aa, Artificial Sequence
  Description of Artificial Sequence: Synthetic polypeptide
  XENP019483 [CTLA-4]_H0_L0.68_Fab Light Chain
EIVLTQSPGTLSLSPGERATLSCRASQSVGSSYLAWYQQKPGQAPRLLIYSAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4965 - protein, 108 aa, Artificial Sequence; identical to SEQ ID NO: 2021
  Description of Artificial Sequence: Synthetic polypeptide
  VL of XENP019483

SEQ ID NO: 4966 - protein, 12 aa, Artificial Sequence
  Description of Artificial Sequence: Synthetic peptide
  XENP019483 vlCDR1
RASQSVGSSYLA

SEQ ID NO: 4967 - protein, 7 aa, Artificial Sequence
  Description of Artificial Sequence: Synthetic peptide
  XENP019483 vlCDR2
SAFSRAT

SEQ ID NO: 4968 - protein, 9 aa, Artificial Sequence
  Description of Artificial Sequence: Synthetic peptide
  XENP019483 vlCDR3
QQYGSSPWT

SEQ ID NO: 4969 - protein, 221 aa, Artificial Sequence; identical to SEQ ID NO: 2919
  Description of Artificial Sequence: Synthetic polypeptide
  XENP019484 [CTLA-4]_H0_L0.69_Fab Heavy Chain

SEQ ID NO: 4970 - protein, 118 aa, Artificial Sequence; identical to SEQ ID NO: 22
  Description of Artificial Sequence: Synthetic polypeptide
  VH of XENP019484

SEQ ID NO: 4971 - protein, 5 aa, Artificial Sequence
  Description of Artificial Sequence: Synthetic peptide
  XENP019484 vhCDR1
SYTMH

SEQ ID NO: 4972 - protein, 17 aa, Artificial Sequence
  Description of Artificial Sequence: Synthetic peptide
  XENP019484 vhCDR2
FISYDGNNKYYADSVKG

SEQ ID NO: 4973 - protein, 9 aa, Artificial Sequence
  Description of Artificial Sequence: Synthetic peptide
  XENP019484 vhCDR3
TGWLGPFDY

SEQ ID NO: 4974 - protein, 215 aa, Artificial Sequence
  Description of Artificial Sequence: Synthetic polypeptide
  XENP019484 [CTLA-4]_H0_L0.69_Fab Light Chain
EIVLTQSPGTLSLSPGERATLSCRASQSVGSSYLAWYQQKPGQAPRLLIYGVFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4975 - protein, 108 aa, Artificial Sequence; identical to SEQ ID NO: 2030
  Description of Artificial Sequence: Synthetic polypeptide
  VL of XENP019484

SEQ ID NO: 4976 - protein, 12 aa, Artificial Sequence
  Description of Artificial Sequence: Synthetic peptide
  XENP019484 vlCDR1
RASQSVGSSYLA

SEQ ID NO: 4977 - protein, 7 aa, Artificial Sequence
  Description of Artificial Sequence: Synthetic peptide
  XENP019484 vlCDR2
GVFSRAT

SEQ ID NO: 4978 - protein, 9 aa, Artificial Sequence
  Description of Artificial Sequence: Synthetic peptide
  XENP019484 vlCDR3
QQYGSSPWT

SEQ ID NO: 4979 - protein, 221 aa, Artificial Sequence; identical to SEQ ID NO: 2919
  Description of Artificial Sequence: Synthetic polypeptide
  XENP019485 [CTLA-4]_H0_L0.70_Fab Heavy Chain

SEQ ID NO: 4980 - protein, 118 aa, Artificial Sequence; identical to SEQ ID NO: 22
  Description of Artificial Sequence: Synthetic polypeptide
  VH of XENP019485

SEQ ID NO: 4981 - protein, 5 aa, Artificial Sequence
  Description of Artificial Sequence: Synthetic peptide
  XENP019485 vhCDR1
SYTMH

SEQ ID NO: 4982 - protein, 17 aa, Artificial Sequence
  Description of Artificial Sequence: Synthetic peptide
  XENP019485 vhCDR2
FISYDGNNKYYADSVKG

SEQ ID NO: 4983 - protein, 9 aa, Artificial Sequence
  Description of Artificial Sequence: Synthetic peptide
  XENP019485 vhCDR3
TGWLGPFDY

SEQ ID NO: 4984 - protein, 215 aa, Artificial Sequence
  Description of Artificial Sequence: Synthetic polypeptide
  XENP019485 [CTLA-4]_H0_L0.70_Fab Light Chain
EIVLTQSPGTLSLSPGERATLSCRASQSVGSSYLAWYQQKPGQAPRLLIYGAHSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4985 - protein, 108 aa, Artificial Sequence; identical to SEQ ID NO: 2039
  Description of Artificial Sequence: Synthetic polypeptide
  VL of XENP019485

SEQ ID NO: 4986 - protein, 12 aa, Artificial Sequence
  Description of Artificial Sequence: Synthetic peptide
  XENP019485 vlCDR1
RASQSVGSSYLA

SEQ ID NO: 4987 - protein, 7 aa, Artificial Sequence
  Description of Artificial Sequence: Synthetic peptide
  XENP019485 vlCDR2
GAHSRAT

SEQ ID NO: 4988 - protein, 9 aa, Artificial Sequence
  Description of Artificial Sequence: Synthetic peptide
  XENP019485 vlCDR3
QQYGSSPWT

SEQ ID NO: 4989 - protein, 221 aa, Artificial Sequence; identical to SEQ ID NO: 2919
  Description of Artificial Sequence: Synthetic polypeptide
  XENP019486 [CTLA-4]_H0_L0.71_Fab Heavy Chain

SEQ ID NO: 4990 - protein, 118 aa, Artificial Sequence; identical to SEQ ID NO: 22
  Description of Artificial Sequence: Synthetic polypeptide
  VH of XENP019486

SEQ ID NO: 4991 - protein, 5 aa, Artificial Sequence
  Description of Artificial Sequence: Synthetic peptide
  XENP019486 vhCDR1
SYTMH

SEQ ID NO: 4992 - protein, 17 aa, Artificial Sequence
  Description of Artificial Sequence: Synthetic peptide
  XENP019486 vhCDR2
FISYDGNNKYYADSVKG

SEQ ID NO: 4993 - protein, 9 aa, Artificial Sequence
  Description of Artificial Sequence: Synthetic peptide
  XENP019486 vhCDR3
TGWLGPFDY

SEQ ID NO: 4994 - protein, 215 aa, Artificial Sequence
  Description of Artificial Sequence: Synthetic polypeptide
  XENP019486 [CTLA-4]_H0_L0.71_Fab Light Chain
EIVLTQSPGTLSLSPGERATLSCRASQSVGSSYLAWYQQKPGQAPRLLIYGAISRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4995 - protein, 108 aa, Artificial Sequence; identical to SEQ ID NO: 2048
  Description of Artificial Sequence: Synthetic polypeptide
  VL of XENP019486

SEQ ID NO: 4996 - protein, 12 aa, Artificial Sequence
  Description of Artificial Sequence: Synthetic peptide
  XENP019486 vlCDR1
RASQSVGSSYLA

SEQ ID NO: 4997 - protein, 7 aa, Artificial Sequence
  Description of Artificial Sequence: Synthetic peptide
  XENP019486 vlCDR2
GAISRAT

SEQ ID NO: 4998 - protein, 9 aa, Artificial Sequence
  Description of Artificial Sequence: Synthetic peptide
  XENP019486 vlCDR3
QQYGSSPWT

SEQ ID NO: 4999 - protein, 221 aa, Artificial Sequence; identical to SEQ ID NO: 2919
  Description of Artificial Sequence: Synthetic polypeptide
  XENP019487 [CTLA-4]_H0_L0.72_Fab Heavy Chain

SEQ ID NO: 5000 - protein, 118 aa, Artificial Sequence; identical to SEQ ID NO: 22
  Description of Artificial Sequence: Synthetic polypeptide
  VH of XENP019487

SEQ ID NO: 5001 - protein, 5 aa, Artificial Sequence
  Description of Artificial Sequence: Synthetic peptide
  XENP019487 vhCDR1
SYTMH

SEQ ID NO: 5002 - protein, 17 aa, Artificial Sequence
  Description of Artificial Sequence: Synthetic peptide
  XENP019487 vhCDR2
FISYDGNNKYYADSVKG

SEQ ID NO: 5003 - protein, 9 aa, Artificial Sequence
  Description of Artificial Sequence: Synthetic peptide
  XENP019487 vhCDR3
TGWLGPFDY

SEQ ID NO: 5004 - protein, 215 aa, Artificial Sequence
  Description of Artificial Sequence: Synthetic polypeptide
  XENP019487 [CTLA-4]_H0_L0.72_Fab Light Chain
EIVLTQSPGTLSLSPGERATLSCRASQSVGSSYLAWYQQKPGQAPRLLIYGALSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5005 - protein, 108 aa, Artificial Sequence; identical to SEQ ID NO: 2057
  Description of Artificial Sequence: Synthetic polypeptide
  VL of XENP019487

SEQ ID NO: 5006 - protein, 12 aa, Artificial Sequence
  Description of Artificial Sequence: Synthetic peptide
  XENP019487 vlCDR1
RASQSVGSSYLA

SEQ ID NO: 5007 - protein, 7 aa, Artificial Sequence
  Description of Artificial Sequence: Synthetic peptide
  XENP019487 vlCDR2
GALSRAT

SEQ ID NO: 5008 - protein, 9 aa, Artificial Sequence
  Description of Artificial Sequence: Synthetic peptide
  XENP019487 vlCDR3
QQYGSSPWT

SEQ ID NO: 5009 - protein, 221 aa, Artificial Sequence; identical to SEQ ID NO: 2919
  Description of Artificial Sequence: Synthetic polypeptide
  XENP019488 [CTLA-4]_H0_L0.73_Fab Heavy Chain

SEQ ID NO: 5010 - protein, 118 aa, Artificial Sequence; identical to SEQ ID NO: 22
  Description of Artificial Sequence: Synthetic polypeptide
  VH of XENP019488

SEQ ID NO: 5011 - protein, 5 aa, Artificial Sequence
  Description of Artificial Sequence: Synthetic peptide
  XENP019488 vhCDR1
SYTMH

SEQ ID NO: 5012 - protein, 17 aa, Artificial Sequence
  Description of Artificial Sequence: Synthetic peptide
  XENP019488 vhCDR2
FISYDGNNKYYADSVKG

SEQ ID NO: 5013 - protein, 9 aa, Artificial Sequence
  Description of Artificial Sequence: Synthetic peptide
  XENP019488 vhCDR3
TGWLGPFDY

SEQ ID NO: 5014 - protein, 215 aa, Artificial Sequence
  Description of Artificial Sequence: Synthetic polypeptide
  XENP019488 [CTLA-4]_H0_L0.73_Fab Light Chain
EIVLTQSPGTLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5015 - protein, 108 aa, Artificial Sequence; identical to SEQ ID NO: 2066
  Description of Artificial Sequence: Synthetic polypeptide
  VL of XENP019488

SEQ ID NO: 5016 - protein, 12 aa, Artificial Sequence
  Description of Artificial Sequence: Synthetic peptide
  XENP019488 vlCDR1
RASQSVGSSYLA

SEQ ID NO: 5017 - protein, 7 aa, Artificial Sequence
  Description of Artificial Sequence: Synthetic peptide
  XENP019488 vlCDR2
GASSRAT

SEQ ID NO: 5018 - protein, 9 aa, Artificial Sequence
  Description of Artificial Sequence: Synthetic peptide
  XENP019488 vlCDR3
QQYGSSPWT

SEQ ID NO: 5019 - protein, 221 aa, Artificial Sequence; identical to SEQ ID NO: 2919
  Description of Artificial Sequence: Synthetic polypeptide
  XENP019489 [CTLA-4]_H0_L0.74_Fab Heavy Chain

SEQ ID NO: 5020 - protein, 118 aa, Artificial Sequence; identical to SEQ ID NO: 22
  Description of Artificial Sequence: Synthetic polypeptide
  VH of XENP019489

SEQ ID NO: 5021 - protein, 5 aa, Artificial Sequence
  Description of Artificial Sequence: Synthetic peptide
  XENP019489 vhCDR1
SYTMH

SEQ ID NO: 5022 - protein, 17 aa, Artificial Sequence
  Description of Artificial Sequence: Synthetic peptide
  XENP019489 vhCDR2
FISYDGNNKYYADSVKG

SEQ ID NO: 5023 - protein, 9 aa, Artificial Sequence
  Description of Artificial Sequence: Synthetic peptide
  XENP019489 vhCDR3
TGWLGPFDY

SEQ ID NO: 5024 - protein, 215 aa, Artificial Sequence
  Description of Artificial Sequence: Synthetic polypeptide
  XENP019489 [CTLA-4]_H0_L0.74_Fab Light Chain
EIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5025 - protein, 108 aa, Artificial Sequence; identical to SEQ ID NO: 2075
  Description of Artificial Sequence: Synthetic polypeptide
  VL of XENP019489

SEQ ID NO: 5026 - protein, 12 aa, Artificial Sequence
  Description of Artificial Sequence: Synthetic peptide
  XENP019489 vlCDR1
RASQSVGSSYLA

SEQ ID NO: 5027 - protein, 7 aa, Artificial Sequence
  Description of Artificial Sequence: Synthetic peptide
  XENP019489 vlCDR2
GAYSRAT

SEQ ID NO: 5028 - protein, 9 aa, Artificial Sequence
  Description of Artificial Sequence: Synthetic peptide
  XENP019489 vlCDR3
QQYGSSPWT

SEQ ID NO: 5029 - protein, 221 aa, Artificial Sequence; identical to SEQ ID NO: 2919
  Description of Artificial Sequence: Synthetic polypeptide
  XENP019490 [CTLA-4]_H0_L0.75_Fab Heavy Chain

SEQ ID NO: 5030 - protein, 118 aa, Artificial Sequence; identical to SEQ ID NO: 22
  Description of Artificial Sequence: Synthetic polypeptide
  VH of XENP019490

SEQ ID NO: 5031 - protein, 5 aa, Artificial Sequence
  Description of Artificial Sequence: Synthetic peptide
  XENP019490 vhCDR1
SYTMH

SEQ ID NO: 5032 - protein, 17 aa, Artificial Sequence
  Description of Artificial Sequence: Synthetic peptide
  XENP019490 vhCDR2
FISYDGNNKYYADSVKG

SEQ ID NO: 5033 - protein, 9 aa, Artificial Sequence
  Description of Artificial Sequence: Synthetic peptide
  XENP019490 vhCDR3
TGWLGPFDY

SEQ ID NO: 5034 - protein, 215 aa, Artificial Sequence
  Description of Artificial Sequence: Synthetic polypeptide
  XENP019490 [CTLA-4]_H0_L0.75_Fab Light Chain
EIVLTQSPGTLSLSPGERATLSCRASQSVGSSYLAWYQQKPGQAPRLLIYGAFARATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5035 - protein, 108 aa, Artificial Sequence; identical to SEQ ID NO: 2084
  Description of Artificial Sequence: Synthetic polypeptide
  VL of XENP019490

SEQ ID NO: 5036 - protein, 12 aa, Artificial Sequence
  Description of Artificial Sequence: Synthetic peptide
  XENP019490 vlCDR1
RASQSVGSSYLA

SEQ ID NO: 5037 - protein, 7 aa, Artificial Sequence
  Description of Artificial Sequence: Synthetic peptide
  XENP019490 vlCDR2
GAFARAT

SEQ ID NO: 5038 - protein, 9 aa, Artificial Sequence
  Description of Artificial Sequence: Synthetic peptide
  XENP019490 vlCDR3
QQYGSSPWT

SEQ ID NO: 5039 - protein, 221 aa, Artificial Sequence; identical to SEQ ID NO: 2919
  Description of Artificial Sequence: Synthetic polypeptide
  XENP019491 [CTLA-4]_H0_L0.76_Fab Heavy Chain

SEQ ID NO: 5040 - protein, 118 aa, Artificial Sequence; identical to SEQ ID NO: 22
  Description of Artificial Sequence: Synthetic polypeptide
  VH of XENP019491

SEQ ID NO: 5041 - protein, 5 aa, Artificial Sequence
  Description of Artificial Sequence: Synthetic peptide
  XENP019491 vhCDR1
SYTMH

SEQ ID NO: 5042 - protein, 17 aa, Artificial Sequence
  Description of Artificial Sequence: Synthetic peptide
  XENP019491 vhCDR2
FISYDGNNKYYADSVKG

SEQ ID NO: 5043 - protein, 9 aa, Artificial Sequence
  Description of Artificial Sequence: Synthetic peptide
  XENP019491 vhCDR3
TGWLGPFDY

SEQ ID NO: 5044 - protein, 215 aa, Artificial Sequence
  Description of Artificial Sequence: Synthetic polypeptide
  XENP019491 [CTLA-4]_H0_L0.76_Fab Light Chain
EIVLTQSPGTLSLSPGERATLSCRASQSVGSSYLAWYQQKPGQAPRLLIYGAFGRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5045 - protein, 108 aa, Artificial Sequence; identical to SEQ ID NO: 2093
  Description of Artificial Sequence: Synthetic polypeptide
  VL of XENP019491

SEQ ID NO: 5046 - protein, 12 aa, Artificial Sequence
  Description of Artificial Sequence: Synthetic peptide
  XENP019491 vlCDR1
RASQSVGSSYLA

SEQ ID NO: 5047 - protein, 7 aa, Artificial Sequence
  Description of Artificial Sequence: Synthetic peptide
  XENP019491 vlCDR2
GAFGRAT

SEQ ID NO: 5048 - protein, 9 aa, Artificial Sequence
  Description of Artificial Sequence: Synthetic peptide
  XENP019491 vlCDR3
QQYGSSPWT

SEQ ID NO: 5049 - protein, 221 aa, Artificial Sequence; identical to SEQ ID NO: 2919
  Description of Artificial Sequence: Synthetic polypeptide
  XENP019492 [CTLA-4]_H0_L0.77_Fab Heavy Chain

SEQ ID NO: 5050 - protein, 118 aa, Artificial Sequence; identical to SEQ ID NO: 22
  Description of Artificial Sequence: Synthetic polypeptide
  VH of XENP019492

SEQ ID NO: 5051 - protein, 5 aa, Artificial Sequence
  Description of Artificial Sequence: Synthetic peptide
  XENP019492 vhCDR1
SYTMH

SEQ ID NO: 5052 - protein, 17 aa, Artificial Sequence
  Description of Artificial Sequence: Synthetic peptide
  XENP019492 vhCDR2
FISYDGNNKYYADSVKG

SEQ ID NO: 5053 - protein, 9 aa, Artificial Sequence
  Description of Artificial Sequence: Synthetic peptide
  XENP019492 vhCDR3
TGWLGPFDY

SEQ ID NO: 5054 - protein, 215 aa, Artificial Sequence
  Description of Artificial Sequence: Synthetic polypeptide
  XENP019492 [CTLA-4]_H0_L0.77_Fab Light Chain
EIVLTQSPGTLSLSPGERATLSCRASQSVGSSYLAWYQQKPGQAPRLLIYGAFNRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5055 - protein, 108 aa, Artificial Sequence; identical to SEQ ID NO: 2102
  Description of Artificial Sequence: Synthetic polypeptide
  VL of XENP019492

SEQ ID NO: 5056 - protein, 12 aa, Artificial Sequence
  Description of Artificial Sequence: Synthetic peptide
  XENP019492 vlCDR1
RASQSVGSSYLA

SEQ ID NO: 5057 - protein, 7 aa, Artificial Sequence
  Description of Artificial Sequence: Synthetic peptide
  XENP019492 vlCDR2
GAFNRAT

SEQ ID NO: 5058 - protein, 9 aa, Artificial Sequence
  Description of Artificial Sequence: Synthetic peptide
  XENP019492 vlCDR3
QQYGSSPWT

SEQ ID NO: 5059 - protein, 221 aa, Artificial Sequence; identical to SEQ ID NO: 2919
  Description of Artificial Sequence: Synthetic polypeptide
  XENP019493 [CTLA-4]_H0_L0.78_Fab Heavy Chain

SEQ ID NO: 5060 - protein, 118 aa, Artificial Sequence; identical to SEQ ID NO: 22
  Description of Artificial Sequence: Synthetic polypeptide
  VH of XENP019493

SEQ ID NO: 5061 - protein, 5 aa, Artificial Sequence
  Description of Artificial Sequence: Synthetic peptide
  XENP019493 vhCDR1
SYTMH

SEQ ID NO: 5062 - protein, 17 aa, Artificial Sequence
  Description of Artificial Sequence: Synthetic peptide
  XENP019493 vhCDR2
FISYDGNNKYYADSVKG

SEQ ID NO: 5063 - protein, 9 aa, Artificial Sequence
  Description of Artificial Sequence: Synthetic peptide
  XENP019493 vhCDR3
TGWLGPFDY

SEQ ID NO: 5064 - protein, 215 aa, Artificial Sequence
  Description of Artificial Sequence: Synthetic polypeptide
  XENP019493 [CTLA-4]_H0_L0.78_Fab Light Chain
EIVLTQSPGTLSLSPGERATLSCRASQSVGSSYLAWYQQKPGQAPRLLIYGAFQRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5065 - protein, 108 aa, Artificial Sequence; identical to SEQ ID NO: 2111
  Description of Artificial Sequence: Synthetic polypeptide
  VL of XENP019493

SEQ ID NO: 5066 - protein, 12 aa, Artificial Sequence
  Description of Artificial Sequence: Synthetic peptide
  XENP019493 vlCDR1
RASQSVGSSYLA

SEQ ID NO: 5067 - protein, 7 aa, Artificial Sequence
  Description of Artificial Sequence: Synthetic peptide
  XENP019493 vlCDR2
GAFQRAT

SEQ ID NO: 5068 - protein, 9 aa, Artificial Sequence
  Description of Artificial Sequence: Synthetic peptide
  XENP019493 vlCDR3
QQYGSSPWT

SEQ ID NO: 5069 - protein, 221 aa, Artificial Sequence; identical to SEQ ID NO: 2919
  Description of Artificial Sequence: Synthetic polypeptide
  XENP019494 [CTLA-4]_H0_L0.79_Fab Heavy Chain

SEQ ID NO: 5070 - protein, 118 aa, Artificial Sequence; identical to SEQ ID NO: 22
  Description of Artificial Sequence: Synthetic polypeptide
  VH of XENP019494

SEQ ID NO: 5071 - protein, 5 aa, Artificial Sequence
  Description of Artificial Sequence: Synthetic peptide
  XENP019494 vhCDR1
SYTMH

SEQ ID NO: 5072 - protein, 17 aa, Artificial Sequence
  Description of Artificial Sequence: Synthetic peptide
  XENP019494 vhCDR2
FISYDGNNKYYADSVKG

SEQ ID NO: 5073 - protein, 9 aa, Artificial Sequence
  Description of Artificial Sequence: Synthetic peptide
  XENP019494 vhCDR3
TGWLGPFDY

SEQ ID NO: 5074 - protein, 215 aa, Artificial Sequence
  Description of Artificial Sequence: Synthetic polypeptide
  XENP019494 [CTLA-4]_H0_L0.79_Fab Light Chain
EIVLTQSPGTLSLSPGERATLSCRASQSVGSSYLAWYQQKPGQAPRLLIYGAFTRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5075 - protein, 108 aa, Artificial Sequence; identical to SEQ ID NO: 2120
  Description of Artificial Sequence: Synthetic polypeptide
  VL of XENP019494

SEQ ID NO: 5076 - protein, 12 aa, Artificial Sequence
  Description of Artificial Sequence: Synthetic peptide
  XENP019494 vlCDR1
RASQSVGSSYLA

SEQ ID NO: 5077 - protein, 7 aa, Artificial Sequence
  Description of Artificial Sequence: Synthetic peptide
  XENP019494 vlCDR2
GAFTRAT

SEQ ID NO: 5078 - protein, 9 aa, Artificial Sequence
  Description of Artificial Sequence: Synthetic peptide
  XENP019494 vlCDR3
QQYGSSPWT

SEQ ID NO: 5079 - protein, 221 aa, Artificial Sequence; identical to SEQ ID NO: 2919
  Description of Artificial Sequence: Synthetic polypeptide
  XENP019495 [CTLA-4]_H0_L0.80_Fab Heavy Chain

SEQ ID NO: 5080 - protein, 118 aa, Artificial Sequence; identical to SEQ ID NO: 22
  Description of Artificial Sequence: Synthetic polypeptide
  VH of XENP019495

SEQ ID NO: 5081 - protein, 5 aa, Artificial Sequence
  Description of Artificial Sequence: Synthetic peptide
  XENP019495 vhCDR1
SYTMH

SEQ ID NO: 5082 - protein, 17 aa, Artificial Sequence
  Description of Artificial Sequence: Synthetic peptide
  XENP019495 vhCDR2
FISYDGNNKYYADSVKG

SEQ ID NO: 5083 - protein, 9 aa, Artificial Sequence
  Description of Artificial Sequence: Synthetic peptide
  XENP019495 vhCDR3
TGWLGPFDY

SEQ ID NO: 5084 - protein, 215 aa, Artificial Sequence
  Description of Artificial Sequence: Synthetic polypeptide
  XENP019495 [CTLA-4]_H0_L0.80_Fab Light Chain
EIVLTQSPGTLSLSPGERATLSCRASQSVGSSYLAWYQQKPGQAPRLLIYGAFSRDTGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5085 - protein, 108 aa, Artificial Sequence; identical to SEQ ID NO: 2129
  Description of Artificial Sequence: Synthetic polypeptide
  VL of XENP019495

SEQ ID NO: 5086 - protein, 12 aa, Artificial Sequence
  Description of Artificial Sequence: Synthetic peptide
  XENP019495 vlCDR1
RASQSVGSSYLA

SEQ ID NO: 5087 - protein, 7 aa, Artificial Sequence
  Description of Artificial Sequence: Synthetic peptide
  XENP019495 vlCDR2
GAFSRDT

SEQ ID NO: 5088 - protein, 9 aa, Artificial Sequence
  Description of Artificial Sequence: Synthetic peptide
  XENP019495 vlCDR3
QQYGSSPWT

SEQ ID NO: 5089 - protein, 221 aa, Artificial Sequence; identical to SEQ ID NO: 2919
  Description of Artificial Sequence: Synthetic polypeptide
  XENP019496 [CTLA-4]_H0_L0.81_Fab Heavy Chain

SEQ ID NO: 5090 - protein, 118 aa, Artificial Sequence; identical to SEQ ID NO: 22
  Description of Artificial Sequence: Synthetic polypeptide
  VH of XENP019496

SEQ ID NO: 5091 - protein, 5 aa, Artificial Sequence
  Description of Artificial Sequence: Synthetic peptide
  XENP019496 vhCDR1
SYTMH

SEQ ID NO: 5092 - protein, 17 aa, Artificial Sequence
  Description of Artificial Sequence: Synthetic peptide
  XENP019496 vhCDR2
FISYDGNNKYYADSVKG

SEQ ID NO: 5093 - protein, 9 aa, Artificial Sequence
  Description of Artificial Sequence: Synthetic peptide
  XENP019496 vhCDR3
TGWLGPFDY

SEQ ID NO: 5094 - protein, 215 aa, Artificial Sequence
  Description of Artificial Sequence: Synthetic polypeptide
  XENP019496 [CTLA-4]_H0_L0.81_Fab Light Chain
EIVLTQSPGTLSLSPGERATLSCRASQSVGSSYLAWYQQKPGQAPRLLIYGAFSRASGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5095 - protein, 108 aa, Artificial Sequence; identical to SEQ ID NO: 2138
  Description of Artificial Sequence: Synthetic polypeptide
  VL of XENP019496

SEQ ID NO: 5096 - protein, 12 aa, Artificial Sequence
  Description of Artificial Sequence: Synthetic peptide
  XENP019496 vlCDR1
RASQSVGSSYLA

SEQ ID NO: 5097 - protein, 7 aa, Artificial Sequence
  Description of Artificial Sequence: Synthetic peptide
  XENP019496 vlCDR2
GAFSRAS

SEQ ID NO: 5098 - protein, 9 aa, Artificial Sequence
  Description of Artificial Sequence: Synthetic peptide
  XENP019496 vlCDR3
QQYGSSPWT

SEQ ID NO: 5099 - protein, 221 aa, Artificial Sequence; identical to SEQ ID NO: 2919
  Description of Artificial Sequence: Synthetic polypeptide
  XENP019501 [CTLA-4]_H0_L0.82_Fab Heavy Chain

SEQ ID NO: 5100 - protein, 118 aa, Artificial Sequence; identical to SEQ ID NO: 22
  Description of Artificial Sequence: Synthetic polypeptide
  VH of XENP019501

SEQ ID NO: 5101 - protein, 5 aa, Artificial Sequence
  Description of Artificial Sequence: Synthetic peptide
  XENP019501 vhCDR1
SYTMH

SEQ ID NO: 5102 - protein, 17 aa, Artificial Sequence
  Description of Artificial Sequence: Synthetic peptide
  XENP019501 vhCDR2
FISYDGNNKYYADSVKG

SEQ ID NO: 5103 - protein, 9 aa, Artificial Sequence
  Description of Artificial Sequence: Synthetic peptide
  XENP019501 vhCDR3
TGWLGPFDY

SEQ ID NO: 5104 - protein, 215 aa, Artificial Sequence
  Description of Artificial Sequence: Synthetic polypeptide
  XENP019501 [CTLA-4]_H0_L0.82_Fab Light Chain
EIVLTQSPGTLSLSPGERATLSCRASQSVGSSYLAWYQQKPGQAPRLLIYGAFSRATGVPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5105 - protein, 108 aa, Artificial Sequence; identical to SEQ ID NO: 2147
  Description of Artificial Sequence: Synthetic polypeptide
  VL of XENP019501

SEQ ID NO: 5106 - protein, 12 aa, Artificial Sequence
  Description of Artificial Sequence: Synthetic peptide
  XENP019501 vlCDR1
RASQSVGSSYLA

SEQ ID NO: 5107 - protein, 7 aa, Artificial Sequence
  Description of Artificial Sequence: Synthetic peptide
  XENP019501 vlCDR2
GAFSRAT

SEQ ID NO: 5108 - protein, 9 aa, Artificial Sequence
  Description of Artificial Sequence: Synthetic peptide
  XENP019501 vlCDR3
QQYGSSPWT

SEQ ID NO: 5109 - protein, 221 aa, Artificial Sequence; identical to SEQ ID NO: 2919
  Description of Artificial Sequence: Synthetic polypeptide
  XENP019502 [CTLA-4]_H0_L0.83_Fab Heavy Chain

SEQ ID NO: 5110 - protein, 118 aa, Artificial Sequence; identical to SEQ ID NO: 22
  Description of Artificial Sequence: Synthetic polypeptide
  VH of XENP019502

SEQ ID NO: 5111 - protein, 5 aa, Artificial Sequence
  Description of Artificial Sequence: Synthetic peptide
  XENP019502 vhCDR1
SYTMH

SEQ ID NO: 5112 - protein, 17 aa, Artificial Sequence
  Description of Artificial Sequence: Synthetic peptide
  XENP019502 vhCDR2
FISYDGNNKYYADSVKG

SEQ ID NO: 5113 - protein, 9 aa, Artificial Sequence
  Description of Artificial Sequence: Synthetic peptide
  XENP019502 vhCDR3
TGWLGPFDY

SEQ ID NO: 5114 - protein, 215 aa, Artificial Sequence
  Description of Artificial Sequence: Synthetic polypeptide
  XENP019502 [CTLA-4]_H0_L0.83_Fab Light Chain
EIVLTQSPGTLSLSPGERATLSCRASQSVGSSYLAWYQQKPGQAPRLLIYGAFSRATGIPARFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5115 - protein, 108 aa, Artificial Sequence; identical to SEQ ID NO: 2156
  Description of Artificial Sequence: Synthetic polypeptide
  VL of XENP019502

SEQ ID NO: 5116 - protein, 12 aa, Artificial Sequence
  Description of Artificial Sequence: Synthetic peptide
  XENP019502 vlCDR1
RASQSVGSSYLA

SEQ ID NO: 5117 - protein, 7 aa, Artificial Sequence
  Description of Artificial Sequence: Synthetic peptide
  XENP019502 vlCDR2
GAFSRAT

SEQ ID NO: 5118 - protein, 9 aa, Artificial Sequence
  Description of Artificial Sequence: Synthetic peptide
  XENP019502 vlCDR3
QQYGSSPWT

SEQ ID NO: 5119 - protein, 221 aa, Artificial Sequence; identical to SEQ ID NO: 2919
  Description of Artificial Sequence: Synthetic polypeptide
  XENP019503 [CTLA-4]_H0_L0.84_Fab Heavy Chain

SEQ ID NO: 5120 - protein, 118 aa, Artificial Sequence; identical to SEQ ID NO: 22
  Description of Artificial Sequence: Synthetic polypeptide
  VH of XENP019503

SEQ ID NO: 5121 - protein, 5 aa, Artificial Sequence
  Description of Artificial Sequence: Synthetic peptide
  XENP019503 vhCDR1
SYTMH

SEQ ID NO: 5122 - protein, 17 aa, Artificial Sequence
  Description of Artificial Sequence: Synthetic peptide
  XENP019503 vhCDR2
FISYDGNNKYYADSVKG

SEQ ID NO: 5123 - protein, 9 aa, Artificial Sequence
  Description of Artificial Sequence: Synthetic peptide
  XENP019503 vhCDR3
TGWLGPFDY

SEQ ID NO: 5124 - protein, 215 aa, Artificial Sequence
  Description of Artificial Sequence: Synthetic polypeptide
  XENP019503 [CTLA-4]_H0_L0.84_Fab Light Chain
EIVLTQSPGTLSLSPGERATLSCRASQSVGSSYLAWYQQKPGQAPRLLIYGAFSRATGIPDRFSGSGSRTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5125 - protein, 108 aa, Artificial Sequence; identical to SEQ ID NO: 2165
  Description of Artificial Sequence: Synthetic polypeptide
  VL of XENP019503

SEQ ID NO: 5126 - protein, 12 aa, Artificial Sequence
  Description of Artificial Sequence: Synthetic peptide
  XENP019503 vlCDR1
RASQSVGSSYLA

SEQ ID NO: 5127 - protein, 7 aa, Artificial Sequence
  Description of Artificial Sequence: Synthetic peptide
  XENP019503 vlCDR2
GAFSRAT

SEQ ID NO: 5128 - protein, 9 aa, Artificial Sequence
  Description of Artificial Sequence: Synthetic peptide
  XENP019503 vlCDR3
QQYGSSPWT

SEQ ID NO: 5129 - protein, 221 aa, Artificial Sequence; identical to SEQ ID NO: 2919
  Description of Artificial Sequence: Synthetic polypeptide
  XENP019504 [CTLA-4]_H0_L0.85_Fab Heavy Chain

SEQ ID NO: 5130 - protein, 118 aa, Artificial Sequence; identical to SEQ ID NO: 22
  Description of Artificial Sequence: Synthetic polypeptide
  VH of XENP019504

SEQ ID NO: 5131 - protein, 5 aa, Artificial Sequence
  Description of Artificial Sequence: Synthetic peptide
  XENP019504 vhCDR1
SYTMH

SEQ ID NO: 5132 - protein, 17 aa, Artificial Sequence
  Description of Artificial Sequence: Synthetic peptide
  XENP019504 vhCDR2
FISYDGNNKYYADSVKG

SEQ ID NO: 5133 - protein, 9 aa, Artificial Sequence
  Description of Artificial Sequence: Synthetic peptide
  XENP019504 vhCDR3
TGWLGPFDY

SEQ ID NO: 5134 - protein, 215 aa, Artificial Sequence
  Description of Artificial Sequence: Synthetic polypeptide
  XENP019504 [CTLA-4]_H0_L0.85_Fab Light Chain
EIVLTQSPGTLSLSPGERATLSCRASQSVGSSYLAWYQQKPGQAPRLLIYGAFSRATGIPDRFSGSGSGTEFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5135 - protein, 108 aa, Artificial Sequence; identical to SEQ ID NO: 2174
  Description of Artificial Sequence: Synthetic polypeptide
  VL of XENP019504

SEQ ID NO: 5136 - protein, 12 aa, Artificial Sequence
  Description of Artificial Sequence: Synthetic peptide
  XENP019504 vlCDR1
RASQSVGSSYLA

SEQ ID NO: 5137 - protein, 7 aa, Artificial Sequence
  Description of Artificial Sequence: Synthetic peptide
  XENP019504 vlCDR2
GAFSRAT

SEQ ID NO: 5138 - protein, 9 aa, Artificial Sequence
  Description of Artificial Sequence: Synthetic peptide
  XENP019504 vlCDR3
QQYGSSPWT

SEQ ID NO: 5139 - protein, 221 aa, Artificial Sequence; identical to SEQ ID NO: 2919
  Description of Artificial Sequence: Synthetic polypeptide
  XENP019505 [CTLA-4]_H0_L0.86_Fab Heavy Chain

SEQ ID NO: 5140 - protein, 118 aa, Artificial Sequence; identical to SEQ ID NO: 22
  Description of Artificial Sequence: Synthetic polypeptide
  VH of XENP019505

SEQ ID NO: 5141 - protein, 5 aa, Artificial Sequence
  Description of Artificial Sequence: Synthetic peptide
  XENP019505 vhCDR1
SYTMH

SEQ ID NO: 5142 - protein, 17 aa, Artificial Sequence
  Description of Artificial Sequence: Synthetic peptide
  XENP019505 vhCDR2
FISYDGNNKYYADSVKG

SEQ ID NO: 5143 - protein, 9 aa, Artificial Sequence
  Description of Artificial Sequence: Synthetic peptide
  XENP019505 vhCDR3
TGWLGPFDY

SEQ ID NO: 5144 - protein, 215 aa, Artificial Sequence
  Description of Artificial Sequence: Synthetic polypeptide
  XENP019505 [CTLA-4]_H0_L0.86_Fab Light Chain
EIVLTQSPGTLSLSPGERATLSCRASQSVGSSYLAWYQQKPGQAPRLLIYGAFSRATGIPDRFSGSGSGTDFTLKISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5145 - protein, 108 aa, Artificial Sequence; identical to SEQ ID NO: 2183
  Description of Artificial Sequence: Synthetic polypeptide
  VL of XENP019505

SEQ ID NO: 5146 - protein, 12 aa, Artificial Sequence
  Description of Artificial Sequence: Synthetic peptide
  XENP019505 vlCDR1
RASQSVGSSYLA

SEQ ID NO: 5147 - protein, 7 aa, Artificial Sequence
  Description of Artificial Sequence: Synthetic peptide
  XENP019505 vlCDR2
GAFSRAT

SEQ ID NO: 5148 - protein, 9 aa, Artificial Sequence
  Description of Artificial Sequence: Synthetic peptide
  XENP019505 vlCDR3
QQYGSSPWT

SEQ ID NO: 5149 - protein, 221 aa, Artificial Sequence; identical to SEQ ID NO: 2919
  Description of Artificial Sequence: Synthetic polypeptide
  XENP019506 [CTLA-4]_H0_L0.87_Fab Heavy Chain

SEQ ID NO: 5150 - protein, 118 aa, Artificial Sequence; identical to SEQ ID NO: 22
  Description of Artificial Sequence: Synthetic polypeptide
  VH of XENP019506

SEQ ID NO: 5151 - protein, 5 aa, Artificial Sequence
  Description of Artificial Sequence: Synthetic peptide
  XENP019506 vhCDR1
SYTMH

SEQ ID NO: 5152 - protein, 17 aa, Artificial Sequence
  Description of Artificial Sequence: Synthetic peptide
  XENP019506 vhCDR2
FISYDGNNKYYADSVKG

SEQ ID NO: 5153 - protein, 9 aa, Artificial Sequence
  Description of Artificial Sequence: Synthetic peptide
  XENP019506 vhCDR3
TGWLGPFDY

SEQ ID NO: 5154 - protein, 215 aa, Artificial Sequence
  Description of Artificial Sequence: Synthetic polypeptide
  XENP019506 [CTLA-4]_H0_L0.87_Fab Light Chain
EIVLTQSPGTLSLSPGERATLSCRASQSVGSSYLAWYQQKPGQAPRLLIYGAFSRATGIPDRFSGSGSGTDFTLTISSLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5155 - protein, 108 aa, Artificial Sequence; identical to SEQ ID NO: 2192
  Description of Artificial Sequence: Synthetic polypeptide
  VL of XENP019506

SEQ ID NO: 5156 - protein, 12 aa, Artificial Sequence
  Description of Artificial Sequence: Synthetic peptide
  XENP019506 vlCDR1
RASQSVGSSYLA

SEQ ID NO: 5157 - protein, 7 aa, Artificial Sequence
  Description of Artificial Sequence: Synthetic peptide
  XENP019506 vlCDR2
GAFSRAT

SEQ ID NO: 5158 - protein, 9 aa, Artificial Sequence
  Description of Artificial Sequence: Synthetic peptide
  XENP019506 vlCDR3
QQYGSSPWT

SEQ ID NO: 5159 - protein, 221 aa, Artificial Sequence; identical to SEQ ID NO: 2919
  Description of Artificial Sequence: Synthetic polypeptide
  XENP019507 [CTLA-4]_H0_L0.88_Fab Heavy Chain

SEQ ID NO: 5160 - protein, 118 aa, Artificial Sequence; identical to SEQ ID NO: 22
  Description of Artificial Sequence: Synthetic polypeptide
  VH of XENP019507

SEQ ID NO: 5161 - protein, 5 aa, Artificial Sequence
  Description of Artificial Sequence: Synthetic peptide
  XENP019507 vhCDR1
SYTMH

SEQ ID NO: 5162 - protein, 17 aa, Artificial Sequence
  Description of Artificial Sequence: Synthetic peptide
  XENP019507 vhCDR2
FISYDGNNKYYADSVKG

SEQ ID NO: 5163 - protein, 9 aa, Artificial Sequence
  Description of Artificial Sequence: Synthetic peptide
  XENP019507 vhCDR3
TGWLGPFDY

SEQ ID NO: 5164 - protein, 215 aa, Artificial Sequence
  Description of Artificial Sequence: Synthetic polypeptide
  XENP019507 [CTLA-4]_H0_L0.88_Fab Light Chain
EIVLTQSPGTLSLSPGERATLSCRASQSVGSSYLAWYQQKPGQAPRLLIYGAFSRATGIPDRFSGSGSGTDFTLTISSLQSEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5165 - protein, 108 aa, Artificial Sequence; identical to SEQ ID NO: 2201
  Description of Artificial Sequence: Synthetic polypeptide
  VL of XENP019507

SEQ ID NO: 5166 - protein, 12 aa, Artificial Sequence
  Description of Artificial Sequence: Synthetic peptide
  XENP019507 vlCDR1
RASQSVGSSYLA

SEQ ID NO: 5167 - protein, 7 aa, Artificial Sequence
  Description of Artificial Sequence: Synthetic peptide
  XENP019507 vlCDR2
GAFSRAT

SEQ ID NO: 5168 - protein, 9 aa, Artificial Sequence
  Description of Artificial Sequence: Synthetic peptide
  XENP019507 vlCDR3
QQYGSSPWT

SEQ ID NO: 5169 - protein, 221 aa, Artificial Sequence; identical to SEQ ID NO: 2919
  Description of Artificial Sequence: Synthetic polypeptide
  XENP019508 [CTLA-4]_H0_L0.89_Fab Heavy Chain

SEQ ID NO: 5170 - protein, 118 aa, Artificial Sequence; identical to SEQ ID NO: 22
  Description of Artificial Sequence: Synthetic polypeptide
  VH of XENP019508

SEQ ID NO: 5171 - protein, 5 aa, Artificial Sequence
  Description of Artificial Sequence: Synthetic peptide
  XENP019508 vhCDR1
SYTMH

SEQ ID NO: 5172 - protein, 17 aa, Artificial Sequence
  Description of Artificial Sequence: Synthetic peptide
  XENP019508 vhCDR2
FISYDGNNKYYADSVKG

SEQ ID NO: 5173 - protein, 9 aa, Artificial Sequence
  Description of Artificial Sequence: Synthetic peptide
  XENP019508 vhCDR3
TGWLGPFDY

SEQ ID NO: 5174 - protein, 215 aa, Artificial Sequence
  Description of Artificial Sequence: Synthetic polypeptide
  XENP019508 [CTLA-4]_H0_L0.89_Fab Light Chain
EIVLTQSPGTLSLSPGERATLSCRASQSVGSSYLAWYQQKPGQAPRLLIYGAFSRATGIPDRFSGSGSGTDFTLTISRVEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5175 - protein, 108 aa, Artificial Sequence; identical to SEQ ID NO: 2210
  Description of Artificial Sequence: Synthetic polypeptide
  VL of XENP019508

SEQ ID NO: 5176 - protein, 12 aa, Artificial Sequence
  Description of Artificial Sequence: Synthetic peptide
  XENP019508 vlCDR1
RASQSVGSSYLA

SEQ ID NO: 5177 - protein, 7 aa, Artificial Sequence
  Description of Artificial Sequence: Synthetic peptide
  XENP019508 vlCDR2
GAFSRAT

SEQ ID NO: 5178 - protein, 9 aa, Artificial Sequence
  Description of Artificial Sequence: Synthetic peptide
  XENP019508 vlCDR3
QQYGSSPWT

SEQ ID NO: 5179 - protein, 221 aa, Artificial Sequence; identical to SEQ ID NO: 2919
  Description of Artificial Sequence: Synthetic polypeptide
  XENP019509 [CTLA-4]_H0_L0.90_Fab Heavy Chain

SEQ ID NO: 5180 - protein, 118 aa, Artificial Sequence; identical to SEQ ID NO: 22
  Description of Artificial Sequence: Synthetic polypeptide
  VH of XENP019509

SEQ ID NO: 5181 - protein, 5 aa, Artificial Sequence
  Description of Artificial Sequence: Synthetic peptide
  XENP019509 vhCDR1
SYTMH

SEQ ID NO: 5182 - protein, 17 aa, Artificial Sequence
  Description of Artificial Sequence: Synthetic peptide
  XENP019509 vhCDR2
FISYDGNNKYYADSVKG

SEQ ID NO: 5183 - protein, 9 aa, Artificial Sequence
  Description of Artificial Sequence: Synthetic peptide
  XENP019509 vhCDR3
TGWLGPFDY

SEQ ID NO: 5184 - protein, 215 aa, Artificial Sequence
  Description of Artificial Sequence: Synthetic polypeptide
  XENP019509 [CTLA-4]_H0_L0.90_Fab Light Chain
EIVLTQSPGTLSLSPGERATLSCRASQSVGSSYLAWYQQKPGQAPRLLIYGAFSRATGIPDRFSGSGSGTDFTLTISRLQPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5185 - protein, 108 aa, Artificial Sequence; identical to SEQ ID NO: 2219
  Description of Artificial Sequence: Synthetic polypeptide
  VL of XENP019509

SEQ ID NO: 5186 - protein, 12 aa, Artificial Sequence
  Description of Artificial Sequence: Synthetic peptide
  XENP019509 vlCDR1
RASQSVGSSYLA

SEQ ID NO: 5187 - protein, 7 aa, Artificial Sequence
  Description of Artificial Sequence: Synthetic peptide
  XENP019509 vlCDR2
GAFSRAT

SEQ ID NO: 5188 - protein, 9 aa, Artificial Sequence
  Description of Artificial Sequence: Synthetic peptide
  XENP019509 vlCDR3
QQYGSSPWT

SEQ ID NO: 5189 - protein, 221 aa, Artificial Sequence; identical to SEQ ID NO: 2919
  Description of Artificial Sequence: Synthetic polypeptide
  XENP019510 [CTLA-4]_H0_L0.91_Fab Heavy Chain

SEQ ID NO: 5190 - protein, 118 aa, Artificial Sequence; identical to SEQ ID NO: 22
  Description of Artificial Sequence: Synthetic polypeptide
  VH of XENP019510

SEQ ID NO: 5191 - protein, 5 aa, Artificial Sequence
  Description of Artificial Sequence: Synthetic peptide
  XENP019510 vhCDR1
SYTMH

SEQ ID NO: 5192 - protein, 17 aa, Artificial Sequence
  Description of Artificial Sequence: Synthetic peptide
  XENP019510 vhCDR2
FISYDGNNKYYADSVKG

SEQ ID NO: 5193 - protein, 9 aa, Artificial Sequence
  Description of Artificial Sequence: Synthetic peptide
  XENP019510 vhCDR3
TGWLGPFDY

SEQ ID NO: 5194 - protein, 215 aa, Artificial Sequence
  Description of Artificial Sequence: Synthetic polypeptide
  XENP019510 [CTLA-4]_H0_L0.91_Fab Light Chain
EIVLTQSPGTLSLSPGERATLSCRASQSVGSSYLAWYQQKPGQAPRLLIYGAFSRATGIPDRFSGSGSGTDFTLTISRLESEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5195 - protein, 108 aa, Artificial Sequence; identical to SEQ ID NO: 2228
  Description of Artificial Sequence: Synthetic polypeptide
  VL of XENP019510

SEQ ID NO: 5196 - protein, 12 aa, Artificial Sequence
  Description of Artificial Sequence: Synthetic peptide
  XENP019510 vlCDR1
RASQSVGSSYLA

SEQ ID NO: 5197 - protein, 7 aa, Artificial Sequence
  Description of Artificial Sequence: Synthetic peptide
  XENP019510 vlCDR2
GAFSRAT

SEQ ID NO: 5198 - protein, 9 aa, Artificial Sequence
  Description of Artificial Sequence: Synthetic peptide
  XENP019510 vlCDR3
QQYGSSPWT

SEQ ID NO: 5199 - protein, 221 aa, Artificial Sequence; identical to SEQ ID NO: 2919
  Description of Artificial Sequence: Synthetic polypeptide
  XENP019511 [CTLA-4]_H0_L0.92_Fab Heavy Chain

SEQ ID NO: 5200 - protein, 118 aa, Artificial Sequence; identical to SEQ ID NO: 22
  Description of Artificial Sequence: Synthetic polypeptide
  VH of XENP019511

SEQ ID NO: 5201 - protein, 5 aa, Artificial Sequence
  Description of Artificial Sequence: Synthetic peptide
  XENP019511 vhCDR1
SYTMH

SEQ ID NO: 5202 - protein, 17 aa, Artificial Sequence
  Description of Artificial Sequence: Synthetic peptide
  XENP019511 vhCDR2
FISYDGNNKYYADSVKG

SEQ ID NO: 5203 - protein, 9 aa, Artificial Sequence
  Description of Artificial Sequence: Synthetic peptide
  XENP019511 vhCDR3
TGWLGPFDY

SEQ ID NO: 5204 - protein, 215 aa, Artificial Sequence
  Description of Artificial Sequence: Synthetic polypeptide
  XENP019511 [CTLA-4]_H0_L0.92_Fab Light Chain
EIVLTQSPGTLSLSPGERATLSCRASQSVGSSYLAWYQQKPGQAPRLLIYGAFSRATGIPDRFSGSGSGTDFTLTISRLEPQDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5205 - protein, 108 aa, Artificial Sequence; identical to SEQ ID NO: 2237
  Description of Artificial Sequence: Synthetic polypeptide
  VL of XENP019511

SEQ ID NO: 5206 - protein, 12 aa, Artificial Sequence
  Description of Artificial Sequence: Synthetic peptide
  XENP019511 vlCDR1
RASQSVGSSYLA

SEQ ID NO: 5207 - protein, 7 aa, Artificial Sequence
  Description of Artificial Sequence: Synthetic peptide
  XENP019511 vlCDR2
GAFSRAT

SEQ ID NO: 5208 - protein, 9 aa, Artificial Sequence
  Description of Artificial Sequence: Synthetic peptide
  XENP019511 vlCDR3
QQYGSSPWT

SEQ ID NO: 5209 - protein, 221 aa, Artificial Sequence; identical to SEQ ID NO: 2919
  Description of Artificial Sequence: Synthetic polypeptide
  XENP019512 [CTLA-4]_H0_L0.93_Fab Heavy Chain

SEQ ID NO: 5210 - protein, 118 aa, Artificial Sequence; identical to SEQ ID NO: 22
  Description of Artificial Sequence: Synthetic polypeptide
  VH of XENP019512

SEQ ID NO: 5211 - protein, 5 aa, Artificial Sequence
  Description of Artificial Sequence: Synthetic peptide
  XENP019512 vhCDR1
SYTMH

SEQ ID NO: 5212 - protein, 17 aa, Artificial Sequence
  Description of Artificial Sequence: Synthetic peptide
  XENP019512 vhCDR2
FISYDGNNKYYADSVKG

SEQ ID NO: 5213 - protein, 9 aa, Artificial Sequence
  Description of Artificial Sequence: Synthetic peptide
  XENP019512 vhCDR3
TGWLGPFDY

SEQ ID NO: 5214 - protein, 215 aa, Artificial Sequence
  Description of Artificial Sequence: Synthetic polypeptide
  XENP019512 [CTLA-4]_H0_L0.93_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCKQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5215 - protein, 108 aa, Artificial Sequence; identical to SEQ ID NO: 2246
  Description of Artificial Sequence: Synthetic polypeptide
  VL of XENP019512

SEQ ID NO: 5216 - protein, 12 aa, Artificial Sequence
  Description of Artificial Sequence: Synthetic peptide
  XENP019512 vlCDR1
RASQSVGSSYLA

SEQ ID NO: 5217 - protein, 7 aa, Artificial Sequence
  Description of Artificial Sequence: Synthetic peptide
  XENP019512 vlCDR2
GAFSRAT

SEQ ID NO: 5218 - protein, 9 aa, Artificial Sequence
  Description of Artificial Sequence: Synthetic peptide
  XENP019512 vlCDR3
KQYGSSPWT

SEQ ID NO: 5219 - protein, 221 aa, Artificial Sequence; identical to SEQ ID NO: 2919
  Description of Artificial Sequence: Synthetic polypeptide
  XENP019513 [CTLA-4]_H0_L0.94_Fab Heavy Chain

SEQ ID NO: 5220 - protein, 118 aa, Artificial Sequence; identical to SEQ ID NO: 22
  Description of Artificial Sequence: Synthetic polypeptide
  VH of XENP019513

SEQ ID NO: 5221 - protein, 5 aa, Artificial Sequence
  Description of Artificial Sequence: Synthetic peptide
  XENP019513 vhCDR1
SYTMH

SEQ ID NO: 5222 - protein, 17 aa, Artificial Sequence
  Description of Artificial Sequence: Synthetic peptide
  XENP019513 vhCDR2
FISYDGNNKYYADSVKG

SEQ ID NO: 5223 - protein, 9 aa, Artificial Sequence
  Description of Artificial Sequence: Synthetic peptide
  XENP019513 vhCDR3
TGWLGPFDY

SEQ ID NO: 5224 - protein, 215 aa, Artificial Sequence
  Description of Artificial Sequence: Synthetic polypeptide
  XENP019513 [CTLA-4]_H0_L0.94_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCLQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5225 - protein, 108 aa, Artificial Sequence; identical to SEQ ID NO: 2255
  Description of Artificial Sequence: Synthetic polypeptide
  VL of XENP019513

SEQ ID NO: 5226 - protein, 12 aa, Artificial Sequence
  Description of Artificial Sequence: Synthetic peptide
  XENP019513 vlCDR1
RASQSVGSSYLA

SEQ ID NO: 5227 - protein, 7 aa, Artificial Sequence
  Description of Artificial Sequence: Synthetic peptide
  XENP019513 vlCDR2
GAFSRAT

SEQ ID NO: 5228 - protein, 9 aa, Artificial Sequence
  Description of Artificial Sequence: Synthetic peptide
  XENP019513 vlCDR3
LQYGSSPWT

SEQ ID NO: 5229 - protein, 221 aa, Artificial Sequence; identical to SEQ ID NO: 2919
  Description of Artificial Sequence: Synthetic polypeptide
  XENP019514 [CTLA-4]_H0_L0.95_Fab Heavy Chain

SEQ ID NO: 5230 - protein, 118 aa, Artificial Sequence; identical to SEQ ID NO: 22
  Description of Artificial Sequence: Synthetic polypeptide
  VH of XENP019514

SEQ ID NO: 5231 - protein, 5 aa, Artificial Sequence
  Description of Artificial Sequence: Synthetic peptide
  XENP019514 vhCDR1
SYTMH

SEQ ID NO: 5232 - protein, 17 aa, Artificial Sequence
  Description of Artificial Sequence: Synthetic peptide
  XENP019514 vhCDR2
FISYDGNNKYYADSVKG

SEQ ID NO: 5233 - protein, 9 aa, Artificial Sequence
  Description of Artificial Sequence: Synthetic peptide
  XENP019514 vhCDR3
TGWLGPFDY

SEQ ID NO: 5234 - protein, 215 aa, Artificial Sequence
  Description of Artificial Sequence: Synthetic polypeptide
  XENP019514 [CTLA-4]_H0_L0.95_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCMQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5235 - protein, 108 aa, Artificial Sequence; identical to SEQ ID NO: 2264
  Description of Artificial Sequence: Synthetic polypeptide
  VL of XENP019514

SEQ ID NO: 5236 - protein, 12 aa, Artificial Sequence
  Description of Artificial Sequence: Synthetic peptide
  XENP019514 vlCDR1
RASQSVGSSYLA

SEQ ID NO: 5237 - protein, 7 aa, Artificial Sequence
  Description of Artificial Sequence: Synthetic peptide
  XENP019514 vlCDR2
GAFSRAT

SEQ ID NO: 5238 - protein, 9 aa, Artificial Sequence
  Description of Artificial Sequence: Synthetic peptide
  XENP019514 vlCDR3
MQYGSSPWT

SEQ ID NO: 5239 - protein, 221 aa, Artificial Sequence; identical to SEQ ID NO: 2919
  Description of Artificial Sequence: Synthetic polypeptide
  XENP019515 [CTLA-4]_H0_L0.96_Fab Heavy Chain

SEQ ID NO: 5240 - protein, 118 aa, Artificial Sequence; identical to SEQ ID NO: 22
  Description of Artificial Sequence: Synthetic polypeptide
  VH of XENP019515

SEQ ID NO: 5241 - protein, 5 aa, Artificial Sequence
  Description of Artificial Sequence: Synthetic peptide
  XENP019515 vhCDR1
SYTMH

SEQ ID NO: 5242 - protein, 17 aa, Artificial Sequence
  Description of Artificial Sequence: Synthetic peptide
  XENP019515 vhCDR2
FISYDGNNKYYADSVKG

SEQ ID NO: 5243 - protein, 9 aa, Artificial Sequence
  Description of Artificial Sequence: Synthetic peptide
  XENP019515 vhCDR3
TGWLGPFDY

SEQ ID NO: 5244 - protein, 215 aa, Artificial Sequence
  Description of Artificial Sequence: Synthetic polypeptide
  XENP019515 [CTLA-4]_H0_L0.96_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQSYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5245 - protein, 108 aa, Artificial Sequence; identical to SEQ ID NO: 2273
  Description of Artificial Sequence: Synthetic polypeptide
  VL of XENP019515

SEQ ID NO: 5246 - protein, 12 aa, Artificial Sequence
  Description of Artificial Sequence: Synthetic peptide
  XENP019515 vlCDR1
RASQSVGSSYLA

SEQ ID NO: 5247 - protein, 7 aa, Artificial Sequence
  Description of Artificial Sequence: Synthetic peptide
  XENP019515 vlCDR2
GAFSRAT

SEQ ID NO: 5248 - protein, 9 aa, Artificial Sequence
  Description of Artificial Sequence: Synthetic peptide
  XENP019515 vlCDR3
QSYGSSPWT

SEQ ID NO: 5249 - protein, 221 aa, Artificial Sequence; identical to SEQ ID NO: 2919
  Description of Artificial Sequence: Synthetic polypeptide
  XENP019516 [CTLA-4]_H0_L0.97_Fab Heavy Chain

SEQ ID NO: 5250 - protein, 118 aa, Artificial Sequence; identical to SEQ ID NO: 22
  Description of Artificial Sequence: Synthetic polypeptide
  VH of XENP019516

SEQ ID NO: 5251 - protein, 5 aa, Artificial Sequence
  Description of Artificial Sequence: Synthetic peptide
  XENP019516 vhCDR1
SYTMH

SEQ ID NO: 5252 - protein, 17 aa, Artificial Sequence
  Description of Artificial Sequence: Synthetic peptide
  XENP019516 vhCDR2
FISYDGNNKYYADSVKG

SEQ ID NO: 5253 - protein, 9 aa, Artificial Sequence
  Description of Artificial Sequence: Synthetic peptide
  XENP019516 vhCDR3
TGWLGPFDY

SEQ ID NO: 5254 - protein, 215 aa, Artificial Sequence
  Description of Artificial Sequence: Synthetic polypeptide
  XENP019516 [CTLA-4]_H0_L0.97_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQAGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5255 - protein, 108 aa, Artificial Sequence; identical to SEQ ID NO: 2282
  Description of Artificial Sequence: Synthetic polypeptide
  VL of XENP019516

SEQ ID NO: 5256 - protein, 12 aa, Artificial Sequence
  Description of Artificial Sequence: Synthetic peptide
  XENP019516 vlCDR1
RASQSVGSSYLA

SEQ ID NO: 5257 - protein, 7 aa, Artificial Sequence
  Description of Artificial Sequence: Synthetic peptide
  XENP019516 vlCDR2
GAFSRAT

SEQ ID NO: 5258 - protein, 9 aa, Artificial Sequence
  Description of Artificial Sequence: Synthetic peptide
  XENP019516 vlCDR3
QQAGSSPWT

SEQ ID NO: 5259 - protein, 221 aa, Artificial Sequence; identical to SEQ ID NO: 2919
  Description of Artificial Sequence: Synthetic polypeptide
  XENP019517 [CTLA-4]_H0_L0.98_Fab Heavy Chain

SEQ ID NO: 5260 - protein, 118 aa, Artificial Sequence; identical to SEQ ID NO: 22
  Description of Artificial Sequence: Synthetic polypeptide
  VH of XENP019517

SEQ ID NO: 5261 - protein, 5 aa, Artificial Sequence
  Description of Artificial Sequence: Synthetic peptide
  XENP019517 vhCDR1
SYTMH

SEQ ID NO: 5262 - protein, 17 aa, Artificial Sequence
  Description of Artificial Sequence: Synthetic peptide
  XENP019517 vhCDR2
FISYDGNNKYYADSVKG

SEQ ID NO: 5263 - protein, 9 aa, Artificial Sequence
  Description of Artificial Sequence: Synthetic peptide
  XENP019517 vhCDR3
TGWLGPFDY

SEQ ID NO: 5264 - protein, 215 aa, Artificial Sequence
  Description of Artificial Sequence: Synthetic polypeptide
  XENP019517 [CTLA-4]_H0_L0.98_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQFGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5265 - protein, 108 aa, Artificial Sequence; identical to SEQ ID NO: 2291
  Description of Artificial Sequence: Synthetic polypeptide
  VL of XENP019517

SEQ ID NO: 5266 - protein, 12 aa, Artificial Sequence
  Description of Artificial Sequence: Synthetic peptide
  XENP019517 vlCDR1
RASQSVGSSYLA

SEQ ID NO: 5267 - protein, 7 aa, Artificial Sequence
  Description of Artificial Sequence: Synthetic peptide
  XENP019517 vlCDR2
GAFSRAT

SEQ ID NO: 5268 - protein, 9 aa, Artificial Sequence
  Description of Artificial Sequence: Synthetic peptide
  XENP019517 vlCDR3
QQFGSSPWT

SEQ ID NO: 5269 - protein, 221 aa, Artificial Sequence; identical to SEQ ID NO: 2919
  Description of Artificial Sequence: Synthetic polypeptide
  XENP019518 [CTLA-4]_H0_L0.99_Fab Heavy Chain

SEQ ID NO: 5270 - protein, 118 aa, Artificial Sequence; identical to SEQ ID NO: 22
  Description of Artificial Sequence: Synthetic polypeptide
  VH of XENP019518

SEQ ID NO: 5271 - protein, 5 aa, Artificial Sequence
  Description of Artificial Sequence: Synthetic peptide
  XENP019518 vhCDR1
SYTMH

SEQ ID NO: 5272 - protein, 17 aa, Artificial Sequence
  Description of Artificial Sequence: Synthetic peptide
  XENP019518 vhCDR2
FISYDGNNKYYADSVKG

SEQ ID NO: 5273 - protein, 9 aa, Artificial Sequence
  Description of Artificial Sequence: Synthetic peptide
  XENP019518 vhCDR3
TGWLGPFDY

SEQ ID NO: 5274 - protein, 215 aa, Artificial Sequence
  Description of Artificial Sequence: Synthetic polypeptide
  XENP019518 [CTLA-4]_H0_L0.99_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQHGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5275 - protein, 108 aa, Artificial Sequence; identical to SEQ ID NO: 2300
  Description of Artificial Sequence: Synthetic polypeptide
  VL of XENP019518

SEQ ID NO: 5276 - protein, 12 aa, Artificial Sequence
  Description of Artificial Sequence: Synthetic peptide
  XENP019518 vlCDR1
RASQSVGSSYLA

SEQ ID NO: 5277 - protein, 7 aa, Artificial Sequence
  Description of Artificial Sequence: Synthetic peptide
  XENP019518 vlCDR2
GAFSRAT

SEQ ID NO: 5278 - protein, 9 aa, Artificial Sequence
  Description of Artificial Sequence: Synthetic peptide
  XENP019518 vlCDR3
QQHGSSPWT

SEQ ID NO: 5279 - protein, 221 aa, Artificial Sequence; identical to SEQ ID NO: 2919
  Description of Artificial Sequence: Synthetic polypeptide
  XENP019519 [CTLA-4]_H0_L0.100_Fab Heavy Chain

SEQ ID NO: 5280 - protein, 118 aa, Artificial Sequence; identical to SEQ ID NO: 22
  Description of Artificial Sequence: Synthetic polypeptide
  VH of XENP019519

SEQ ID NO: 5281 - protein, 5 aa, Artificial Sequence
  Description of Artificial Sequence: Synthetic peptide
  XENP019519 vhCDR1
SYTMH

SEQ ID NO: 5282 - protein, 17 aa, Artificial Sequence
  Description of Artificial Sequence: Synthetic peptide
  XENP019519 vhCDR2
FISYDGNNKYYADSVKG

SEQ ID NO: 5283 - protein, 9 aa, Artificial Sequence
  Description of Artificial Sequence: Synthetic peptide
  XENP019519 vhCDR3
TGWLGPFDY

SEQ ID NO: 5284 - protein, 215 aa, Artificial Sequence
  Description of Artificial Sequence: Synthetic polypeptide
  XENP019519 [CTLA-4]_H0_L0.100_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQLGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5285 - protein, 108 aa, Artificial Sequence; identical to SEQ ID NO: 2309
  Description of Artificial Sequence: Synthetic polypeptide
  VL of XENP019519

SEQ ID NO: 5286 - protein, 12 aa, Artificial Sequence
  Description of Artificial Sequence: Synthetic peptide
  XENP019519 vlCDR1
RASQSVGSSYLA

SEQ ID NO: 5287 - protein, 7 aa, Artificial Sequence
  Description of Artificial Sequence: Synthetic peptide
  XENP019519 vlCDR2
GAFSRAT

SEQ ID NO: 5288 - protein, 9 aa, Artificial Sequence
  Description of Artificial Sequence: Synthetic peptide
  XENP019519 vlCDR3
QQLGSSPWT

SEQ ID NO: 5289 - protein, 221 aa, Artificial Sequence; identical to SEQ ID NO: 2919
  Description of Artificial Sequence: Synthetic polypeptide
  XENP019520 [CTLA-4]_H0_L0.101_Fab Heavy Chain

SEQ ID NO: 5290 - protein, 118 aa, Artificial Sequence; identical to SEQ ID NO: 22
  Description of Artificial Sequence: Synthetic polypeptide
  VH of XENP019520

SEQ ID NO: 5291 - protein, 5 aa, Artificial Sequence
  Description of Artificial Sequence: Synthetic peptide
  XENP019520 vhCDR1
SYTMH

SEQ ID NO: 5292 - protein, 17 aa, Artificial Sequence
  Description of Artificial Sequence: Synthetic peptide
  XENP019520 vhCDR2
FISYDGNNKYYADSVKG

SEQ ID NO: 5293 - protein, 9 aa, Artificial Sequence
  Description of Artificial Sequence: Synthetic peptide
  XENP019520 vhCDR3
TGWLGPFDY

SEQ ID NO: 5294 - protein, 215 aa, Artificial Sequence
  Description of Artificial Sequence: Synthetic polypeptide
  XENP019520 [CTLA-4]_H0_L0.101_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQVGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5295 - protein, 108 aa, Artificial Sequence; identical to SEQ ID NO: 2318
  Description of Artificial Sequence: Synthetic polypeptide
  VL of XENP019520

SEQ ID NO: 5296 - protein, 12 aa, Artificial Sequence
  Description of Artificial Sequence: Synthetic peptide
  XENP019520 vlCDR1
RASQSVGSSYLA

SEQ ID NO: 5297 - protein, 7 aa, Artificial Sequence
  Description of Artificial Sequence: Synthetic peptide
  XENP019520 vlCDR2
GAFSRAT

SEQ ID NO: 5298 - protein, 9 aa, Artificial Sequence
  Description of Artificial Sequence: Synthetic peptide
  XENP019520 vlCDR3
QQVGSSPWT

SEQ ID NO: 5299 - protein, 221 aa, Artificial Sequence; identical to SEQ ID NO: 2919
  Description of Artificial Sequence: Synthetic polypeptide
  XENP019521 [CTLA-4]_H0_L0.102_Fab Heavy Chain

SEQ ID NO: 5300 - protein, 118 aa, Artificial Sequence; identical to SEQ ID NO: 22
  Description of Artificial Sequence: Synthetic polypeptide
  VH of XENP019521

SEQ ID NO: 5301 - protein, 5 aa, Artificial Sequence
  Description of Artificial Sequence: Synthetic peptide
  XENP019521 vhCDR1
SYTMH

SEQ ID NO: 5302 - protein, 17 aa, Artificial Sequence
  Description of Artificial Sequence: Synthetic peptide
  XENP019521 vhCDR2
FISYDGNNKYYADSVKG

SEQ ID NO: 5303 - protein, 9 aa, Artificial Sequence
  Description of Artificial Sequence: Synthetic peptide
  XENP019521 vhCDR3
TGWLGPFDY

SEQ ID NO: 5304 - protein, 215 aa, Artificial Sequence
  Description of Artificial Sequence: Synthetic polypeptide
  XENP019521 [CTLA-4]_H0_L0.102_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGESPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5305 - protein, 108 aa, Artificial Sequence; identical to SEQ ID NO: 2327
  Description of Artificial Sequence: Synthetic polypeptide
  VL of XENP019521

SEQ ID NO: 5306 - protein, 12 aa, Artificial Sequence
  Description of Artificial Sequence: Synthetic peptide
  XENP019521 vlCDR1
RASQSVGSSYLA

SEQ ID NO: 5307 - protein, 7 aa, Artificial Sequence
  Description of Artificial Sequence: Synthetic peptide
  XENP019521 vlCDR2
GAFSRAT

SEQ ID NO: 5308 - protein, 9 aa, Artificial Sequence
  Description of Artificial Sequence: Synthetic peptide
  XENP019521 vlCDR3
QQYGESPWT

SEQ ID NO: 5309 - protein, 221 aa, Artificial Sequence; identical to SEQ ID NO: 2919
  Description of Artificial Sequence: Synthetic polypeptide
  XENP019522 [CTLA-4]_H0_L0.103_Fab Heavy Chain

SEQ ID NO: 5310 - protein, 118 aa, Artificial Sequence; identical to SEQ ID NO: 22
  Description of Artificial Sequence: Synthetic polypeptide
  VH of XENP019522

SEQ ID NO: 5311 - protein, 5 aa, Artificial Sequence
  Description of Artificial Sequence: Synthetic peptide
  XENP019522 vhCDR1
SYTMH

SEQ ID NO: 5312 - protein, 17 aa, Artificial Sequence
  Description of Artificial Sequence: Synthetic peptide
  XENP019522 vhCDR2
FISYDGNNKYYADSVKG

SEQ ID NO: 5313 - protein, 9 aa, Artificial Sequence
  Description of Artificial Sequence: Synthetic peptide
  XENP019522 vhCDR3
TGWLGPFDY

SEQ ID NO: 5314 - protein, 215 aa, Artificial Sequence
  Description of Artificial Sequence: Synthetic polypeptide
  XENP019522 [CTLA-4]_H0_L0.103_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGKSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5315 - protein, 108 aa, Artificial Sequence; identical to SEQ ID NO: 2336
  Description of Artificial Sequence: Synthetic polypeptide
  VL of XENP019522

SEQ ID NO: 5316 - protein, 12 aa, Artificial Sequence
  Description of Artificial Sequence: Synthetic peptide
  XENP019522 vlCDR1
RASQSVGSSYLA

SEQ ID NO: 5317 - protein, 7 aa, Artificial Sequence
  Description of Artificial Sequence: Synthetic peptide
  XENP019522 vlCDR2
GAFSRAT

SEQ ID NO: 5318 - protein, 9 aa, Artificial Sequence
  Description of Artificial Sequence: Synthetic peptide
  XENP019522 vlCDR3
QQYGKSPWT

SEQ ID NO: 5319 - protein, 221 aa, Artificial Sequence; identical to SEQ ID NO: 2919
  Description of Artificial Sequence: Synthetic polypeptide
  XENP019523 [CTLA-4]_H0_L0.104_Fab Heavy Chain

SEQ ID NO: 5320 - protein, 118 aa, Artificial Sequence; identical to SEQ ID NO: 22
  Description of Artificial Sequence: Synthetic polypeptide
  VH of XENP019523

SEQ ID NO: 5321 - protein, 5 aa, Artificial Sequence
  Description of Artificial Sequence: Synthetic peptide
  XENP019523 vhCDR1
SYTMH

SEQ ID NO: 5322 - protein, 17 aa, Artificial Sequence
  Description of Artificial Sequence: Synthetic peptide
  XENP019523 vhCDR2
FISYDGNNKYYADSVKG

SEQ ID NO: 5323 - protein, 9 aa, Artificial Sequence
  Description of Artificial Sequence: Synthetic peptide
  XENP019523 vhCDR3
TGWLGPFDY

SEQ ID NO: 5324 - protein, 215 aa, Artificial Sequence
  Description of Artificial Sequence: Synthetic polypeptide
  XENP019523 [CTLA-4]_H0_L0.104_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5325 - protein, 108 aa, Artificial Sequence; identical to SEQ ID NO: 2345
  Description of Artificial Sequence: Synthetic polypeptide
  VL of XENP019523

SEQ ID NO: 5326 - protein, 12 aa, Artificial Sequence
  Description of Artificial Sequence: Synthetic peptide
  XENP019523 vlCDR1
RASQSVGSSYLA

SEQ ID NO: 5327 - protein, 7 aa, Artificial Sequence
  Description of Artificial Sequence: Synthetic peptide
  XENP019523 vlCDR2
GAFSRAT

SEQ ID NO: 5328 - protein, 9 aa, Artificial Sequence
  Description of Artificial Sequence: Synthetic peptide
  XENP019523 vlCDR3
QQYGSYPWT

SEQ ID NO: 5329 - protein, 221 aa, Artificial Sequence; identical to SEQ ID NO: 2919
  Description of Artificial Sequence: Synthetic polypeptide
  XENP019524 [CTLA-4]_H0_L0.105_Fab Heavy Chain

SEQ ID NO: 5330 - protein, 118 aa, Artificial Sequence; identical to SEQ ID NO: 22
  Description of Artificial Sequence: Synthetic polypeptide
  VH of XENP019524

SEQ ID NO: 5331 - protein, 5 aa, Artificial Sequence
  Description of Artificial Sequence: Synthetic peptide
  XENP019524 vhCDR1
SYTMH

SEQ ID NO: 5332 - protein, 17 aa, Artificial Sequence
  Description of Artificial Sequence: Synthetic peptide
  XENP019524 vhCDR2
FISYDGNNKYYADSVKG

SEQ ID NO: 5333 - protein, 9 aa, Artificial Sequence
  Description of Artificial Sequence: Synthetic peptide
  XENP019524 vhCDR3
TGWLGPFDY

SEQ ID NO: 5334 - protein, 215 aa, Artificial Sequence
  Description of Artificial Sequence: Synthetic polypeptide
  XENP019524 [CTLA-4]_H0_L0.105_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSHWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5335 - protein, 108 aa, Artificial Sequence; identical to SEQ ID NO: 2354
  Description of Artificial Sequence: Synthetic polypeptide
  VL of XENP019524

SEQ ID NO: 5336 - protein, 12 aa, Artificial Sequence
  Description of Artificial Sequence: Synthetic peptide
  XENP019524 vlCDR1
RASQSVGSSYLA

SEQ ID NO: 5337 - protein, 7 aa, Artificial Sequence
  Description of Artificial Sequence: Synthetic peptide
  XENP019524 vlCDR2
GAFSRAT

SEQ ID NO: 5338 - protein, 9 aa, Artificial Sequence
  Description of Artificial Sequence: Synthetic peptide
  XENP019524 vlCDR3
QQYGSSHWT

SEQ ID NO: 5339 - protein, 221 aa, Artificial Sequence; identical to SEQ ID NO: 2919
  Description of Artificial Sequence: Synthetic polypeptide
  XENP019525 [CTLA-4]_H0_L0.106_Fab Heavy Chain

SEQ ID NO: 5340 - protein, 118 aa, Artificial Sequence; identical to SEQ ID NO: 22
  Description of Artificial Sequence: Synthetic polypeptide
  VH of XENP019525

SEQ ID NO: 5341 - protein, 5 aa, Artificial Sequence
  Description of Artificial Sequence: Synthetic peptide
  XENP019525 vhCDR1
SYTMH

SEQ ID NO: 5342 - protein, 17 aa, Artificial Sequence
  Description of Artificial Sequence: Synthetic peptide
  XENP019525 vhCDR2
FISYDGNNKYYADSVKG

SEQ ID NO: 5343 - protein, 9 aa, Artificial Sequence
  Description of Artificial Sequence: Synthetic peptide
  XENP019525 vhCDR3
TGWLGPFDY

SEQ ID NO: 5344 - protein, 215 aa, Artificial Sequence
  Description of Artificial Sequence: Synthetic polypeptide
  XENP019525 [CTLA-4]_H0_L0.106_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5345 - protein, 108 aa, Artificial Sequence; identical to SEQ ID NO: 2363
  Description of Artificial Sequence: Synthetic polypeptide
  VL of XENP019525

SEQ ID NO: 5346 - protein, 12 aa, Artificial Sequence
  Description of Artificial Sequence: Synthetic peptide
  XENP019525 vlCDR1
RASQSVGSSYLA

SEQ ID NO: 5347 - protein, 7 aa, Artificial Sequence
  Description of Artificial Sequence: Synthetic peptide
  XENP019525 vlCDR2
GAFSRAT

SEQ ID NO: 5348 - protein, 9 aa, Artificial Sequence
  Description of Artificial Sequence: Synthetic peptide
  XENP019525 vlCDR3
QQYGSSPFT

SEQ ID NO: 5349 - protein, 221 aa, Artificial Sequence; identical to SEQ ID NO: 2919
  Description of Artificial Sequence: Synthetic polypeptide
  XENP019526 [CTLA-4]_H0_L0.107_Fab Heavy Chain

SEQ ID NO: 5350 - protein, 118 aa, Artificial Sequence; identical to SEQ ID NO: 22
  Description of Artificial Sequence: Synthetic polypeptide
  VH of XENP019526

SEQ ID NO: 5351 - protein, 5 aa, Artificial Sequence
  Description of Artificial Sequence: Synthetic peptide
  XENP019526 vhCDR1
SYTMH

SEQ ID NO: 5352 - protein, 17 aa, Artificial Sequence
  Description of Artificial Sequence: Synthetic peptide
  XENP019526 vhCDR2
FISYDGNNKYYADSVKG

SEQ ID NO: 5353 - protein, 9 aa, Artificial Sequence
  Description of Artificial Sequence: Synthetic peptide
  XENP019526 vhCDR3
TGWLGPFDY

SEQ ID NO: 5354 - protein, 215 aa, Artificial Sequence
  Description of Artificial Sequence: Synthetic polypeptide
  XENP019526 [CTLA-4]_H0_L0.107_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5355 - protein, 108 aa, Artificial Sequence; identical to SEQ ID NO: 2372
  Description of Artificial Sequence: Synthetic polypeptide
  VL of XENP019526

SEQ ID NO: 5356 - protein, 12 aa, Artificial Sequence
  Description of Artificial Sequence: Synthetic peptide
  XENP019526 vlCDR1
RASQSVGSSYLA

SEQ ID NO: 5357 - protein, 7 aa, Artificial Sequence
  Description of Artificial Sequence: Synthetic peptide
  XENP019526 vlCDR2
GAFSRAT

SEQ ID NO: 5358 - protein, 9 aa, Artificial Sequence
  Description of Artificial Sequence: Synthetic peptide
  XENP019526 vlCDR3
QQYGSSPHT

SEQ ID NO: 5359 - protein, 221 aa, Artificial Sequence; identical to SEQ ID NO: 2919
  Description of Artificial Sequence: Synthetic polypeptide
  XENP019527 [CTLA-4]_H0_L0.108_Fab Heavy Chain

SEQ ID NO: 5360 - protein, 118 aa, Artificial Sequence; identical to SEQ ID NO: 22
  Description of Artificial Sequence: Synthetic polypeptide
  VH of XENP019527

SEQ ID NO: 5361 - protein, 5 aa, Artificial Sequence
  Description of Artificial Sequence: Synthetic peptide
  XENP019527 vhCDR1
SYTMH

SEQ ID NO: 5362 - protein, 17 aa, Artificial Sequence
  Description of Artificial Sequence: Synthetic peptide
  XENP019527 vhCDR2
FISYDGNNKYYADSVKG

SEQ ID NO: 5363 - protein, 9 aa, Artificial Sequence
  Description of Artificial Sequence: Synthetic peptide
  XENP019527 vhCDR3
TGWLGPFDY

SEQ ID NO: 5364 - protein, 215 aa, Artificial Sequence
  Description of Artificial Sequence: Synthetic polypeptide
  XENP019527 [CTLA-4]_H0_L0.108_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5365 - protein, 108 aa, Artificial Sequence; identical to SEQ ID NO: 2381
  Description of Artificial Sequence: Synthetic polypeptide
  VL of XENP019527

SEQ ID NO: 5366 - protein, 12 aa, Artificial Sequence
  Description of Artificial Sequence: Synthetic peptide
  XENP019527 vlCDR1
RASQSVGSSYLA

SEQ ID NO: 5367 - protein, 7 aa, Artificial Sequence
  Description of Artificial Sequence: Synthetic peptide
  XENP019527 vlCDR2
GAFSRAT

SEQ ID NO: 5368 - protein, 9 aa, Artificial Sequence
  Description of Artificial Sequence: Synthetic peptide
  XENP019527 vlCDR3
QQYGSSPIT

SEQ ID NO: 5369 - protein, 221 aa, Artificial Sequence; identical to SEQ ID NO: 2919
  Description of Artificial Sequence: Synthetic polypeptide
  XENP019528 [CTLA-4]_H0_L0.109_Fab Heavy Chain

SEQ ID NO: 5370 - protein, 118 aa, Artificial Sequence; identical to SEQ ID NO: 22
  Description of Artificial Sequence: Synthetic polypeptide
  VH of XENP019528

SEQ ID NO: 5371 - protein, 5 aa, Artificial Sequence
  Description of Artificial Sequence: Synthetic peptide
  XENP019528 vhCDR1
SYTMH

SEQ ID NO: 5372 - protein, 17 aa, Artificial Sequence
  Description of Artificial Sequence: Synthetic peptide
  XENP019528 vhCDR2
FISYDGNNKYYADSVKG

SEQ ID NO: 5373 - protein, 9 aa, Artificial Sequence
  Description of Artificial Sequence: Synthetic peptide
  XENP019528 vhCDR3
TGWLGPFDY

SEQ ID NO: 5374 - protein, 215 aa, Artificial Sequence
  Description of Artificial Sequence: Synthetic polypeptide
  XENP019528 [CTLA-4]_H0_L0.109_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5375 - protein, 108 aa, Artificial Sequence; identical to SEQ ID NO: 2390
  Description of Artificial Sequence: Synthetic polypeptide
  VL of XENP019528

SEQ ID NO: 5376 - protein, 12 aa, Artificial Sequence
  Description of Artificial Sequence: Synthetic peptide
  XENP019528 vlCDR1
RASQSVGSSYLA

SEQ ID NO: 5377 - protein, 7 aa, Artificial Sequence
  Description of Artificial Sequence: Synthetic peptide
  XENP019528 vlCDR2
GAFSRAT

SEQ ID NO: 5378 - protein, 9 aa, Artificial Sequence
  Description of Artificial Sequence: Synthetic peptide
  XENP019528 vlCDR3
QQYGSSPLT

SEQ ID NO: 5379 - protein, 221 aa, Artificial Sequence; identical to SEQ ID NO: 2919
  Description of Artificial Sequence: Synthetic polypeptide
  XENP019529 [CTLA-4]_H0_L0.110_Fab Heavy Chain

SEQ ID NO: 5380 - protein, 118 aa, Artificial Sequence; identical to SEQ ID NO: 22
  Description of Artificial Sequence: Synthetic polypeptide
  VH of XENP019529

SEQ ID NO: 5381 - protein, 5 aa, Artificial Sequence
  Description of Artificial Sequence: Synthetic peptide
  XENP019529 vhCDR1
SYTMH

SEQ ID NO: 5382 - protein, 17 aa, Artificial Sequence
  Description of Artificial Sequence: Synthetic peptide
  XENP019529 vhCDR2
FISYDGNNKYYADSVKG

SEQ ID NO: 5383 - protein, 9 aa, Artificial Sequence
  Description of Artificial Sequence: Synthetic peptide
  XENP019529 vhCDR3
TGWLGPFDY

SEQ ID NO: 5384 - protein, 215 aa, Artificial Sequence
  Description of Artificial Sequence: Synthetic polypeptide
  XENP019529 [CTLA-4]_H0_L0.110_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5385 - protein, 108 aa, Artificial Sequence; identical to SEQ ID NO: 2399
  Description of Artificial Sequence: Synthetic polypeptide
  VL of XENP019529

SEQ ID NO: 5386 - protein, 12 aa, Artificial Sequence
  Description of Artificial Sequence: Synthetic peptide
  XENP019529 vlCDR1
RASQSVGSSYLA

SEQ ID NO: 5387 - protein, 7 aa, Artificial Sequence
  Description of Artificial Sequence: Synthetic peptide
  XENP019529 vlCDR2
GAFSRAT

SEQ ID NO: 5388 - protein, 9 aa, Artificial Sequence
  Description of Artificial Sequence: Synthetic peptide
  XENP019529 vlCDR3
QQYGSSPYT

SEQ ID NO: 5389 - protein, 221 aa, Artificial Sequence; identical to SEQ ID NO: 2919
  Description of Artificial Sequence: Synthetic polypeptide
  XENP019530 [CTLA-4]_H0_L0.111_Fab Heavy Chain

SEQ ID NO: 5390 - protein, 118 aa, Artificial Sequence; identical to SEQ ID NO: 22
  Description of Artificial Sequence: Synthetic polypeptide
  VH of XENP019530

SEQ ID NO: 5391 - protein, 5 aa, Artificial Sequence
  Description of Artificial Sequence: Synthetic peptide
  XENP019530 vhCDR1
SYTMH

SEQ ID NO: 5392 - protein, 17 aa, Artificial Sequence
  Description of Artificial Sequence: Synthetic peptide
  XENP019530 vhCDR2
FISYDGNNKYYADSVKG

SEQ ID NO: 5393 - protein, 9 aa, Artificial Sequence
  Description of Artificial Sequence: Synthetic peptide
  XENP019530 vhCDR3
TGWLGPFDY

SEQ ID NO: 5394 - protein, 215 aa, Artificial Sequence
  Description of Artificial Sequence: Synthetic polypeptide
  XENP019530 [CTLA-4]_H0_L0.111_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWVFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5395 - protein, 108 aa, Artificial Sequence; identical to SEQ ID NO: 2408
  Description of Artificial Sequence: Synthetic polypeptide
  VL of XENP019530

SEQ ID NO: 5396 - protein, 12 aa, Artificial Sequence
  Description of Artificial Sequence: Synthetic peptide
  XENP019530 vlCDR1
RASQSVGSSYLA

SEQ ID NO: 5397 - protein, 7 aa, Artificial Sequence
  Description of Artificial Sequence: Synthetic peptide
  XENP019530 vlCDR2
GAFSRAT

SEQ ID NO: 5398 - protein, 9 aa, Artificial Sequence
  Description of Artificial Sequence: Synthetic peptide
  XENP019530 vlCDR3
QQYGSSPWV

SEQ ID NO: 5399 - protein, 221 aa, Artificial Sequence; identical to SEQ ID NO: 2919
  Description of Artificial Sequence: Synthetic polypeptide
  XENP019531 [CTLA-4]_H0_L0.112_Fab Heavy Chain

SEQ ID NO: 5400 - protein, 118 aa, Artificial Sequence; identical to SEQ ID NO: 22
  Description of Artificial Sequence: Synthetic polypeptide
  VH of XENP019531

SEQ ID NO: 5401 - protein, 5 aa, Artificial Sequence
  Description of Artificial Sequence: Synthetic peptide
  XENP019531 vhCDR1
SYTMH

SEQ ID NO: 5402 - protein, 17 aa, Artificial Sequence
  Description of Artificial Sequence: Synthetic peptide
  XENP019531 vhCDR2
FISYDGNNKYYADSVKG

SEQ ID NO: 5403 - protein, 9 aa, Artificial Sequence
  Description of Artificial Sequence: Synthetic peptide
  XENP019531 vhCDR3
TGWLGPFDY

SEQ ID NO: 5404 - protein, 215 aa, Artificial Sequence
  Description of Artificial Sequence: Synthetic polypeptide
  XENP019531 [CTLA-4]_H0_L0.112_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5405 - protein, 108 aa, Artificial Sequence; identical to SEQ ID NO: 2417
  Description of Artificial Sequence: Synthetic polypeptide
  VL of XENP019531

SEQ ID NO: 5406 - protein, 12 aa, Artificial Sequence
  Description of Artificial Sequence: Synthetic peptide
  XENP019531 vlCDR1
RASQSVGSSYLA

SEQ ID NO: 5407 - protein, 7 aa, Artificial Sequence
  Description of Artificial Sequence: Synthetic peptide
  XENP019531 vlCDR2
GAFSRAT

SEQ ID NO: 5408 - protein, 9 aa, Artificial Sequence
  Description of Artificial Sequence: Synthetic peptide
  XENP019531 vlCDR3
QQYGSSPWT

SEQ ID NO: 5409 - protein, 221 aa, Artificial Sequence; identical to SEQ ID NO: 2919
  Description of Artificial Sequence: Synthetic polypeptide
  XENP019532 [CTLA-4]_H0_L0.113_Fab Heavy Chain

SEQ ID NO: 5410 - protein, 118 aa, Artificial Sequence; identical to SEQ ID NO: 22
  Description of Artificial Sequence: Synthetic polypeptide
  VH of XENP019532

SEQ ID NO: 5411 - protein, 5 aa, Artificial Sequence
  Description of Artificial Sequence: Synthetic peptide
  XENP019532 vhCDR1
SYTMH

SEQ ID NO: 5412 - protein, 17 aa, Artificial Sequence
  Description of Artificial Sequence: Synthetic peptide
  XENP019532 vhCDR2
FISYDGNNKYYADSVKG

SEQ ID NO: 5413 - protein, 9 aa, Artificial Sequence
  Description of Artificial Sequence: Synthetic peptide
  XENP019532 vhCDR3
TGWLGPFDY

SEQ ID NO: 5414 - protein, 215 aa, Artificial Sequence
  Description of Artificial Sequence: Synthetic polypeptide
  XENP019532 [CTLA-4]_H0_L0.113_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5415 - protein, 108 aa, Artificial Sequence; identical to SEQ ID NO: 59
  Description of Artificial Sequence: Synthetic polypeptide
  VL of XENP019532

SEQ ID NO: 5416 - protein, 12 aa, Artificial Sequence
  Description of Artificial Sequence: Synthetic peptide
  XENP019532 vlCDR1
RASQSVGSSYLA

SEQ ID NO: 5417 - protein, 7 aa, Artificial Sequence
  Description of Artificial Sequence: Synthetic peptide
  XENP019532 vlCDR2
GAFSRAT

SEQ ID NO: 5418 - protein, 9 aa, Artificial Sequence
  Description of Artificial Sequence: Synthetic peptide
  XENP019532 vlCDR3
QQYGSSPWT

SEQ ID NO: 5419 - protein, 221 aa, Artificial Sequence
  Description of Artificial Sequence: Synthetic polypeptide
  XENP019544 [CTLA-4]_H1_L0_Fab Heavy Chain
EVQLVESGGGLVQPGGSLRLSCAASGFTFSSYTMHWVRQAPGKGLEWVTFISYDGNNKYYVDSVKGRFTISRDNAKNSLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5420 - protein, 118 aa, Artificial Sequence; identical to SEQ ID NO: 121
  Description of Artificial Sequence: Synthetic polypeptide
  VH of XENP019544

SEQ ID NO: 5421 - protein, 5 aa, Artificial Sequence
  Description of Artificial Sequence: Synthetic peptide
  XENP019544 vhCDR1
SYTMH

SEQ ID NO: 5422 - protein, 17 aa, Artificial Sequence
  Description of Artificial Sequence: Synthetic peptide
  XENP019544 vhCDR2
FISYDGNNKYYVDSVKG

SEQ ID NO: 5423 - protein, 9 aa, Artificial Sequence
  Description of Artificial Sequence: Synthetic peptide
  XENP019544 vhCDR3
TGWLGPFDY

SEQ ID NO: 5424 - protein, 215 aa, Artificial Sequence; identical to SEQ ID NO: 2924
  Description of Artificial Sequence: Synthetic polypeptide
  XENP019544 [CTLA-4]_H1_L0_Fab Light Chain

SEQ ID NO: 5425 - protein, 108 aa, Artificial Sequence; identical to SEQ ID NO: 23
  Description of Artificial Sequence: Synthetic polypeptide
  VL of XENP019544

SEQ ID NO: 5426 - protein, 12 aa, Artificial Sequence
  Description of Artificial Sequence: Synthetic peptide
  XENP019544 vlCDR1
RASQSVGSSYLA

SEQ ID NO: 5427 - protein, 7 aa, Artificial Sequence
  Description of Artificial Sequence: Synthetic peptide
  XENP019544 vlCDR2
GAFSRAT

SEQ ID NO: 5428 - protein, 9 aa, Artificial Sequence
  Description of Artificial Sequence: Synthetic peptide
  XENP019544 vlCDR3
QQYGSSPWT

SEQ ID NO: 5429 - protein, 221 aa, Artificial Sequence
  Description of Artificial Sequence: Synthetic polypeptide
  XENP019545 [CTLA-4]_H2_L0_Fab Heavy Chain
EVQLVESGGGLVQPGGSLRLSCAASGFTFSSYTMHWVRQAPGKGLEWVTFISYDGNNKYYPGSVKGRFTISRENAKNSLYLQMNSLRAGDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5430 - protein, 118 aa, Artificial Sequence; identical to SEQ ID NO: 130
  Description of Artificial Sequence: Synthetic polypeptide
  VH of XENP019545

SEQ ID NO: 5431 - protein, 5 aa, Artificial Sequence
  Description of Artificial Sequence: Synthetic peptide
  XENP019545 vhCDR1
SYTMH

SEQ ID NO: 5432 - protein, 17 aa, Artificial Sequence
  Description of Artificial Sequence: Synthetic peptide
  XENP019545 vhCDR2
FISYDGNNKYYPGSVKG

SEQ ID NO: 5433 - protein, 9 aa, Artificial Sequence
  Description of Artificial Sequence: Synthetic peptide
  XENP019545 vhCDR3
TGWLGPFDY

SEQ ID NO: 5434 - protein, 215 aa, Artificial Sequence; identical to SEQ ID NO: 2924
  Description of Artificial Sequence: Synthetic polypeptide
  XENP019545 [CTLA-4]_H2_L0_Fab Light Chain

SEQ ID NO: 5435 - protein, 108 aa, Artificial Sequence; identical to SEQ ID NO: 23
  Description of Artificial Sequence: Synthetic polypeptide
  VL of XENP019545

SEQ ID NO: 5436 - protein, 12 aa, Artificial Sequence
  Description of Artificial Sequence: Synthetic peptide
  XENP019545 vlCDR1
RASQSVGSSYLA

SEQ ID NO: 5437 - protein, 7 aa, Artificial Sequence
  Description of Artificial Sequence: Synthetic peptide
  XENP019545 vlCDR2
GAFSRAT

SEQ ID NO: 5438 - protein, 9 aa, Artificial Sequence
  Description of Artificial Sequence: Synthetic peptide
  XENP019545 vlCDR3
QQYGSSPWT

SEQ ID NO: 5439 - protein, 221 aa, Artificial Sequence
  Description of Artificial Sequence: Synthetic polypeptide
  XENP019546 [CTLA-4]_H3_L0_Fab Heavy Chain
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5440 - protein, 118 aa, Artificial Sequence; identical to SEQ ID NO: 139
  Description of Artificial Sequence: Synthetic polypeptide
  VH of XENP019546

SEQ ID NO: 5441 - protein, 5 aa, Artificial Sequence
  Description of Artificial Sequence: Synthetic peptide
  XENP019546 vhCDR1
SYTMH

SEQ ID NO: 5442 - protein, 17 aa, Artificial Sequence
  Description of Artificial Sequence: Synthetic peptide
  XENP019546 vhCDR2
FISYDGNNKYYADSVKG

SEQ ID NO: 5443 - protein, 9 aa, Artificial Sequence
  Description of Artificial Sequence: Synthetic peptide
  XENP019546 vhCDR3
TGWLGPFDY

SEQ ID NO: 5444 - protein, 215 aa, Artificial Sequence; identical to SEQ ID NO: 2924
  Description of Artificial Sequence: Synthetic polypeptide
  XENP019546 [CTLA-4]_H3_L0_Fab Light Chain

SEQ ID NO: 5445 - protein, 108 aa, Artificial Sequence; identical to SEQ ID NO: 23
  Description of Artificial Sequence: Synthetic polypeptide
  VL of XENP019546

SEQ ID NO: 5446 - protein, 12 aa, Artificial Sequence
  Description of Artificial Sequence: Synthetic peptide
  XENP019546 vlCDR1
RASQSVGSSYLA

SEQ ID NO: 5447 - protein, 7 aa, Artificial Sequence
  Description of Artificial Sequence: Synthetic peptide
  XENP019546 vlCDR2
GAFSRAT

SEQ ID NO: 5448 - protein, 9 aa, Artificial Sequence
  Description of Artificial Sequence: Synthetic peptide
  XENP019546 vlCDR3
QQYGSSPWT

SEQ ID NO: 5449 - protein, 221 aa, Artificial Sequence
  Description of Artificial Sequence: Synthetic polypeptide
  XENP019547 [CTLA-4]_H4_L0_Fab Heavy Chain
EVQLVESGGGLVQPGGSLRLSCAASGFTFSSYTMHWVRQAPGKGLEYVTFISYDGNNKYYADSVKGRFTISRDNSKNTLYLQMGSLRAEDMAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5450 - protein, 118 aa, Artificial Sequence; identical to SEQ ID NO: 148
  Description of Artificial Sequence: Synthetic polypeptide
  VH of XENP019547

SEQ ID NO: 5451 - protein, 5 aa, Artificial Sequence
  Description of Artificial Sequence: Synthetic peptide
  XENP019547 vhCDR1
SYTMH

SEQ ID NO: 5452 - protein, 17 aa, Artificial Sequence
  Description of Artificial Sequence: Synthetic peptide
  XENP019547 vhCDR2
FISYDGNNKYYADSVKG

SEQ ID NO: 5453 - protein, 9 aa, Artificial Sequence
  Description of Artificial Sequence: Synthetic peptide
  XENP019547 vhCDR3
TGWLGPFDY

SEQ ID NO: 5454 - protein, 215 aa, Artificial Sequence; identical to SEQ ID NO: 2924
  Description of Artificial Sequence: Synthetic polypeptide
  XENP019547 [CTLA-4]_H4_L0_Fab Light Chain

SEQ ID NO: 5455 - protein, 108 aa, Artificial Sequence; identical to SEQ ID NO: 23
  Description of Artificial Sequence: Synthetic polypeptide
  VL of XENP019547

SEQ ID NO: 5456 - protein, 12 aa, Artificial Sequence
  Description of Artificial Sequence: Synthetic peptide
  XENP019547 vlCDR1
RASQSVGSSYLA

SEQ ID NO: 5457 - protein, 7 aa, Artificial Sequence
  Description of Artificial Sequence: Synthetic peptide
  XENP019547 vlCDR2
GAFSRAT

SEQ ID NO: 5458 - protein, 9 aa, Artificial Sequence
  Description of Artificial Sequence: Synthetic peptide
  XENP019547 vlCDR3
QQYGSSPWT

SEQ ID NO: 5459 - protein, 221 aa, Artificial Sequence; identical to SEQ ID NO: 2919
  Description of Artificial Sequence: Synthetic polypeptide
  XENP019548 [CTLA-4]_H0_L1_Fab Heavy Chain

SEQ ID NO: 5460 - protein, 118 aa, Artificial Sequence; identical to SEQ ID NO: 22
  Description of Artificial Sequence: Synthetic polypeptide
  VH of XENP019548

SEQ ID NO: 5461 - protein, 5 aa, Artificial Sequence
  Description of Artificial Sequence: Synthetic peptide
  XENP019548 vhCDR1
SYTMH

SEQ ID NO: 5462 - protein, 17 aa, Artificial Sequence
  Description of Artificial Sequence: Synthetic peptide
  XENP019548 vhCDR2
FISYDGNNKYYADSVKG

SEQ ID NO: 5463 - protein, 9 aa, Artificial Sequence
  Description of Artificial Sequence: Synthetic peptide
  XENP019548 vhCDR3
TGWLGPFDY

SEQ ID NO: 5464 - protein, 215 aa, Artificial Sequence
  Description of Artificial Sequence: Synthetic polypeptide
  XENP019548 [CTLA-4]_H0_L1_Fab Light Chain
EIVLTQSPATLSLSPGERATLSCGASQSVGSSYLAWYQQKPGLAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5465 - protein, 108 aa, Artificial Sequence; identical to SEQ ID NO: 158
  Description of Artificial Sequence: Synthetic polypeptide
  VL of XENP019548

SEQ ID NO: 5466 - protein, 12 aa, Artificial Sequence
  Description of Artificial Sequence: Synthetic peptide
  XENP019548 vlCDR1
GASQSVGSSYLA

SEQ ID NO: 5467 - protein, 7 aa, Artificial Sequence
  Description of Artificial Sequence: Synthetic peptide
  XENP019548 vlCDR2
GAFSRAT

SEQ ID NO: 5468 - protein, 9 aa, Artificial Sequence
  Description of Artificial Sequence: Synthetic peptide
  XENP019548 vlCDR3
QQYGSSPWT

SEQ ID NO: 5469 - protein, 221 aa, Artificial Sequence; identical to SEQ ID NO: 2919
  Description of Artificial Sequence: Synthetic polypeptide
  XENP019549 [CTLA-4]_H0_L2_Fab Heavy Chain

SEQ ID NO: 5470 - protein, 118 aa, Artificial Sequence; identical to SEQ ID NO: 22
  Description of Artificial Sequence: Synthetic polypeptide
  VH of XENP019549

SEQ ID NO: 5471 - protein, 5 aa, Artificial Sequence
  Description of Artificial Sequence: Synthetic peptide
  XENP019549 vhCDR1
SYTMH

SEQ ID NO: 5472 - protein, 17 aa, Artificial Sequence
  Description of Artificial Sequence: Synthetic peptide
  XENP019549 vhCDR2
FISYDGNNKYYADSVKG

SEQ ID NO: 5473 - protein, 9 aa, Artificial Sequence
  Description of Artificial Sequence: Synthetic peptide
  XENP019549 vhCDR3
TGWLGPFDY

SEQ ID NO: 5474 - protein, 215 aa, Artificial Sequence
  Description of Artificial Sequence: Synthetic polypeptide
  XENP019549 [CTLA-4]_H0_L2_Fab Light Chain
EIVMTQSPATLSVSPGERATLSCRASQSVGSSYLAWYQQKPGQAPRLLIYGAFSRATGIPARFSGSGSGTEFTLTISSLQSEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5475 - protein, 108 aa, Artificial Sequence; identical to SEQ ID NO: 167
  Description of Artificial Sequence: Synthetic polypeptide
  VL of XENP019549

SEQ ID NO: 5476 - protein, 12 aa, Artificial Sequence
  Description of Artificial Sequence: Synthetic peptide
  XENP019549 vlCDR1
RASQSVGSSYLA

SEQ ID NO: 5477 - protein, 7 aa, Artificial Sequence
  Description of Artificial Sequence: Synthetic peptide
  XENP019549 vlCDR2
GAFSRAT

SEQ ID NO: 5478 - protein, 9 aa, Artificial Sequence
  Description of Artificial Sequence: Synthetic peptide
  XENP019549 vlCDR3
QQYGSSPWT

SEQ ID NO: 5479 - protein, 221 aa, Artificial Sequence
  Description of Artificial Sequence: Synthetic polypeptide
  XENP019585 [CTLA-4]_H0.140_L0_Fab Heavy Chain
QVQLVESGGGVVQPGRSLRLSCAASGFTFSSYTMHWVRQAPGKGLEWVCFISYDGNNKYYADSVKGRFTCSRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5480 - protein, 118 aa, Artificial Sequence; identical to SEQ ID NO: 175
  Description of Artificial Sequence: Synthetic polypeptide
  VH of XENP019585

SEQ ID NO: 5481 - protein, 5 aa, Artificial Sequence
  Description of Artificial Sequence: Synthetic peptide
  XENP019585 vhCDR1
SYTMH

SEQ ID NO: 5482 - protein, 17 aa, Artificial Sequence
  Description of Artificial Sequence: Synthetic peptide
  XENP019585 vhCDR2
FISYDGNNKYYADSVKG

SEQ ID NO: 5483 - protein, 9 aa, Artificial Sequence
  Description of Artificial Sequence: Synthetic peptide
  XENP019585 vhCDR3
TGWLGPFDY

SEQ ID NO: 5484 - protein, 215 aa, Artificial Sequence; identical to SEQ ID NO: 2924
  Description of Artificial Sequence: Synthetic polypeptide
  XENP019585 [CTLA-4]_H0.140_L0_Fab Light Chain

SEQ ID NO: 5485 - protein, 108 aa, Artificial Sequence; identical to SEQ ID NO: 23
  Description of Artificial Sequence: Synthetic polypeptide
  VL of XENP019585

SEQ ID NO: 5486 - protein, 12 aa, Artificial Sequence
  Description of Artificial Sequence: Synthetic peptide
  XENP019585 vlCDR1
RASQSVGSSYLA

SEQ ID NO: 5487 - protein, 7 aa, Artificial Sequence
  Description of Artificial Sequence: Synthetic peptide
  XENP019585 vlCDR2
GAFSRAT

SEQ ID NO: 5488 - protein, 9 aa, Artificial Sequence
  Description of Artificial Sequence: Synthetic peptide
  XENP019585 vlCDR3
QQYGSSPWT

SEQ ID NO: 5489 - protein, 221 aa, Artificial Sequence; identical to SEQ ID NO: 2919
  Description of Artificial Sequence: Synthetic polypeptide
  XENP019586 [CTLA-4]_H0_L0.117_Fab Heavy Chain

SEQ ID NO: 5490 - protein, 118 aa, Artificial Sequence; identical to SEQ ID NO: 22
  Description of Artificial Sequence: Synthetic polypeptide
  VH of XENP019586

SEQ ID NO: 5491 - protein, 5 aa, Artificial Sequence
  Description of Artificial Sequence: Synthetic peptide
  XENP019586 vhCDR1
SYTMH

SEQ ID NO: 5492 - protein, 17 aa, Artificial Sequence
  Description of Artificial Sequence: Synthetic peptide
  XENP019586 vhCDR2
FISYDGNNKYYADSVKG

SEQ ID NO: 5493 - protein, 9 aa, Artificial Sequence
  Description of Artificial Sequence: Synthetic peptide
  XENP019586 vhCDR3
TGWLGPFDY

SEQ ID NO: 5494 - protein, 215 aa, Artificial Sequence
  Description of Artificial Sequence: Synthetic polypeptide
  XENP019586 [CTLA-4]_H0_L0.117_Fab Light Chain
EIVLTQSPGTLSLSPGERATLSCRASQSVGSSYLAWYQQKPGQAPRLLCYGAFSRATGIPDRFSCSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5495 - protein, 108 aa, Artificial Sequence; identical to SEQ ID NO: 185
  Description of Artificial Sequence: Synthetic polypeptide
  VL of XENP019586

SEQ ID NO: 5496 - protein, 12 aa, Artificial Sequence
  Description of Artificial Sequence: Synthetic peptide
  XENP019586 vlCDR1
RASQSVGSSYLA

SEQ ID NO: 5497 - protein, 7 aa, Artificial Sequence
  Description of Artificial Sequence: Synthetic peptide
  XENP019586 vlCDR2
GAFSRAT

SEQ ID NO: 5498 - protein, 9 aa, Artificial Sequence
  Description of Artificial Sequence: Synthetic peptide
  XENP019586 vlCDR3
QQYGSSPWT

SEQ ID NO: 5499 - protein, 221 aa, Artificial Sequence; identical to SEQ ID NO: 4259
  Description of Artificial Sequence: Synthetic polypeptide
  XENP020006 [CTLA-4]_H0.134_L0.53_Fab Heavy Chain

SEQ ID NO: 5500 - protein, 118 aa, Artificial Sequence; identical to SEQ ID NO: 67
  Description of Artificial Sequence: Synthetic polypeptide
  VH of XENP020006

SEQ ID NO: 5501 - protein, 5 aa, Artificial Sequence
  Description of Artificial Sequence: Synthetic peptide
  XENP020006 vhCDR1
SYTMH

SEQ ID NO: 5502 - protein, 17 aa, Artificial Sequence
  Description of Artificial Sequence: Synthetic peptide
  XENP020006 vhCDR2
FISYDGNNKYYADSVKG

SEQ ID NO: 5503 - protein, 9 aa, Artificial Sequence
  Description of Artificial Sequence: Synthetic peptide
  XENP020006 vhCDR3
TGWLGPFDY

SEQ ID NO: 5504 - protein, 215 aa, Artificial Sequence; identical to SEQ ID NO: 4814
  Description of Artificial Sequence: Synthetic polypeptide
  XENP020006 [CTLA-4]_H0.134_L0.53_Fab Light Chain

SEQ ID NO: 5505 - protein, 108 aa, Artificial Sequence; identical to SEQ ID NO: 77
  Description of Artificial Sequence: Synthetic polypeptide
  VL of XENP020006

SEQ ID NO: 5506 - protein, 12 aa, Artificial Sequence
  Description of Artificial Sequence: Synthetic peptide
  XENP020006 vlCDR1
RASQSVGSSYLA

SEQ ID NO: 5507 - protein, 7 aa, Artificial Sequence
  Description of Artificial Sequence: Synthetic peptide
  XENP020006 vlCDR2
GAFSRAT

SEQ ID NO: 5508 - protein, 9 aa, Artificial Sequence
  Description of Artificial Sequence: Synthetic peptide
  XENP020006 vlCDR3
QQYGSSPWT

SEQ ID NO: 5509 - protein, 221 aa, Artificial Sequence; identical to SEQ ID NO: 5439
  Description of Artificial Sequence: Synthetic polypeptide
  XENP020007 [CTLA-4]_H3_L1_Fab Heavy Chain

SEQ ID NO: 5510 - protein, 118 aa, Artificial Sequence; identical to SEQ ID NO: 139
  Description of Artificial Sequence: Synthetic polypeptide
  VH of XENP020007

SEQ ID NO: 5511 - protein, 5 aa, Artificial Sequence
  Description of Artificial Sequence: Synthetic peptide
  XENP020007 vhCDR1
SYTMH

SEQ ID NO: 5512 - protein, 17 aa, Artificial Sequence
  Description of Artificial Sequence: Synthetic peptide
  XENP020007 vhCDR2
FISYDGNNKYYADSVKG

SEQ ID NO: 5513 - protein, 9 aa, Artificial Sequence
  Description of Artificial Sequence: Synthetic peptide
  XENP020007 vhCDR3
TGWLGPFDY

SEQ ID NO: 5514 - protein, 215 aa, Artificial Sequence; identical to SEQ ID NO: 5464
  Description of Artificial Sequence: Synthetic polypeptide
  XENP020007 [CTLA-4]_H3_L1_Fab Light Chain

SEQ ID NO: 5515 - protein, 108 aa, Artificial Sequence; identical to SEQ ID NO: 158
  Description of Artificial Sequence: Synthetic polypeptide
  VL of XENP020007

SEQ ID NO: 5516 - protein, 12 aa, Artificial Sequence
  Description of Artificial Sequence: Synthetic peptide
  XENP020007 vlCDR1
GASQSVGSSYLA

SEQ ID NO: 5517 - protein, 7 aa, Artificial Sequence
  Description of Artificial Sequence: Synthetic peptide
  XENP020007 vlCDR2
GAFSRAT

SEQ ID NO: 5518 - protein, 9 aa, Artificial Sequence
  Description of Artificial Sequence: Synthetic peptide
  XENP020007 vlCDR3
QQYGSSPWT

SEQ ID NO: 5519 - protein, 221 aa, Artificial Sequence; identical to SEQ ID NO: 5439
  Description of Artificial Sequence: Synthetic polypeptide
  XENP020008 [CTLA-4]_H3_L2_Fab Heavy Chain

SEQ ID NO: 5520 - protein, 118 aa, Artificial Sequence; identical to SEQ ID NO: 139
  Description of Artificial Sequence: Synthetic polypeptide
  VH of XENP020008

SEQ ID NO: 5521 - protein, 5 aa, Artificial Sequence
  Description of Artificial Sequence: Synthetic peptide
  XENP020008 vhCDR1
SYTMH

SEQ ID NO: 5522 - protein, 17 aa, Artificial Sequence
  Description of Artificial Sequence: Synthetic peptide
  XENP020008 vhCDR2
FISYDGNNKYYADSVKG

SEQ ID NO: 5523 - protein, 9 aa, Artificial Sequence
  Description of Artificial Sequence: Synthetic peptide
  XENP020008 vhCDR3
TGWLGPFDY

SEQ ID NO: 5524 - protein, 215 aa, Artificial Sequence; identical to SEQ ID NO: 5474
  Description of Artificial Sequence: Synthetic polypeptide
  XENP020008 [CTLA-4]_H3_L2_Fab Light Chain

SEQ ID NO: 5525 - protein, 108 aa, Artificial Sequence; identical to SEQ ID NO: 167
  Description of Artificial Sequence: Synthetic polypeptide
  VL of XENP020008

SEQ ID NO: 5526 - protein, 12 aa, Artificial Sequence
  Description of Artificial Sequence: Synthetic peptide
  XENP020008 vlCDR1
RASQSVGSSYLA

SEQ ID NO: 5527 - protein, 7 aa, Artificial Sequence
  Description of Artificial Sequence: Synthetic peptide
  XENP020008 vlCDR2
GAFSRAT

SEQ ID NO: 5528 - protein, 9 aa, Artificial Sequence
  Description of Artificial Sequence: Synthetic peptide
  XENP020008 vlCDR3
QQYGSSPWT

SEQ ID NO: 5529 - protein, 221 aa, Artificial Sequence; identical to SEQ ID NO: 5439
  Description of Artificial Sequence: Synthetic polypeptide
  XENP020009 [CTLA-4]_H3_L0.12_Fab Heavy Chain

SEQ ID NO: 5530 - protein, 118 aa, Artificial Sequence; identical to SEQ ID NO: 139
  Description of Artificial Sequence: Synthetic polypeptide
  VH of XENP020009

SEQ ID NO: 5531 - protein, 5 aa, Artificial Sequence
  Description of Artificial Sequence: Synthetic peptide
  XENP020009 vhCDR1
SYTMH

SEQ ID NO: 5532 - protein, 17 aa, Artificial Sequence
  Description of Artificial Sequence: Synthetic peptide
  XENP020009 vhCDR2
FISYDGNNKYYADSVKG

SEQ ID NO: 5533 - protein, 9 aa, Artificial Sequence
  Description of Artificial Sequence: Synthetic peptide
  XENP020009 vhCDR3
TGWLGPFDY

SEQ ID NO: 5534 - protein, 215 aa, Artificial Sequence; identical to SEQ ID NO: 4404
  Description of Artificial Sequence: Synthetic polypeptide
  XENP020009 [CTLA-4]_H3_L0.12_Fab Light Chain

SEQ ID NO: 5535 - protein, 108 aa, Artificial Sequence; identical to SEQ ID NO: 1517
  Description of Artificial Sequence: Synthetic polypeptide
  VL of XENP020009

SEQ ID NO: 5536 - protein, 12 aa, Artificial Sequence
  Description of Artificial Sequence: Synthetic peptide
  XENP020009 vlCDR1
RASQSVGSSYLA

SEQ ID NO: 5537 - protein, 7 aa, Artificial Sequence
  Description of Artificial Sequence: Synthetic peptide
  XENP020009 vlCDR2
GAFSRAT

SEQ ID NO: 5538 - protein, 9 aa, Artificial Sequence
  Description of Artificial Sequence: Synthetic peptide
  XENP020009 vlCDR3
QQYGSSPWT

SEQ ID NO: 5539 - protein, 221 aa, Artificial Sequence; identical to SEQ ID NO: 5439
  Description of Artificial Sequence: Synthetic polypeptide
  XENP020010 [CTLA-4]_H3_L0.18_Fab Heavy Chain

SEQ ID NO: 5540 - protein, 118 aa, Artificial Sequence; identical to SEQ ID NO: 139
  Description of Artificial Sequence: Synthetic polypeptide
  VH of XENP020010

SEQ ID NO: 5541 - protein, 5 aa, Artificial Sequence
  Description of Artificial Sequence: Synthetic peptide
  XENP020010 vhCDR1
SYTMH

SEQ ID NO: 5542 - protein, 17 aa, Artificial Sequence
  Description of Artificial Sequence: Synthetic peptide
  XENP020010 vhCDR2
FISYDGNNKYYADSVKG

SEQ ID NO: 5543 - protein, 9 aa, Artificial Sequence
  Description of Artificial Sequence: Synthetic peptide
  XENP020010 vhCDR3
TGWLGPFDY

SEQ ID NO: 5544 - protein, 215 aa, Artificial Sequence; identical to SEQ ID NO: 4464
  Description of Artificial Sequence: Synthetic polypeptide
  XENP020010 [CTLA-4]_H3_L0.18_Fab Light Chain

SEQ ID NO: 5545 - protein, 108 aa, Artificial Sequence; identical to SEQ ID NO: 1571
  Description of Artificial Sequence: Synthetic polypeptide
  VL of XENP020010

SEQ ID NO: 5546 - protein, 12 aa, Artificial Sequence
  Description of Artificial Sequence: Synthetic peptide
  XENP020010 vlCDR1
RSSQSVGSSYLA

SEQ ID NO: 5547 - protein, 7 aa, Artificial Sequence
  Description of Artificial Sequence: Synthetic peptide
  XENP020010 vlCDR2
GAFSRAT

SEQ ID NO: 5548 - protein, 9 aa, Artificial Sequence
  Description of Artificial Sequence: Synthetic peptide
  XENP020010 vlCDR3
QQYGSSPWT

SEQ ID NO: 5549 - protein, 221 aa, Artificial Sequence; identical to SEQ ID NO: 5439
  Description of Artificial Sequence: Synthetic polypeptide
  XENP020011 [CTLA-4]_H3_L0.22_Fab Heavy Chain

SEQ ID NO: 5550 - protein, 118 aa, Artificial Sequence; identical to SEQ ID NO: 139
  Description of Artificial Sequence: Synthetic polypeptide
  VH of XENP020011

SEQ ID NO: 5551 - protein, 5 aa, Artificial Sequence
  Description of Artificial Sequence: Synthetic peptide
  XENP020011 vhCDR1
SYTMH

SEQ ID NO: 5552 - protein, 17 aa, Artificial Sequence
  Description of Artificial Sequence: Synthetic peptide
  XENP020011 vhCDR2
FISYDGNNKYYADSVKG

SEQ ID NO: 5553 - protein, 9 aa, Artificial Sequence
  Description of Artificial Sequence: Synthetic peptide
  XENP020011 vhCDR3
TGWLGPFDY

SEQ ID NO: 5554 - protein, 215 aa, Artificial Sequence; identical to SEQ ID NO: 4504
  Description of Artificial Sequence: Synthetic polypeptide
  XENP020011 [CTLA-4]_H3_L0.22_Fab Light Chain

SEQ ID NO: 5555 - protein, 108 aa, Artificial Sequence; identical to SEQ ID NO: 1607
  Description of Artificial Sequence: Synthetic polypeptide
  VL of XENP020011

SEQ ID NO: 5556 - protein, 12 aa, Artificial Sequence
  Description of Artificial Sequence: Synthetic peptide
  XENP020011 vlCDR1
RASQSVSSSYLA

SEQ ID NO: 5557 - protein, 7 aa, Artificial Sequence
  Description of Artificial Sequence: Synthetic peptide
  XENP020011 vlCDR2
GAFSRAT

SEQ ID NO: 5558 - protein, 9 aa, Artificial Sequence
  Description of Artificial Sequence: Synthetic peptide
  XENP020011 vlCDR3
QQYGSSPWT

SEQ ID NO: 5559 - protein, 221 aa, Artificial Sequence; identical to SEQ ID NO: 5439
  Description of Artificial Sequence: Synthetic polypeptide
  XENP020012 [CTLA-4]_H3_L0.27_Fab Heavy Chain

SEQ ID NO: 5560 - protein, 118 aa, Artificial Sequence; identical to SEQ ID NO: 139
  Description of Artificial Sequence: Synthetic polypeptide
  VH of XENP020012

SEQ ID NO: 5561 - protein, 5 aa, Artificial Sequence
  Description of Artificial Sequence: Synthetic peptide
  XENP020012 vhCDR1
SYTMH

SEQ ID NO: 5562 - protein, 17 aa, Artificial Sequence
  Description of Artificial Sequence: Synthetic peptide
  XENP020012 vhCDR2
FISYDGNNKYYADSVKG

SEQ ID NO: 5563 - protein, 9 aa, Artificial Sequence
  Description of Artificial Sequence: Synthetic peptide
  XENP020012 vhCDR3
TGWLGPFDY

SEQ ID NO: 5564 - protein, 215 aa, Artificial Sequence; identical to SEQ ID NO: 4554
  Description of Artificial Sequence: Synthetic polypeptide
  XENP020012 [CTLA-4]_H3_L0.27_Fab Light Chain

SEQ ID NO: 5565 - protein, 108 aa, Artificial Sequence; identical to SEQ ID NO: 1652
  Description of Artificial Sequence: Synthetic polypeptide
  VL of XENP020012

SEQ ID NO: 5566 - protein, 12 aa, Artificial Sequence
  Description of Artificial Sequence: Synthetic peptide
  XENP020012 vlCDR1
RASQSVGQSYLA

SEQ ID NO: 5567 - protein, 7 aa, Artificial Sequence
  Description of Artificial Sequence: Synthetic peptide
  XENP020012 vlCDR2
GAFSRAT

SEQ ID NO: 5568 - protein, 9 aa, Artificial Sequence
  Description of Artificial Sequence: Synthetic peptide
  XENP020012 vlCDR3
QQYGSSPWT

SEQ ID NO: 5569 - protein, 221 aa, Artificial Sequence; identical to SEQ ID NO: 5439
  Description of Artificial Sequence: Synthetic polypeptide
  XENP020013 [CTLA-4]_H3_L0.32_Fab Heavy Chain

SEQ ID NO: 5570 - protein, 118 aa, Artificial Sequence; identical to SEQ ID NO: 139
  Description of Artificial Sequence: Synthetic polypeptide
  VH of XENP020013

SEQ ID NO: 5571 - protein, 5 aa, Artificial Sequence
  Description of Artificial Sequence: Synthetic peptide
  XENP020013 vhCDR1
SYTMH

SEQ ID NO: 5572 - protein, 17 aa, Artificial Sequence
  Description of Artificial Sequence: Synthetic peptide
  XENP020013 vhCDR2
FISYDGNNKYYADSVKG

SEQ ID NO: 5573 - protein, 9 aa, Artificial Sequence
  Description of Artificial Sequence: Synthetic peptide
  XENP020013 vhCDR3
TGWLGPFDY

SEQ ID NO: 5574 - protein, 215 aa, Artificial Sequence; identical to SEQ ID NO: 4604
  Description of Artificial Sequence: Synthetic polypeptide
  XENP020013 [CTLA-4]_H3_L0.32_Fab Light Chain

SEQ ID NO: 5575 - protein, 108 aa, Artificial Sequence; identical to SEQ ID NO: 1697
  Description of Artificial Sequence: Synthetic polypeptide
  VL of XENP020013

SEQ ID NO: 5576 - protein, 12 aa, Artificial Sequence
  Description of Artificial Sequence: Synthetic peptide
  XENP020013 vlCDR1
RASQSVGSQYLA

SEQ ID NO: 5577 - protein, 7 aa, Artificial Sequence
  Description of Artificial Sequence: Synthetic peptide
  XENP020013 vlCDR2
GAFSRAT

SEQ ID NO: 5578 - protein, 9 aa, Artificial Sequence
  Description of Artificial Sequence: Synthetic peptide
  XENP020013 vlCDR3
QQYGSSPWT

SEQ ID NO: 5579 - protein, 221 aa, Artificial Sequence; identical to SEQ ID NO: 5439
  Description of Artificial Sequence: Synthetic polypeptide
  XENP020014 [CTLA-4]_H3_L0.36_Fab Heavy Chain

SEQ ID NO: 5580 - protein, 118 aa, Artificial Sequence; identical to SEQ ID NO: 139
  Description of Artificial Sequence: Synthetic polypeptide
  VH of XENP020014

SEQ ID NO: 5581 - protein, 5 aa, Artificial Sequence
  Description of Artificial Sequence: Synthetic peptide
  XENP020014 vhCDR1
SYTMH

SEQ ID NO: 5582 - protein, 17 aa, Artificial Sequence
  Description of Artificial Sequence: Synthetic peptide
  XENP020014 vhCDR2
FISYDGNNKYYADSVKG

SEQ ID NO: 5583 - protein, 9 aa, Artificial Sequence
  Description of Artificial Sequence: Synthetic peptide
  XENP020014 vhCDR3
TGWLGPFDY

SEQ ID NO: 5584 - protein, 215 aa, Artificial Sequence; identical to SEQ ID NO: 4644
  Description of Artificial Sequence: Synthetic polypeptide
  XENP020014 [CTLA-4]_H3_L0.36_Fab Light Chain

SEQ ID NO: 5585 - protein, 108 aa, Artificial Sequence; identical to SEQ ID NO: 1733
  Description of Artificial Sequence: Synthetic polypeptide
  VL of XENP020014

SEQ ID NO: 5586 - protein, 12 aa, Artificial Sequence
  Description of Artificial Sequence: Synthetic peptide
  XENP020014 vlCDR1
RASQSVGSSHLA

SEQ ID NO: 5587 - protein, 7 aa, Artificial Sequence
  Description of Artificial Sequence: Synthetic peptide
  XENP020014 vlCDR2
GAFSRAT

SEQ ID NO: 5588 - protein, 9 aa, Artificial Sequence
  Description of Artificial Sequence: Synthetic peptide
  XENP020014 vlCDR3
QQYGSSPWT

SEQ ID NO: 5589 - protein, 221 aa, Artificial Sequence; identical to SEQ ID NO: 5439
  Description of Artificial Sequence: Synthetic polypeptide
  XENP020015 [CTLA-4]_H3_L0.37_Fab Heavy Chain

SEQ ID NO: 5590 - protein, 118 aa, Artificial Sequence; identical to SEQ ID NO: 139
  Description of Artificial Sequence: Synthetic polypeptide
  VH of XENP020015

SEQ ID NO: 5591 - protein, 5 aa, Artificial Sequence
  Description of Artificial Sequence: Synthetic peptide
  XENP020015 vhCDR1
SYTMH

SEQ ID NO: 5592 - protein, 17 aa, Artificial Sequence
  Description of Artificial Sequence: Synthetic peptide
  XENP020015 vhCDR2
FISYDGNNKYYADSVKG

SEQ ID NO: 5593 - protein, 9 aa, Artificial Sequence
  Description of Artificial Sequence: Synthetic peptide
  XENP020015 vhCDR3
TGWLGPFDY

SEQ ID NO: 5594 - protein, 215 aa, Artificial Sequence; identical to SEQ ID NO: 4654
  Description of Artificial Sequence: Synthetic polypeptide
  XENP020015 [CTLA-4]_H3_L0.37_Fab Light Chain

SEQ ID NO: 5595 - protein, 108 aa, Artificial Sequence; identical to SEQ ID NO: 1742
  Description of Artificial Sequence: Synthetic polypeptide
  VL of XENP020015

SEQ ID NO: 5596 - protein, 12 aa, Artificial Sequence
  Description of Artificial Sequence: Synthetic peptide
  XENP020015 vlCDR1
RASQSVGSSLLA

SEQ ID NO: 5597 - protein, 7 aa, Artificial Sequence
  Description of Artificial Sequence: Synthetic peptide
  XENP020015 vlCDR2
GAFSRAT

SEQ ID NO: 5598 - protein, 9 aa, Artificial Sequence
  Description of Artificial Sequence: Synthetic peptide
  XENP020015 vlCDR3
QQYGSSPWT

SEQ ID NO: 5599 - protein, 221 aa, Artificial Sequence; identical to SEQ ID NO: 5439
  Description of Artificial Sequence: Synthetic polypeptide
  XENP020016 [CTLA-4]_H3_L0.39_Fab Heavy Chain

SEQ ID NO: 5600 - protein, 118 aa, Artificial Sequence; identical to SEQ ID NO: 139
  Description of Artificial Sequence: Synthetic polypeptide
  VH of XENP020016

SEQ ID NO: 5601 - protein, 5 aa, Artificial Sequence
  Description of Artificial Sequence: Synthetic peptide
  XENP020016 vhCDR1
SYTMH

SEQ ID NO: 5602 - protein, 17 aa, Artificial Sequence
  Description of Artificial Sequence: Synthetic peptide
  XENP020016 vhCDR2
FISYDGNNKYYADSVKG

SEQ ID NO: 5603 - protein, 9 aa, Artificial Sequence
  Description of Artificial Sequence: Synthetic peptide
  XENP020016 vhCDR3
TGWLGPFDY

SEQ ID NO: 5604 - protein, 215 aa, Artificial Sequence; identical to SEQ ID NO: 4674
  Description of Artificial Sequence: Synthetic polypeptide
  XENP020016 [CTLA-4]_H3_L0.39_Fab Light Chain

SEQ ID NO: 5605 - protein, 108 aa, Artificial Sequence; identical to SEQ ID NO: 1760
  Description of Artificial Sequence: Synthetic polypeptide
  VL of XENP020016

SEQ ID NO: 5606 - protein, 12 aa, Artificial Sequence
  Description of Artificial Sequence: Synthetic peptide
  XENP020016 vlCDR1
RASQSVGSSSLA

SEQ ID NO: 5607 - protein, 7 aa, Artificial Sequence
  Description of Artificial Sequence: Synthetic peptide
  XENP020016 vlCDR2
GAFSRAT

SEQ ID NO: 5608 - protein, 9 aa, Artificial Sequence
  Description of Artificial Sequence: Synthetic peptide
  XENP020016 vlCDR3
QQYGSSPWT

SEQ ID NO: 5609 - protein, 221 aa, Artificial Sequence; identical to SEQ ID NO: 5439
  Description of Artificial Sequence: Synthetic polypeptide
  XENP020017 [CTLA-4]_H3_L0.41_Fab Heavy Chain

SEQ ID NO: 5610 - protein, 118 aa, Artificial Sequence; identical to SEQ ID NO: 139
  Description of Artificial Sequence: Synthetic polypeptide
  VH of XENP020017

SEQ ID NO: 5611 - protein, 5 aa, Artificial Sequence
  Description of Artificial Sequence: Synthetic peptide
  XENP020017 vhCDR1
SYTMH

SEQ ID NO: 5612 - protein, 17 aa, Artificial Sequence
  Description of Artificial Sequence: Synthetic peptide
  XENP020017 vhCDR2
FISYDGNNKYYADSVKG

SEQ ID NO: 5613 - protein, 9 aa, Artificial Sequence
  Description of Artificial Sequence: Synthetic peptide
  XENP020017 vhCDR3
TGWLGPFDY

SEQ ID NO: 5614 - protein, 215 aa, Artificial Sequence; identical to SEQ ID NO: 4694
  Description of Artificial Sequence: Synthetic polypeptide
  XENP020017 [CTLA-4]_H3_L0.41_Fab Light Chain

SEQ ID NO: 5615 - protein, 108 aa, Artificial Sequence; identical to SEQ ID NO: 1778
  Description of Artificial Sequence: Synthetic polypeptide
  VL of XENP020017

SEQ ID NO: 5616 - protein, 12 aa, Artificial Sequence
  Description of Artificial Sequence: Synthetic peptide
  XENP020017 vlCDR1
RASQSVGSSYMA

SEQ ID NO: 5617 - protein, 7 aa, Artificial Sequence
  Description of Artificial Sequence: Synthetic peptide
  XENP020017 vlCDR2
GAFSRAT

SEQ ID NO: 5618 - protein, 9 aa, Artificial Sequence
  Description of Artificial Sequence: Synthetic peptide
  XENP020017 vlCDR3
QQYGSSPWT

SEQ ID NO: 5619 - protein, 221 aa, Artificial Sequence; identical to SEQ ID NO: 5439
  Description of Artificial Sequence: Synthetic polypeptide
  XENP020018 [CTLA-4]_H3_L0.67_Fab Heavy Chain

SEQ ID NO: 5620 - protein, 118 aa, Artificial Sequence; identical to SEQ ID NO: 139
  Description of Artificial Sequence: Synthetic polypeptide
  VH of XENP020018

SEQ ID NO: 5621 - protein, 5 aa, Artificial Sequence
  Description of Artificial Sequence: Synthetic peptide
  XENP020018 vhCDR1
SYTMH

SEQ ID NO: 5622 - protein, 17 aa, Artificial Sequence
  Description of Artificial Sequence: Synthetic peptide
  XENP020018 vhCDR2
FISYDGNNKYYADSVKG

SEQ ID NO: 5623 - protein, 9 aa, Artificial Sequence
  Description of Artificial Sequence: Synthetic peptide
  XENP020018 vhCDR3
TGWLGPFDY

SEQ ID NO: 5624 - protein, 215 aa, Artificial Sequence; identical to SEQ ID NO: 4954
  Description of Artificial Sequence: Synthetic polypeptide
  XENP020018 [CTLA-4]_H3_L0.67_Fab Light Chain

SEQ ID NO: 5625 - protein, 108 aa, Artificial Sequence; identical to SEQ ID NO: 2012
  Description of Artificial Sequence: Synthetic polypeptide
  VL of XENP020018

SEQ ID NO: 5626 - protein, 12 aa, Artificial Sequence
  Description of Artificial Sequence: Synthetic peptide
  XENP020018 vlCDR1
RASQSVGSSYLA

SEQ ID NO: 5627 - protein, 7 aa, Artificial Sequence
  Description of Artificial Sequence: Synthetic peptide
  XENP020018 vlCDR2
DAFSRAT

SEQ ID NO: 5628 - protein, 9 aa, Artificial Sequence
  Description of Artificial Sequence: Synthetic peptide
  XENP020018 vlCDR3
QQYGSSPWT

SEQ ID NO: 5629 - protein, 221 aa, Artificial Sequence; identical to SEQ ID NO: 5439
  Description of Artificial Sequence: Synthetic polypeptide
  XENP020019 [CTLA-4]_H3_L0.69_Fab Heavy Chain

SEQ ID NO: 5630 - protein, 118 aa, Artificial Sequence; identical to SEQ ID NO: 139
  Description of Artificial Sequence: Synthetic polypeptide
  VH of XENP020019

SEQ ID NO: 5631 - protein, 5 aa, Artificial Sequence
  Description of Artificial Sequence: Synthetic peptide
  XENP020019 vhCDR1
SYTMH

SEQ ID NO: 5632 - protein, 17 aa, Artificial Sequence
  Description of Artificial Sequence: Synthetic peptide
  XENP020019 vhCDR2
FISYDGNNKYYADSVKG

SEQ ID NO: 5633 - protein, 9 aa, Artificial Sequence
  Description of Artificial Sequence: Synthetic peptide
  XENP020019 vhCDR3
TGWLGPFDY

SEQ ID NO: 5634 - protein, 215 aa, Artificial Sequence; identical to SEQ ID NO: 4974
  Description of Artificial Sequence: Synthetic polypeptide
  XENP020019 [CTLA-4]_H3_L0.69_Fab Light Chain

SEQ ID NO: 5635 - protein, 108 aa, Artificial Sequence; identical to SEQ ID NO: 2030
  Description of Artificial Sequence: Synthetic polypeptide
  VL of XENP020019

SEQ ID NO: 5636 - protein, 12 aa, Artificial Sequence
  Description of Artificial Sequence: Synthetic peptide
  XENP020019 vlCDR1
RASQSVGSSYLA

SEQ ID NO: 5637 - protein, 7 aa, Artificial Sequence
  Description of Artificial Sequence: Synthetic peptide
  XENP020019 vlCDR2
GVFSRAT

SEQ ID NO: 5638 - protein, 9 aa, Artificial Sequence
  Description of Artificial Sequence: Synthetic peptide
  XENP020019 vlCDR3
QQYGSSPWT

SEQ ID NO: 5639 - protein, 221 aa, Artificial Sequence; identical to SEQ ID NO: 5439
  Description of Artificial Sequence: Synthetic polypeptide
  XENP020020 [CTLA-4]_H3_L0.74_Fab Heavy Chain

SEQ ID NO: 5640 - protein, 118 aa, Artificial Sequence; identical to SEQ ID NO: 139
  Description of Artificial Sequence: Synthetic polypeptide
  VH of XENP020020

SEQ ID NO: 5641 - protein, 5 aa, Artificial Sequence
  Description of Artificial Sequence: Synthetic peptide
  XENP020020 vhCDR1
SYTMH

SEQ ID NO: 5642 - protein, 17 aa, Artificial Sequence
  Description of Artificial Sequence: Synthetic peptide
  XENP020020 vhCDR2
FISYDGNNKYYADSVKG

SEQ ID NO: 5643 - protein, 9 aa, Artificial Sequence
  Description of Artificial Sequence: Synthetic peptide
  XENP020020 vhCDR3
TGWLGPFDY

SEQ ID NO: 5644 - protein, 215 aa, Artificial Sequence; identical to SEQ ID NO: 5024
  Description of Artificial Sequence: Synthetic polypeptide
  XENP020020 [CTLA-4]_H3_L0.74_Fab Light Chain

SEQ ID NO: 5645 - protein, 108 aa, Artificial Sequence; identical to SEQ ID NO: 2075
  Description of Artificial Sequence: Synthetic polypeptide
  VL of XENP020020

SEQ ID NO: 5646 - protein, 12 aa, Artificial Sequence
  Description of Artificial Sequence: Synthetic peptide
  XENP020020 vlCDR1
RASQSVGSSYLA

SEQ ID NO: 5647 - protein, 7 aa, Artificial Sequence
  Description of Artificial Sequence: Synthetic peptide
  XENP020020 vlCDR2
GAYSRAT

SEQ ID NO: 5648 - protein, 9 aa, Artificial Sequence
  Description of Artificial Sequence: Synthetic peptide
  XENP020020 vlCDR3
QQYGSSPWT

SEQ ID NO: 5649 - protein, 221 aa, Artificial Sequence; identical to SEQ ID NO: 5439
  Description of Artificial Sequence: Synthetic polypeptide
  XENP020021 [CTLA-4]_H3_L0.75_Fab Heavy Chain

SEQ ID NO: 5650 - protein, 118 aa, Artificial Sequence; identical to SEQ ID NO: 139
  Description of Artificial Sequence: Synthetic polypeptide
  VH of XENP020021

SEQ ID NO: 5651 - protein, 5 aa, Artificial Sequence
  Description of Artificial Sequence: Synthetic peptide
  XENP020021 vhCDR1
SYTMH

SEQ ID NO: 5652 - protein, 17 aa, Artificial Sequence
  Description of Artificial Sequence: Synthetic peptide
  XENP020021 vhCDR2
FISYDGNNKYYADSVKG

SEQ ID NO: 5653 - protein, 9 aa, Artificial Sequence
  Description of Artificial Sequence: Synthetic peptide
  XENP020021 vhCDR3
TGWLGPFDY

SEQ ID NO: 5654 - protein, 215 aa, Artificial Sequence; identical to SEQ ID NO: 5034
  Description of Artificial Sequence: Synthetic polypeptide
  XENP020021 [CTLA-4]_H3_L0.75_Fab Light Chain

SEQ ID NO: 5655 - protein, 108 aa, Artificial Sequence; identical to SEQ ID NO: 2084
  Description of Artificial Sequence: Synthetic polypeptide
  VL of XENP020021

SEQ ID NO: 5656 - protein, 12 aa, Artificial Sequence
  Description of Artificial Sequence: Synthetic peptide
  XENP020021 vlCDR1
RASQSVGSSYLA

SEQ ID NO: 5657 - protein, 7 aa, Artificial Sequence
  Description of Artificial Sequence: Synthetic peptide
  XENP020021 vlCDR2
GAFARAT

SEQ ID NO: 5658 - protein, 9 aa, Artificial Sequence
  Description of Artificial Sequence: Synthetic peptide
  XENP020021 vlCDR3
QQYGSSPWT

SEQ ID NO: 5659 - protein, 221 aa, Artificial Sequence; identical to SEQ ID NO: 5439
  Description of Artificial Sequence: Synthetic polypeptide
  XENP020022 [CTLA-4]_H3_L0.103_Fab Heavy Chain

SEQ ID NO: 5660 - protein, 118 aa, Artificial Sequence; identical to SEQ ID NO: 139
  Description of Artificial Sequence: Synthetic polypeptide
  VH of XENP020022

SEQ ID NO: 5661 - protein, 5 aa, Artificial Sequence
  Description of Artificial Sequence: Synthetic peptide
  XENP020022 vhCDR1
SYTMH

SEQ ID NO: 5662 - protein, 17 aa, Artificial Sequence
  Description of Artificial Sequence: Synthetic peptide
  XENP020022 vhCDR2
FISYDGNNKYYADSVKG

SEQ ID NO: 5663 - protein, 9 aa, Artificial Sequence
  Description of Artificial Sequence: Synthetic peptide
  XENP020022 vhCDR3
TGWLGPFDY

SEQ ID NO: 5664 - protein, 215 aa, Artificial Sequence; identical to SEQ ID NO: 5314
  Description of Artificial Sequence: Synthetic polypeptide
  XENP020022 [CTLA-4]_H3_L0.103_Fab Light Chain

SEQ ID NO: 5665 - protein, 108 aa, Artificial Sequence; identical to SEQ ID NO: 2336
  Description of Artificial Sequence: Synthetic polypeptide
  VL of XENP020022

SEQ ID NO: 5666 - protein, 12 aa, Artificial Sequence
  Description of Artificial Sequence: Synthetic peptide
  XENP020022 vlCDR1
RASQSVGSSYLA

SEQ ID NO: 5667 - protein, 7 aa, Artificial Sequence
  Description of Artificial Sequence: Synthetic peptide
  XENP020022 vlCDR2
GAFSRAT

SEQ ID NO: 5668 - protein, 9 aa, Artificial Sequence
  Description of Artificial Sequence: Synthetic peptide
  XENP020022 vlCDR3
QQYGKSPWT

SEQ ID NO: 5669 - protein, 221 aa, Artificial Sequence; identical to SEQ ID NO: 5439
  Description of Artificial Sequence: Synthetic polypeptide
  XENP020052 [CTLA-4]_H3_L0.44_Fab Heavy Chain

SEQ ID NO: 5670 - protein, 118 aa, Artificial Sequence; identical to SEQ ID NO: 139
  Description of Artificial Sequence: Synthetic polypeptide
  VH of XENP020052

SEQ ID NO: 5671 - protein, 5 aa, Artificial Sequence
  Description of Artificial Sequence: Synthetic peptide
  XENP020052 vhCDR1
SYTMH

SEQ ID NO: 5672 - protein, 17 aa, Artificial Sequence
  Description of Artificial Sequence: Synthetic peptide
  XENP020052 vhCDR2
FISYDGNNKYYADSVKG

SEQ ID NO: 5673 - protein, 9 aa, Artificial Sequence
  Description of Artificial Sequence: Synthetic peptide
  XENP020052 vhCDR3
TGWLGPFDY

SEQ ID NO: 5674 - protein, 215 aa, Artificial Sequence; identical to SEQ ID NO: 4724
  Description of Artificial Sequence: Synthetic polypeptide
  XENP020052 [CTLA-4]_H3_L0.44_Fab Light Chain

SEQ ID NO: 5675 - protein, 108 aa, Artificial Sequence; identical to SEQ ID NO: 1805
  Description of Artificial Sequence: Synthetic polypeptide
  VL of XENP020052

SEQ ID NO: 5676 - protein, 12 aa, Artificial Sequence
  Description of Artificial Sequence: Synthetic peptide
  XENP020052 vlCDR1
RASQSVGSSYLS

SEQ ID NO: 5677 - protein, 7 aa, Artificial Sequence
  Description of Artificial Sequence: Synthetic peptide
  XENP020052 vlCDR2
GAFSRAT

SEQ ID NO: 5678 - protein, 9 aa, Artificial Sequence
  Description of Artificial Sequence: Synthetic peptide
  XENP020052 vlCDR3
QQYGSSPWT

SEQ ID NO: 5679 - protein, 221 aa, Artificial Sequence
  Description of Artificial Sequence: Synthetic polypeptide
  XENP020068 [CTLA-4]_H3.1_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5680 - protein, 118 aa, Artificial Sequence; identical to SEQ ID NO: 2434
  Description of Artificial Sequence: Synthetic polypeptide
  VH of XENP020068

SEQ ID NO: 5681 - protein, 5 aa, Artificial Sequence
  Description of Artificial Sequence: Synthetic peptide
  XENP020068 vhCDR1
SYTMH

SEQ ID NO: 5682 - protein, 17 aa, Artificial Sequence
  Description of Artificial Sequence: Synthetic peptide
  XENP020068 vhCDR2
FISYDGNHKYYADSVKG

SEQ ID NO: 5683 - protein, 9 aa, Artificial Sequence
  Description of Artificial Sequence: Synthetic peptide
  XENP020068 vhCDR3
TGLLGPFDL

SEQ ID NO: 5684 - protein, 215 aa, Artificial Sequence; identical to SEQ ID NO: 4404
  Description of Artificial Sequence: Synthetic polypeptide
  XENP020068 [CTLA-4]_H3.1_L0.12_Fab Light Chain

SEQ ID NO: 5685 - protein, 108 aa, Artificial Sequence; identical to SEQ ID NO: 1517
  Description of Artificial Sequence: Synthetic polypeptide
  VL of XENP020068

SEQ ID NO: 5686 - protein, 12 aa, Artificial Sequence
  Description of Artificial Sequence: Synthetic peptide
  XENP020068 vlCDR1
RASQSVGSSYLA

SEQ ID NO: 5687 - protein, 7 aa, Artificial Sequence
  Description of Artificial Sequence: Synthetic peptide
  XENP020068 vlCDR2
GAFSRAT

SEQ ID NO: 5688 - protein, 9 aa, Artificial Sequence
  Description of Artificial Sequence: Synthetic peptide
  XENP020068 vlCDR3
QQYGSSPWT

SEQ ID NO: 5689 - protein, 221 aa, Artificial Sequence
  Description of Artificial Sequence: Synthetic polypeptide
  XENP020069 [CTLA-4]_H3.2_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5690 - protein, 118 aa, Artificial Sequence; identical to SEQ ID NO: 2443
  Description of Artificial Sequence: Synthetic polypeptide
  VH of XENP020069

SEQ ID NO: 5691 - protein, 5 aa, Artificial Sequence
  Description of Artificial Sequence: Synthetic peptide
  XENP020069 vhCDR1
SYTMH

SEQ ID NO: 5692 - protein, 17 aa, Artificial Sequence
  Description of Artificial Sequence: Synthetic peptide
  XENP020069 vhCDR2
FISYDGNTKYYADSVKG

SEQ ID NO: 5693 - protein, 9 aa, Artificial Sequence
  Description of Artificial Sequence: Synthetic peptide
  XENP020069 vhCDR3
TGLLGPFDL

SEQ ID NO: 5694 - protein, 215 aa, Artificial Sequence; identical to SEQ ID NO: 4404
  Description of Artificial Sequence: Synthetic polypeptide
  XENP020069 [CTLA-4]_H3.2_L0.12_Fab Light Chain

SEQ ID NO: 5695 - protein, 108 aa, Artificial Sequence; identical to SEQ ID NO: 1517
  Description of Artificial Sequence: Synthetic polypeptide
  VL of XENP020069

SEQ ID NO: 5696 - protein, 12 aa, Artificial Sequence
  Description of Artificial Sequence: Synthetic peptide
  XENP020069 vlCDR1
RASQSVGSSYLA

SEQ ID NO: 5697 - protein, 7 aa, Artificial Sequence
  Description of Artificial Sequence: Synthetic peptide
  XENP020069 vlCDR2
GAFSRAT

SEQ ID NO: 5698 - protein, 9 aa, Artificial Sequence
  Description of Artificial Sequence: Synthetic peptide
  XENP020069 vlCDR3
QQYGSSPWT

SEQ ID NO: 5699 - protein, 221 aa, Artificial Sequence
  Description of Artificial Sequence: Synthetic polypeptide
  XENP020070 [CTLA-4]_H3.3_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5700 - protein, 118 aa, Artificial Sequence; identical to SEQ ID NO: 2452
  Description of Artificial Sequence: Synthetic polypeptide
  VH of XENP020070

SEQ ID NO: 5701 - protein, 5 aa, Artificial Sequence
  Description of Artificial Sequence: Synthetic peptide
  XENP020070 vhCDR1
SYTMH

SEQ ID NO: 5702 - protein, 17 aa, Artificial Sequence
  Description of Artificial Sequence: Synthetic peptide
  XENP020070 vhCDR2
FISYDGNQKYYADSVKG

SEQ ID NO: 5703 - protein, 9 aa, Artificial Sequence
  Description of Artificial Sequence: Synthetic peptide
  XENP020070 vhCDR3
TGLLGPFDL

SEQ ID NO: 5704 - protein, 215 aa, Artificial Sequence; identical to SEQ ID NO: 4404
  Description of Artificial Sequence: Synthetic polypeptide
  XENP020070 [CTLA-4]_H3.3_L0.12_Fab Light Chain

SEQ ID NO: 5705 - protein, 108 aa, Artificial Sequence; identical to SEQ ID NO: 1517
  Description of Artificial Sequence: Synthetic polypeptide
  VL of XENP020070

SEQ ID NO: 5706 - protein, 12 aa, Artificial Sequence
  Description of Artificial Sequence: Synthetic peptide
  XENP020070 vlCDR1
RASQSVGSSYLA

SEQ ID NO: 5707 - protein, 7 aa, Artificial Sequence
  Description of Artificial Sequence: Synthetic peptide
  XENP020070 vlCDR2
GAFSRAT

SEQ ID NO: 5708 - protein, 9 aa, Artificial Sequence
  Description of Artificial Sequence: Synthetic peptide
  XENP020070 vlCDR3
QQYGSSPWT

SEQ ID NO: 5709 - protein, 221 aa, Artificial Sequence
  Description of Artificial Sequence: Synthetic polypeptide
  XENP020071 [CTLA-4]_H3.4_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5710 - protein, 118 aa, Artificial Sequence; identical to SEQ ID NO: 2461
  Description of Artificial Sequence: Synthetic polypeptide
  VH of XENP020071

SEQ ID NO: 5711 - protein, 5 aa, Artificial Sequence
  Description of Artificial Sequence: Synthetic peptide
  XENP020071 vhCDR1
SYTMH

SEQ ID NO: 5712 - protein, 17 aa, Artificial Sequence
  Description of Artificial Sequence: Synthetic peptide
  XENP020071 vhCDR2
FISYDGNHKYYADSVKG

SEQ ID NO: 5713 - protein, 9 aa, Artificial Sequence
  Description of Artificial Sequence: Synthetic peptide
  XENP020071 vhCDR3
TGHLGPFDL

SEQ ID NO: 5714 - protein, 215 aa, Artificial Sequence; identical to SEQ ID NO: 4404
  Description of Artificial Sequence: Synthetic polypeptide
  XENP020071 [CTLA-4]_H3.4_L0.12_Fab Light Chain

SEQ ID NO: 5715 - protein, 108 aa, Artificial Sequence; identical to SEQ ID NO: 1517
  Description of Artificial Sequence: Synthetic polypeptide
  VL of XENP020071

SEQ ID NO: 5716 - protein, 12 aa, Artificial Sequence
  Description of Artificial Sequence: Synthetic peptide
  XENP020071 vlCDR1
RASQSVGSSYLA

SEQ ID NO: 5717 - protein, 7 aa, Artificial Sequence
  Description of Artificial Sequence: Synthetic peptide
  XENP020071 vlCDR2
GAFSRAT

SEQ ID NO: 5718 - protein, 9 aa, Artificial Sequence
  Description of Artificial Sequence: Synthetic peptide
  XENP020071 vlCDR3
QQYGSSPWT

SEQ ID NO: 5719 - protein, 221 aa, Artificial Sequence
  Description of Artificial Sequence: Synthetic polypeptide
  XENP020072 [CTLA-4]_H3.5_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5720 - protein, 118 aa, Artificial Sequence; identical to SEQ ID NO: 2470
  Description of Artificial Sequence: Synthetic polypeptide
  VH of XENP020072

SEQ ID NO: 5721 - protein, 5 aa, Artificial Sequence
  Description of Artificial Sequence: Synthetic peptide
  XENP020072 vhCDR1
SYTMH

SEQ ID NO: 5722 - protein, 17 aa, Artificial Sequence
  Description of Artificial Sequence: Synthetic peptide
  XENP020072 vhCDR2
FISYDGNTKYYADSVKG

SEQ ID NO: 5723 - protein, 9 aa, Artificial Sequence
  Description of Artificial Sequence: Synthetic peptide
  XENP020072 vhCDR3
TGHLGPFDL

SEQ ID NO: 5724 - protein, 215 aa, Artificial Sequence; identical to SEQ ID NO: 4404
  Description of Artificial Sequence: Synthetic polypeptide
  XENP020072 [CTLA-4]_H3.5_L0.12_Fab Light Chain

SEQ ID NO: 5725 - protein, 108 aa, Artificial Sequence; identical to SEQ ID NO: 1517
  Description of Artificial Sequence: Synthetic polypeptide
  VL of XENP020072

SEQ ID NO: 5726 - protein, 12 aa, Artificial Sequence
  Description of Artificial Sequence: Synthetic peptide
  XENP020072 vlCDR1
RASQSVGSSYLA

SEQ ID NO: 5727 - protein, 7 aa, Artificial Sequence
  Description of Artificial Sequence: Synthetic peptide
  XENP020072 vlCDR2
GAFSRAT

SEQ ID NO: 5728 - protein, 9 aa, Artificial Sequence
  Description of Artificial Sequence: Synthetic peptide
  XENP020072 vlCDR3
QQYGSSPWT

SEQ ID NO: 5729 - protein, 221 aa, Artificial Sequence
  Description of Artificial Sequence: Synthetic polypeptide
  XENP020073 [CTLA-4]_H3.6_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5730 - protein, 118 aa, Artificial Sequence; identical to SEQ ID NO: 2479
  Description of Artificial Sequence: Synthetic polypeptide
  VH of XENP020073

SEQ ID NO: 5731 - protein, 5 aa, Artificial Sequence
  Description of Artificial Sequence: Synthetic peptide
  XENP020073 vhCDR1
SYTMH

SEQ ID NO: 5732 - protein, 17 aa, Artificial Sequence
  Description of Artificial Sequence: Synthetic peptide
  XENP020073 vhCDR2
FISYDGNQKYYADSVKG

SEQ ID NO: 5733 - protein, 9 aa, Artificial Sequence
  Description of Artificial Sequence: Synthetic peptide
  XENP020073 vhCDR3
TGHLGPFDL

SEQ ID NO: 5734 - protein, 215 aa, Artificial Sequence; identical to SEQ ID NO: 4404
  Description of Artificial Sequence: Synthetic polypeptide
  XENP020073 [CTLA-4]_H3.6_L0.12_Fab Light Chain

SEQ ID NO: 5735 - protein, 108 aa, Artificial Sequence; identical to SEQ ID NO: 1517
  Description of Artificial Sequence: Synthetic polypeptide
  VL of XENP020073

SEQ ID NO: 5736 - protein, 12 aa, Artificial Sequence
  Description of Artificial Sequence: Synthetic peptide
  XENP020073 vlCDR1
RASQSVGSSYLA

SEQ ID NO: 5737 - protein, 7 aa, Artificial Sequence
  Description of Artificial Sequence: Synthetic peptide
  XENP020073 vlCDR2
GAFSRAT

SEQ ID NO: 5738 - protein, 9 aa, Artificial Sequence
  Description of Artificial Sequence: Synthetic peptide
  XENP020073 vlCDR3
QQYGSSPWT

SEQ ID NO: 5739 - protein, 221 aa, Artificial Sequence
  Description of Artificial Sequence: Synthetic polypeptide
  XENP020074 [CTLA-4]_H3.7_L0.12_Fab Heavy Chain
EVQLVESGGGLVKPGGSLRLSCAASGFTFSSYTMHWVRQAPGKGLEWVCFISYDGNNKYYADSVKGRFTCSRDNAKNSLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5740 - protein, 118 aa, Artificial Sequence; identical to SEQ ID NO: 2488
  Description of Artificial Sequence: Synthetic polypeptide
  VH of XENP020074

SEQ ID NO: 5741 - protein, 5 aa, Artificial Sequence
  Description of Artificial Sequence: Synthetic peptide
  XENP020074 vhCDR1
SYTMH

SEQ ID NO: 5742 - protein, 17 aa, Artificial Sequence
  Description of Artificial Sequence: Synthetic peptide
  XENP020074 vhCDR2
FISYDGNNKYYADSVKG

SEQ ID NO: 5743 - protein, 9 aa, Artificial Sequence
  Description of Artificial Sequence: Synthetic peptide
  XENP020074 vhCDR3
TGWLGPFDY

SEQ ID NO: 5744 - protein, 215 aa, Artificial Sequence; identical to SEQ ID NO: 4404
  Description of Artificial Sequence: Synthetic polypeptide
  XENP020074 [CTLA-4]_H3.7_L0.12_Fab Light Chain

SEQ ID NO: 5745 - protein, 108 aa, Artificial Sequence; identical to SEQ ID NO: 1517
  Description of Artificial Sequence: Synthetic polypeptide
  VL of XENP020074

SEQ ID NO: 5746 - protein, 12 aa, Artificial Sequence
  Description of Artificial Sequence: Synthetic peptide
  XENP020074 vlCDR1
RASQSVGSSYLA

SEQ ID NO: 5747 - protein, 7 aa, Artificial Sequence
  Description of Artificial Sequence: Synthetic peptide
  XENP020074 vlCDR2
GAFSRAT

SEQ ID NO: 5748 - protein, 9 aa, Artificial Sequence
  Description of Artificial Sequence: Synthetic peptide
  XENP020074 vlCDR3
QQYGSSPWT

SEQ ID NO: 5749 - protein, 221 aa, Artificial Sequence
  Description of Artificial Sequence: Synthetic polypeptide
  XENP020323 [CTLA-4]_H3.9_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5750 - protein, 118 aa, Artificial Sequence; identical to SEQ ID NO: 2506
  Description of Artificial Sequence: Synthetic polypeptide
  VH of XENP020323

SEQ ID NO: 5751 - protein, 5 aa, Artificial Sequence
  Description of Artificial Sequence: Synthetic peptide
  XENP020323 vhCDR1
SYTMH

SEQ ID NO: 5752 - protein, 17 aa, Artificial Sequence
  Description of Artificial Sequence: Synthetic peptide
  XENP020323 vhCDR2
FISYDGNYKYYADSVKG

SEQ ID NO: 5753 - protein, 9 aa, Artificial Sequence
  Description of Artificial Sequence: Synthetic peptide
  XENP020323 vhCDR3
TGHLGPFDL

SEQ ID NO: 5754 - protein, 215 aa, Artificial Sequence; identical to SEQ ID NO: 4404
  Description of Artificial Sequence: Synthetic polypeptide
  XENP020323 [CTLA-4]_H3.9_L0.12_Fab Light Chain

SEQ ID NO: 5755 - protein, 108 aa, Artificial Sequence; identical to SEQ ID NO: 1517
  Description of Artificial Sequence: Synthetic polypeptide
  VL of XENP020323

SEQ ID NO: 5756 - protein, 12 aa, Artificial Sequence
  Description of Artificial Sequence: Synthetic peptide
  XENP020323 vlCDR1
RASQSVGSSYLA

SEQ ID NO: 5757 - protein, 7 aa, Artificial Sequence
  Description of Artificial Sequence: Synthetic peptide
  XENP020323 vlCDR2
GAFSRAT

SEQ ID NO: 5758 - protein, 9 aa, Artificial Sequence
  Description of Artificial Sequence: Synthetic peptide
  XENP020323 vlCDR3
QQYGSSPWT

SEQ ID NO: 5759 - protein, 221 aa, Artificial Sequence
  Description of Artificial Sequence: Synthetic polypeptide
  XENP020324 [CTLA-4]_H3.10_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5760 - protein, 118 aa, Artificial Sequence; identical to SEQ ID NO: 2515
  Description of Artificial Sequence: Synthetic polypeptide
  VH of XENP020324

SEQ ID NO: 5761 - protein, 5 aa, Artificial Sequence
  Description of Artificial Sequence: Synthetic peptide
  XENP020324 vhCDR1
SYTMH

SEQ ID NO: 5762 - protein, 17 aa, Artificial Sequence
  Description of Artificial Sequence: Synthetic peptide
  XENP020324 vhCDR2
FISYDGNYKYYADSVKG

SEQ ID NO: 5763 - protein, 9 aa, Artificial Sequence
  Description of Artificial Sequence: Synthetic peptide
  XENP020324 vhCDR3
TGLLGPFDL

SEQ ID NO: 5764 - protein, 215 aa, Artificial Sequence; identical to SEQ ID NO: 4404
  Description of Artificial Sequence: Synthetic polypeptide
  XENP020324 [CTLA-4]_H3.10_L0.12_Fab Light Chain

SEQ ID NO: 5765 - protein, 108 aa, Artificial Sequence; identical to SEQ ID NO: 1517
  Description of Artificial Sequence: Synthetic polypeptide
  VL of XENP020324

SEQ ID NO: 5766 - protein, 12 aa, Artificial Sequence
  Description of Artificial Sequence: Synthetic peptide
  XENP020324 vlCDR1
RASQSVGSSYLA

SEQ ID NO: 5767 - protein, 7 aa, Artificial Sequence
  Description of Artificial Sequence: Synthetic peptide
  XENP020324 vlCDR2
GAFSRAT

SEQ ID NO: 5768 - protein, 9 aa, Artificial Sequence
  Description of Artificial Sequence: Synthetic peptide
  XENP020324 vlCDR3
QQYGSSPWT

SEQ ID NO: 5769 - protein, 221 aa, Artificial Sequence
  Description of Artificial Sequence: Synthetic polypeptide
  XENP020325 [CTLA-4]_H3.11_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5770 - protein, 118 aa, Artificial Sequence; identical to SEQ ID NO: 2524
  Description of Artificial Sequence: Synthetic polypeptide
  VH of XENP020325

SEQ ID NO: 5771 - protein, 5 aa, Artificial Sequence
  Description of Artificial Sequence: Synthetic peptide
  XENP020325 vhCDR1
SYTMH

SEQ ID NO: 5772 - protein, 17 aa, Artificial Sequence
  Description of Artificial Sequence: Synthetic peptide
  XENP020325 vhCDR2
FISYDGNHKYYADSVKG

SEQ ID NO: 5773 - protein, 9 aa, Artificial Sequence
  Description of Artificial Sequence: Synthetic peptide
  XENP020325 vhCDR3
GGHLGPFDL

SEQ ID NO: 5774 - protein, 215 aa, Artificial Sequence; identical to SEQ ID NO: 4404
  Description of Artificial Sequence: Synthetic polypeptide
  XENP020325 [CTLA-4]_H3.11_L0.12_Fab Light Chain

SEQ ID NO: 5775 - protein, 108 aa, Artificial Sequence; identical to SEQ ID NO: 1517
  Description of Artificial Sequence: Synthetic polypeptide
  VL of XENP020325

SEQ ID NO: 5776 - protein, 12 aa, Artificial Sequence
  Description of Artificial Sequence: Synthetic peptide
  XENP020325 vlCDR1
RASQSVGSSYLA

SEQ ID NO: 5777 - protein, 7 aa, Artificial Sequence
  Description of Artificial Sequence: Synthetic peptide
  XENP020325 vlCDR2
GAFSRAT

SEQ ID NO: 5778 - protein, 9 aa, Artificial Sequence
  Description of Artificial Sequence: Synthetic peptide
  XENP020325 vlCDR3
QQYGSSPWT

SEQ ID NO: 5779 - protein, 221 aa, Artificial Sequence
  Description of Artificial Sequence: Synthetic polypeptide
  XENP020326 [CTLA-4]_H3.12_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5780 - protein, 118 aa, Artificial Sequence; identical to SEQ ID NO: 2533
  Description of Artificial Sequence: Synthetic polypeptide
  VH of XENP020326

SEQ ID NO: 5781 - protein, 5 aa, Artificial Sequence
  Description of Artificial Sequence: Synthetic peptide
  XENP020326 vhCDR1
SYTMH

SEQ ID NO: 5782 - protein, 17 aa, Artificial Sequence
  Description of Artificial Sequence: Synthetic peptide
  XENP020326 vhCDR2
FISYDGNHKYYADSVKG

SEQ ID NO: 5783 - protein, 9 aa, Artificial Sequence
  Description of Artificial Sequence: Synthetic peptide
  XENP020326 vhCDR3
TSHLGPFDL

SEQ ID NO: 5784 - protein, 215 aa, Artificial Sequence; identical to SEQ ID NO: 4404
  Description of Artificial Sequence: Synthetic polypeptide
  XENP020326 [CTLA-4]_H3.12_L0.12_Fab Light Chain

SEQ ID NO: 5785 - protein, 108 aa, Artificial Sequence; identical to SEQ ID NO: 1517
  Description of Artificial Sequence: Synthetic polypeptide
  VL of XENP020326

SEQ ID NO: 5786 - protein, 12 aa, Artificial Sequence
  Description of Artificial Sequence: Synthetic peptide
  XENP020326 vlCDR1
RASQSVGSSYLA

SEQ ID NO: 5787 - protein, 7 aa, Artificial Sequence
  Description of Artificial Sequence: Synthetic peptide
  XENP020326 vlCDR2
GAFSRAT

SEQ ID NO: 5788 - protein, 9 aa, Artificial Sequence
  Description of Artificial Sequence: Synthetic peptide
  XENP020326 vlCDR3
QQYGSSPWT

SEQ ID NO: 5789 - protein, 221 aa, Artificial Sequence
  Description of Artificial Sequence: Synthetic polypeptide
  XENP020327 [CTLA-4]_H3.13_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5790 - protein, 118 aa, Artificial Sequence; identical to SEQ ID NO: 2542
  Description of Artificial Sequence: Synthetic polypeptide
  VH of XENP020327

SEQ ID NO: 5791 - protein, 5 aa, Artificial Sequence
  Description of Artificial Sequence: Synthetic peptide
  XENP020327 vhCDR1
SYTMH

SEQ ID NO: 5792 - protein, 17 aa, Artificial Sequence
  Description of Artificial Sequence: Synthetic peptide
  XENP020327 vhCDR2
FISYDGNHKYYADSVKG

SEQ ID NO: 5793 - protein, 9 aa, Artificial Sequence
  Description of Artificial Sequence: Synthetic peptide
  XENP020327 vhCDR3
GGLLGPFDL

SEQ ID NO: 5794 - protein, 215 aa, Artificial Sequence; identical to SEQ ID NO: 4404
  Description of Artificial Sequence: Synthetic polypeptide
  XENP020327 [CTLA-4]_H3.13_L0.12_Fab Light Chain

SEQ ID NO: 5795 - protein, 108 aa, Artificial Sequence; identical to SEQ ID NO: 1517
  Description of Artificial Sequence: Synthetic polypeptide
  VL of XENP020327

SEQ ID NO: 5796 - protein, 12 aa, Artificial Sequence
  Description of Artificial Sequence: Synthetic peptide
  XENP020327 vlCDR1
RASQSVGSSYLA

SEQ ID NO: 5797 - protein, 7 aa, Artificial Sequence
  Description of Artificial Sequence: Synthetic peptide
  XENP020327 vlCDR2
GAFSRAT

SEQ ID NO: 5798 - protein, 9 aa, Artificial Sequence
  Description of Artificial Sequence: Synthetic peptide
  XENP020327 vlCDR3
QQYGSSPWT

SEQ ID NO: 5799 - protein, 221 aa, Artificial Sequence
  Description of Artificial Sequence: Synthetic polypeptide
  XENP020328 [CTLA-4]_H3.14_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5800 - protein, 118 aa, Artificial Sequence; identical to SEQ ID NO: 2551
  Description of Artificial Sequence: Synthetic polypeptide
  VH of XENP020328

SEQ ID NO: 5801 - protein, 5 aa, Artificial Sequence
  Description of Artificial Sequence: Synthetic peptide
  XENP020328 vhCDR1
SYTMH

SEQ ID NO: 5802 - protein, 17 aa, Artificial Sequence
  Description of Artificial Sequence: Synthetic peptide
  XENP020328 vhCDR2
FISYDGNHKYYADSVKG

SEQ ID NO: 5803 - protein, 9 aa, Artificial Sequence
  Description of Artificial Sequence: Synthetic peptide
  XENP020328 vhCDR3
TSLLGPFDL

SEQ ID NO: 5804 - protein, 215 aa, Artificial Sequence; identical to SEQ ID NO: 4404
  Description of Artificial Sequence: Synthetic polypeptide
  XENP020328 [CTLA-4]_H3.14_L0.12_Fab Light Chain

SEQ ID NO: 5805 - protein, 108 aa, Artificial Sequence; identical to SEQ ID NO: 1517
  Description of Artificial Sequence: Synthetic polypeptide
  VL of XENP020328

SEQ ID NO: 5806 - protein, 12 aa, Artificial Sequence
  Description of Artificial Sequence: Synthetic peptide
  XENP020328 vlCDR1
RASQSVGSSYLA

SEQ ID NO: 5807 - protein, 7 aa, Artificial Sequence
  Description of Artificial Sequence: Synthetic peptide
  XENP020328 vlCDR2
GAFSRAT

SEQ ID NO: 5808 - protein, 9 aa, Artificial Sequence
  Description of Artificial Sequence: Synthetic peptide
  XENP020328 vlCDR3
QQYGSSPWT

SEQ ID NO: 5809 - protein, 221 aa, Artificial Sequence
  Description of Artificial Sequence: Synthetic polypeptide
  XENP020329 [CTLA-4]_H3.15_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5810 - protein, 118 aa, Artificial Sequence; identical to SEQ ID NO: 2560
  Description of Artificial Sequence: Synthetic polypeptide
  VH of XENP020329

SEQ ID NO: 5811 - protein, 5 aa, Artificial Sequence
  Description of Artificial Sequence: Synthetic peptide
  XENP020329 vhCDR1
SYTMH

SEQ ID NO: 5812 - protein, 17 aa, Artificial Sequence
  Description of Artificial Sequence: Synthetic peptide
  XENP020329 vhCDR2
FISYDGNQKYYADSVKG

SEQ ID NO: 5813 - protein, 9 aa, Artificial Sequence
  Description of Artificial Sequence: Synthetic peptide
  XENP020329 vhCDR3
GGHLGPFDL

SEQ ID NO: 5814 - protein, 215 aa, Artificial Sequence; identical to SEQ ID NO: 4404
  Description of Artificial Sequence: Synthetic polypeptide
  XENP020329 [CTLA-4]_H3.15_L0.12_Fab Light Chain

SEQ ID NO: 5815 - protein, 108 aa, Artificial Sequence; identical to SEQ ID NO: 1517
  Description of Artificial Sequence: Synthetic polypeptide
  VL of XENP020329

SEQ ID NO: 5816 - protein, 12 aa, Artificial Sequence
  Description of Artificial Sequence: Synthetic peptide
  XENP020329 vlCDR1
RASQSVGSSYLA

SEQ ID NO: 5817 - protein, 7 aa, Artificial Sequence
  Description of Artificial Sequence: Synthetic peptide
  XENP020329 vlCDR2
GAFSRAT

SEQ ID NO: 5818 - protein, 9 aa, Artificial Sequence
  Description of Artificial Sequence: Synthetic peptide
  XENP020329 vlCDR3
QQYGSSPWT

SEQ ID NO: 5819 - protein, 221 aa, Artificial Sequence
  Description of Artificial Sequence: Synthetic polypeptide
  XENP020330 [CTLA-4]_H3.16_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5820 - protein, 118 aa, Artificial Sequence; identical to SEQ ID NO: 2569
  Description of Artificial Sequence: Synthetic polypeptide
  VH of XENP020330

SEQ ID NO: 5821 - protein, 5 aa, Artificial Sequence
  Description of Artificial Sequence: Synthetic peptide
  XENP020330 vhCDR1
SYTMH

SEQ ID NO: 5822 - protein, 17 aa, Artificial Sequence
  Description of Artificial Sequence: Synthetic peptide
  XENP020330 vhCDR2
FISYDGNQKYYADSVKG

SEQ ID NO: 5823 - protein, 9 aa, Artificial Sequence
  Description of Artificial Sequence: Synthetic peptide
  XENP020330 vhCDR3
TSHLGPFDL

SEQ ID NO: 5824 - protein, 215 aa, Artificial Sequence; identical to SEQ ID NO: 4404
  Description of Artificial Sequence: Synthetic polypeptide
  XENP020330 [CTLA-4]_H3.16_L0.12_Fab Light Chain

SEQ ID NO: 5825 - protein, 108 aa, Artificial Sequence; identical to SEQ ID NO: 1517
  Description of Artificial Sequence: Synthetic polypeptide
  VL of XENP020330

SEQ ID NO: 5826 - protein, 12 aa, Artificial Sequence
  Description of Artificial Sequence: Synthetic peptide
  XENP020330 vlCDR1
RASQSVGSSYLA

SEQ ID NO: 5827 - protein, 7 aa, Artificial Sequence
  Description of Artificial Sequence: Synthetic peptide
  XENP020330 vlCDR2
GAFSRAT

SEQ ID NO: 5828 - protein, 9 aa, Artificial Sequence
  Description of Artificial Sequence: Synthetic peptide
  XENP020330 vlCDR3
QQYGSSPWT

SEQ ID NO: 5829 - protein, 221 aa, Artificial Sequence
  Description of Artificial Sequence: Synthetic polypeptide
  XENP020331 [CTLA-4]_H3.17_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5830 - protein, 118 aa, Artificial Sequence; identical to SEQ ID NO: 2578
  Description of Artificial Sequence: Synthetic polypeptide
  VH of XENP020331

SEQ ID NO: 5831 - protein, 5 aa, Artificial Sequence
  Description of Artificial Sequence: Synthetic peptide
  XENP020331 vhCDR1
SYTMH

SEQ ID NO: 5832 - protein, 17 aa, Artificial Sequence
  Description of Artificial Sequence: Synthetic peptide
  XENP020331 vhCDR2
FISYDGNQKYYADSVKG

SEQ ID NO: 5833 - protein, 9 aa, Artificial Sequence
  Description of Artificial Sequence: Synthetic peptide
  XENP020331 vhCDR3
GGLLGPFDL

SEQ ID NO: 5834 - protein, 215 aa, Artificial Sequence; identical to SEQ ID NO: 4404
  Description of Artificial Sequence: Synthetic polypeptide
  XENP020331 [CTLA-4]_H3.17_L0.12_Fab Light Chain

SEQ ID NO: 5835 - protein, 108 aa, Artificial Sequence; identical to SEQ ID NO: 1517
  Description of Artificial Sequence: Synthetic polypeptide
  VL of XENP020331

SEQ ID NO: 5836 - protein, 12 aa, Artificial Sequence
  Description of Artificial Sequence: Synthetic peptide
  XENP020331 vlCDR1
RASQSVGSSYLA

SEQ ID NO: 5837 - protein, 7 aa, Artificial Sequence
  Description of Artificial Sequence: Synthetic peptide
  XENP020331 vlCDR2
GAFSRAT

SEQ ID NO: 5838 - protein, 9 aa, Artificial Sequence
  Description of Artificial Sequence: Synthetic peptide
  XENP020331 vlCDR3
QQYGSSPWT

SEQ ID NO: 5839 - protein, 221 aa, Artificial Sequence
  Description of Artificial Sequence: Synthetic polypeptide
  XENP020332 [CTLA-4]_H3.18_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5840 - protein, 118 aa, Artificial Sequence; identical to SEQ ID NO: 2587
  Description of Artificial Sequence: Synthetic polypeptide
  VH of XENP020332

SEQ ID NO: 5841 - protein, 5 aa, Artificial Sequence
  Description of Artificial Sequence: Synthetic peptide
  XENP020332 vhCDR1
SYTMH

SEQ ID NO: 5842 - protein, 17 aa, Artificial Sequence
  Description of Artificial Sequence: Synthetic peptide
  XENP020332 vhCDR2
FISYDGNQKYYADSVKG

SEQ ID NO: 5843 - protein, 9 aa, Artificial Sequence
  Description of Artificial Sequence: Synthetic peptide
  XENP020332 vhCDR3
TSLLGPFDL

SEQ ID NO: 5844 - protein, 215 aa, Artificial Sequence; identical to SEQ ID NO: 4404
  Description of Artificial Sequence: Synthetic polypeptide
  XENP020332 [CTLA-4]_H3.18_L0.12_Fab Light Chain

SEQ ID NO: 5845 - protein, 108 aa, Artificial Sequence; identical to SEQ ID NO: 1517
  Description of Artificial Sequence: Synthetic polypeptide
  VL of XENP020332

SEQ ID NO: 5846 - protein, 12 aa, Artificial Sequence
  Description of Artificial Sequence: Synthetic peptide
  XENP020332 vlCDR1
RASQSVGSSYLA

SEQ ID NO: 5847 - protein, 7 aa, Artificial Sequence
  Description of Artificial Sequence: Synthetic peptide
  XENP020332 vlCDR2
GAFSRAT

SEQ ID NO: 5848 - protein, 9 aa, Artificial Sequence
  Description of Artificial Sequence: Synthetic peptide
  XENP020332 vlCDR3
QQYGSSPWT

SEQ ID NO: 5849 - protein, 221 aa, Artificial Sequence
  Description of Artificial Sequence: Synthetic polypeptide
  XENP020333 [CTLA-4]_H3.19_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5850 - protein, 118 aa, Artificial Sequence; identical to SEQ ID NO: 2596
  Description of Artificial Sequence: Synthetic polypeptide
  VH of XENP020333

SEQ ID NO: 5851 - protein, 5 aa, Artificial Sequence
  Description of Artificial Sequence: Synthetic peptide
  XENP020333 vhCDR1
SYTMH

SEQ ID NO: 5852 - protein, 17 aa, Artificial Sequence
  Description of Artificial Sequence: Synthetic peptide
  XENP020333 vhCDR2
FISYDGNTKYYADSVKG

SEQ ID NO: 5853 - protein, 9 aa, Artificial Sequence
  Description of Artificial Sequence: Synthetic peptide
  XENP020333 vhCDR3
GGHLGPFDL

SEQ ID NO: 5854 - protein, 215 aa, Artificial Sequence; identical to SEQ ID NO: 4404
  Description of Artificial Sequence: Synthetic polypeptide
  XENP020333 [CTLA-4]_H3.19_L0.12_Fab Light Chain

SEQ ID NO: 5855 - protein, 108 aa, Artificial Sequence; identical to SEQ ID NO: 1517
  Description of Artificial Sequence: Synthetic polypeptide
  VL of XENP020333

SEQ ID NO: 5856 - protein, 12 aa, Artificial Sequence
  Description of Artificial Sequence: Synthetic peptide
  XENP020333 vlCDR1
RASQSVGSSYLA

SEQ ID NO: 5857 - protein, 7 aa, Artificial Sequence
  Description of Artificial Sequence: Synthetic peptide
  XENP020333 vlCDR2
GAFSRAT

SEQ ID NO: 5858 - protein, 9 aa, Artificial Sequence
  Description of Artificial Sequence: Synthetic peptide
  XENP020333 vlCDR3
QQYGSSPWT

SEQ ID NO: 5859 - protein, 221 aa, Artificial Sequence
  Description of Artificial Sequence: Synthetic polypeptide
  XENP020334 [CTLA-4]_H3.20_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5860 - protein, 118 aa, Artificial Sequence; identical to SEQ ID NO: 2605
  Description of Artificial Sequence: Synthetic polypeptide
  VH of XENP020334

SEQ ID NO: 5861 - protein, 5 aa, Artificial Sequence
  Description of Artificial Sequence: Synthetic peptide
  XENP020334 vhCDR1
SYTMH

SEQ ID NO: 5862 - protein, 17 aa, Artificial Sequence
  Description of Artificial Sequence: Synthetic peptide
  XENP020334 vhCDR2
FISYDGNTKYYADSVKG

SEQ ID NO: 5863 - protein, 9 aa, Artificial Sequence
  Description of Artificial Sequence: Synthetic peptide
  XENP020334 vhCDR3
TSHLGPFDL

SEQ ID NO: 5864 - protein, 215 aa, Artificial Sequence; identical to SEQ ID NO: 4404
  Description of Artificial Sequence: Synthetic polypeptide
  XENP020334 [CTLA-4]_H3.20_L0.12_Fab Light Chain

SEQ ID NO: 5865 - protein, 108 aa, Artificial Sequence; identical to SEQ ID NO: 1517
  Description of Artificial Sequence: Synthetic polypeptide
  VL of XENP020334

SEQ ID NO: 5866 - protein, 12 aa, Artificial Sequence
  Description of Artificial Sequence: Synthetic peptide
  XENP020334 vlCDR1
RASQSVGSSYLA

SEQ ID NO: 5867 - protein, 7 aa, Artificial Sequence
  Description of Artificial Sequence: Synthetic peptide
  XENP020334 vlCDR2
GAFSRAT

SEQ ID NO: 5868 - protein, 9 aa, Artificial Sequence
  Description of Artificial Sequence: Synthetic peptide
  XENP020334 vlCDR3
QQYGSSPWT

SEQ ID NO: 5869 - protein, 221 aa, Artificial Sequence
  Description of Artificial Sequence: Synthetic polypeptide
  XENP020335 [CTLA-4]_H3.21_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5870 - protein, 118 aa, Artificial Sequence; identical to SEQ ID NO: 2614
  Description of Artificial Sequence: Synthetic polypeptide
  VH of XENP020335

SEQ ID NO: 5871 - protein, 5 aa, Artificial Sequence
  Description of Artificial Sequence: Synthetic peptide
  XENP020335 vhCDR1
SYTMH

SEQ ID NO: 5872 - protein, 17 aa, Artificial Sequence
  Description of Artificial Sequence: Synthetic peptide
  XENP020335 vhCDR2
FISYDGNTKYYADSVKG

SEQ ID NO: 5873 - protein, 9 aa, Artificial Sequence
  Description of Artificial Sequence: Synthetic peptide
  XENP020335 vhCDR3
GGLLGPFDL

SEQ ID NO: 5874 - protein, 215 aa, Artificial Sequence; identical to SEQ ID NO: 4404
  Description of Artificial Sequence: Synthetic polypeptide
  XENP020335 [CTLA-4]_H3.21_L0.12_Fab Light Chain

SEQ ID NO: 5875 - protein, 108 aa, Artificial Sequence; identical to SEQ ID NO: 1517
  Description of Artificial Sequence: Synthetic polypeptide
  VL of XENP020335

SEQ ID NO: 5876 - protein, 12 aa, Artificial Sequence
  Description of Artificial Sequence: Synthetic peptide
  XENP020335 vlCDR1
RASQSVGSSYLA

SEQ ID NO: 5877 - protein, 7 aa, Artificial Sequence
  Description of Artificial Sequence: Synthetic peptide
  XENP020335 vlCDR2
GAFSRAT

SEQ ID NO: 5878 - protein, 9 aa, Artificial Sequence
  Description of Artificial Sequence: Synthetic peptide
  XENP020335 vlCDR3
QQYGSSPWT

SEQ ID NO: 5879 - protein, 221 aa, Artificial Sequence
  Description of Artificial Sequence: Synthetic polypeptide
  XENP020336 [CTLA-4]_H3.22_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5880 - protein, 118 aa, Artificial Sequence; identical to SEQ ID NO: 2623
  Description of Artificial Sequence: Synthetic polypeptide
  VH of XENP020336

SEQ ID NO: 5881 - protein, 5 aa, Artificial Sequence
  Description of Artificial Sequence: Synthetic peptide
  XENP020336 vhCDR1
SYTMH

SEQ ID NO: 5882 - protein, 17 aa, Artificial Sequence
  Description of Artificial Sequence: Synthetic peptide
  XENP020336 vhCDR2
FISYDGNTKYYADSVKG

SEQ ID NO: 5883 - protein, 9 aa, Artificial Sequence
  Description of Artificial Sequence: Synthetic peptide
  XENP020336 vhCDR3
TSLLGPFDL

SEQ ID NO: 5884 - protein, 215 aa, Artificial Sequence; identical to SEQ ID NO: 4404
  Description of Artificial Sequence: Synthetic polypeptide
  XENP020336 [CTLA-4]_H3.22_L0.12_Fab Light Chain

SEQ ID NO: 5885 - protein, 108 aa, Artificial Sequence; identical to SEQ ID NO: 1517
  Description of Artificial Sequence: Synthetic polypeptide
  VL of XENP020336

SEQ ID NO: 5886 - protein, 12 aa, Artificial Sequence
  Description of Artificial Sequence: Synthetic peptide
  XENP020336 vlCDR1
RASQSVGSSYLA

SEQ ID NO: 5887 - protein, 7 aa, Artificial Sequence
  Description of Artificial Sequence: Synthetic peptide
  XENP020336 vlCDR2
GAFSRAT

SEQ ID NO: 5888 - protein, 9 aa, Artificial Sequence
  Description of Artificial Sequence: Synthetic peptide
  XENP020336 vlCDR3
QQYGSSPWT

SEQ ID NO: 5889 - protein, 221 aa, Artificial Sequence
  Description of Artificial Sequence: Synthetic polypeptide
  XENP020337 [CTLA-4]_H3.23_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5890 - protein, 118 aa, Artificial Sequence; identical to SEQ ID NO: 2632
  Description of Artificial Sequence: Synthetic polypeptide
  VH of XENP020337

SEQ ID NO: 5891 - protein, 5 aa, Artificial Sequence
  Description of Artificial Sequence: Synthetic peptide
  XENP020337 vhCDR1
SYTMH

SEQ ID NO: 5892 - protein, 17 aa, Artificial Sequence
  Description of Artificial Sequence: Synthetic peptide
  XENP020337 vhCDR2
FISYDGNYKYYADSVKG

SEQ ID NO: 5893 - protein, 9 aa, Artificial Sequence
  Description of Artificial Sequence: Synthetic peptide
  XENP020337 vhCDR3
GGHLGPFDL

SEQ ID NO: 5894 - protein, 215 aa, Artificial Sequence; identical to SEQ ID NO: 4404
  Description of Artificial Sequence: Synthetic polypeptide
  XENP020337 [CTLA-4]_H3.23_L0.12_Fab Light Chain

SEQ ID NO: 5895 - protein, 108 aa, Artificial Sequence; identical to SEQ ID NO: 1517
  Description of Artificial Sequence: Synthetic polypeptide
  VL of XENP020337

SEQ ID NO: 5896 - protein, 12 aa, Artificial Sequence
  Description of Artificial Sequence: Synthetic peptide
  XENP020337 vlCDR1
RASQSVGSSYLA

SEQ ID NO: 5897 - protein, 7 aa, Artificial Sequence
  Description of Artificial Sequence: Synthetic peptide
  XENP020337 vlCDR2
GAFSRAT

SEQ ID NO: 5898 - protein, 9 aa, Artificial Sequence
  Description of Artificial Sequence: Synthetic peptide
  XENP020337 vlCDR3
QQYGSSPWT

SEQ ID NO: 5899 - protein, 221 aa, Artificial Sequence
  Description of Artificial Sequence: Synthetic polypeptide
  XENP020338 [CTLA-4]_H3.24_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5900 - protein, 118 aa, Artificial Sequence; identical to SEQ ID NO: 2641
  Description of Artificial Sequence: Synthetic polypeptide
  VH of XENP020338

SEQ ID NO: 5901 - protein, 5 aa, Artificial Sequence
  Description of Artificial Sequence: Synthetic peptide
  XENP020338 vhCDR1
SYTMH

SEQ ID NO: 5902 - protein, 17 aa, Artificial Sequence
  Description of Artificial Sequence: Synthetic peptide
  XENP020338 vhCDR2
FISYDGNYKYYADSVKG

SEQ ID NO: 5903 - protein, 9 aa, Artificial Sequence
  Description of Artificial Sequence: Synthetic peptide
  XENP020338 vhCDR3
TSHLGPFDL

SEQ ID NO: 5904 - protein, 215 aa, Artificial Sequence; identical to SEQ ID NO: 4404
  Description of Artificial Sequence: Synthetic polypeptide
  XENP020338 [CTLA-4]_H3.24_L0.12_Fab Light Chain

SEQ ID NO: 5905 - protein, 108 aa, Artificial Sequence; identical to SEQ ID NO: 1517
  Description of Artificial Sequence: Synthetic polypeptide
  VL of XENP020338

SEQ ID NO: 5906 - protein, 12 aa, Artificial Sequence
  Description of Artificial Sequence: Synthetic peptide
  XENP020338 vlCDR1
RASQSVGSSYLA

SEQ ID NO: 5907 - protein, 7 aa, Artificial Sequence
  Description of Artificial Sequence: Synthetic peptide
  XENP020338 vlCDR2
GAFSRAT

SEQ ID NO: 5908 - protein, 9 aa, Artificial Sequence
  Description of Artificial Sequence: Synthetic peptide
  XENP020338 vlCDR3
QQYGSSPWT

SEQ ID NO: 5909 - protein, 221 aa, Artificial Sequence
  Description of Artificial Sequence: Synthetic polypeptide
  XENP020339 [CTLA-4]_H3.25_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5910 - protein, 118 aa, Artificial Sequence; identical to SEQ ID NO: 2650
  Description of Artificial Sequence: Synthetic polypeptide
  VH of XENP020339

SEQ ID NO: 5911 - protein, 5 aa, Artificial Sequence
  Description of Artificial Sequence: Synthetic peptide
  XENP020339 vhCDR1
SYTMH

SEQ ID NO: 5912 - protein, 17 aa, Artificial Sequence
  Description of Artificial Sequence: Synthetic peptide
  XENP020339 vhCDR2
FISYDGNYKYYADSVKG

SEQ ID NO: 5913 - protein, 9 aa, Artificial Sequence
  Description of Artificial Sequence: Synthetic peptide
  XENP020339 vhCDR3
GGLLGPFDL

SEQ ID NO: 5914 - protein, 215 aa, Artificial Sequence; identical to SEQ ID NO: 4404
  Description of Artificial Sequence: Synthetic polypeptide
  XENP020339 [CTLA-4]_H3.25_L0.12_Fab Light Chain

SEQ ID NO: 5915 - protein, 108 aa, Artificial Sequence; identical to SEQ ID NO: 1517
  Description of Artificial Sequence: Synthetic polypeptide
  VL of XENP020339

SEQ ID NO: 5916 - protein, 12 aa, Artificial Sequence
  Description of Artificial Sequence: Synthetic peptide
  XENP020339 vlCDR1
RASQSVGSSYLA

SEQ ID NO: 5917 - protein, 7 aa, Artificial Sequence
  Description of Artificial Sequence: Synthetic peptide
  XENP020339 vlCDR2
GAFSRAT

SEQ ID NO: 5918 - protein, 9 aa, Artificial Sequence
  Description of Artificial Sequence: Synthetic peptide
  XENP020339 vlCDR3
QQYGSSPWT

SEQ ID NO: 5919 - protein, 221 aa, Artificial Sequence
  Description of Artificial Sequence: Synthetic polypeptide
  XENP020340 [CTLA-4]_H3.26_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5920 - protein, 118 aa, Artificial Sequence; identical to SEQ ID NO: 2659
  Description of Artificial Sequence: Synthetic polypeptide
  VH of XENP020340

SEQ ID NO: 5921 - protein, 5 aa, Artificial Sequence
  Description of Artificial Sequence: Synthetic peptide
  XENP020340 vhCDR1
SYTMH

SEQ ID NO: 5922 - protein, 17 aa, Artificial Sequence
  Description of Artificial Sequence: Synthetic peptide
  XENP020340 vhCDR2
FISYDGNYKYYADSVKG

SEQ ID NO: 5923 - protein, 9 aa, Artificial Sequence
  Description of Artificial Sequence: Synthetic peptide
  XENP020340 vhCDR3
TSLLGPFDL

SEQ ID NO: 5924 - protein, 215 aa, Artificial Sequence; identical to SEQ ID NO: 4404
  Description of Artificial Sequence: Synthetic polypeptide
  XENP020340 [CTLA-4]_H3.26_L0.12_Fab Light Chain

SEQ ID NO: 5925 - protein, 108 aa, Artificial Sequence; identical to SEQ ID NO: 1517
  Description of Artificial Sequence: Synthetic polypeptide
  VL of XENP020340

SEQ ID NO: 5926 - protein, 12 aa, Artificial Sequence
  Description of Artificial Sequence: Synthetic peptide
  XENP020340 vlCDR1
RASQSVGSSYLA

SEQ ID NO: 5927 - protein, 7 aa, Artificial Sequence
  Description of Artificial Sequence: Synthetic peptide
  XENP020340 vlCDR2
GAFSRAT

SEQ ID NO: 5928 - protein, 9 aa, Artificial Sequence
  Description of Artificial Sequence: Synthetic peptide
  XENP020340 vlCDR3
QQYGSSPWT

SEQ ID NO: 5929 - protein, 221 aa, Artificial Sequence; identical to SEQ ID NO: 5709
  Description of Artificial Sequence: Synthetic polypeptide
  XENP020341 [CTLA-4]_H3.4_L0.118_Fab Heavy Chain

SEQ ID NO: 5930 - protein, 118 aa, Artificial Sequence; identical to SEQ ID NO: 2461
  Description of Artificial Sequence: Synthetic polypeptide
  VH of XENP020341

SEQ ID NO: 5931 - protein, 5 aa, Artificial Sequence
  Description of Artificial Sequence: Synthetic peptide
  XENP020341 vhCDR1
SYTMH

SEQ ID NO: 5932 - protein, 17 aa, Artificial Sequence
  Description of Artificial Sequence: Synthetic peptide
  XENP020341 vhCDR2
FISYDGNHKYYADSVKG

SEQ ID NO: 5933 - protein, 9 aa, Artificial Sequence
  Description of Artificial Sequence: Synthetic peptide
  XENP020341 vhCDR3
TGHLGPFDL

SEQ ID NO: 5934 - protein, 215 aa, Artificial Sequence
  Description of Artificial Sequence: Synthetic polypeptide
  XENP020341 [CTLA-4]_H3.4_L0.118_Fab Light Chain
EIVLTQSPATLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5935 - protein, 108 aa, Artificial Sequence; identical to SEQ ID NO: 2669
  Description of Artificial Sequence: Synthetic polypeptide
  VL of XENP020341

SEQ ID NO: 5936 - protein, 12 aa, Artificial Sequence
  Description of Artificial Sequence: Synthetic peptide
  XENP020341 vlCDR1
RASQSVGSSYLA

SEQ ID NO: 5937 - protein, 7 aa, Artificial Sequence
  Description of Artificial Sequence: Synthetic peptide
  XENP020341 vlCDR2
GAFSRAT

SEQ ID NO: 5938 - protein, 9 aa, Artificial Sequence
  Description of Artificial Sequence: Synthetic peptide
  XENP020341 vlCDR3
QQYGSSPWT

SEQ ID NO: 5939 - protein, 221 aa, Artificial Sequence; identical to SEQ ID NO: 5709
  Description of Artificial Sequence: Synthetic polypeptide
  XENP020342 [CTLA-4]_H3.4_L0.119_Fab Heavy Chain

SEQ ID NO: 5940 - protein, 118 aa, Artificial Sequence; identical to SEQ ID NO: 2461
  Description of Artificial Sequence: Synthetic polypeptide
  VH of XENP020342

SEQ ID NO: 5941 - protein, 5 aa, Artificial Sequence
  Description of Artificial Sequence: Synthetic peptide
  XENP020342 vhCDR1
SYTMH

SEQ ID NO: 5942 - protein, 17 aa, Artificial Sequence
  Description of Artificial Sequence: Synthetic peptide
  XENP020342 vhCDR2
FISYDGNHKYYADSVKG

SEQ ID NO: 5943 - protein, 9 aa, Artificial Sequence
  Description of Artificial Sequence: Synthetic peptide
  XENP020342 vhCDR3
TGHLGPFDL

SEQ ID NO: 5944 - protein, 215 aa, Artificial Sequence; identical to SEQ ID NO: 2924
  Description of Artificial Sequence: Synthetic polypeptide
  XENP020342 [CTLA-4]_H3.4_L0.119_Fab Light Chain

SEQ ID NO: 5945 - protein, 108 aa, Artificial Sequence; identical to SEQ ID NO: 23
  Description of Artificial Sequence: Synthetic polypeptide
  VL of XENP020342

SEQ ID NO: 5946 - protein, 12 aa, Artificial Sequence
  Description of Artificial Sequence: Synthetic peptide
  XENP020342 vlCDR1
RASQSVGSSYLA

SEQ ID NO: 5947 - protein, 7 aa, Artificial Sequence
  Description of Artificial Sequence: Synthetic peptide
  XENP020342 vlCDR2
GAFSRAT

SEQ ID NO: 5948 - protein, 9 aa, Artificial Sequence
  Description of Artificial Sequence: Synthetic peptide
  XENP020342 vlCDR3
QQYGSSPWT

SEQ ID NO: 5949 - protein, 221 aa, Artificial Sequence; identical to SEQ ID NO: 5709
  Description of Artificial Sequence: Synthetic polypeptide
  XENP020343 [CTLA-4]_H3.4_L0.120_Fab Heavy Chain

SEQ ID NO: 5950 - protein, 118 aa, Artificial Sequence; identical to SEQ ID NO: 2461
  Description of Artificial Sequence: Synthetic polypeptide
  VH of XENP020343

SEQ ID NO: 5951 - protein, 5 aa, Artificial Sequence
  Description of Artificial Sequence: Synthetic peptide
  XENP020343 vhCDR1
SYTMH

SEQ ID NO: 5952 - protein, 17 aa, Artificial Sequence
  Description of Artificial Sequence: Synthetic peptide
  XENP020343 vhCDR2
FISYDGNHKYYADSVKG

SEQ ID NO: 5953 - protein, 9 aa, Artificial Sequence
  Description of Artificial Sequence: Synthetic peptide
  XENP020343 vhCDR3
TGHLGPFDL

SEQ ID NO: 5954 - protein, 215 aa, Artificial Sequence
  Description of Artificial Sequence: Synthetic polypeptide
  XENP020343 [CTLA-4]_H3.4_L0.120_Fab Light Chain
EIVLTQSPGTLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5955 - protein, 108 aa, Artificial Sequence; identical to SEQ ID NO: 2687
  Description of Artificial Sequence: Synthetic polypeptide
  VL of XENP020343

SEQ ID NO: 5956 - protein, 12 aa, Artificial Sequence
  Description of Artificial Sequence: Synthetic peptide
  XENP020343 vlCDR1
RASQSVSSSYLA

SEQ ID NO: 5957 - protein, 7 aa, Artificial Sequence
  Description of Artificial Sequence: Synthetic peptide
  XENP020343 vlCDR2
GAFSRAT

SEQ ID NO: 5958 - protein, 9 aa, Artificial Sequence
  Description of Artificial Sequence: Synthetic peptide
  XENP020343 vlCDR3
QQYGSSPWT

SEQ ID NO: 5959 - protein, 221 aa, Artificial Sequence; identical to SEQ ID NO: 5709
  Description of Artificial Sequence: Synthetic polypeptide
  XENP020344 [CTLA-4]_H3.4_L0.121_Fab Heavy Chain

SEQ ID NO: 5960 - protein, 118 aa, Artificial Sequence; identical to SEQ ID NO: 2461
  Description of Artificial Sequence: Synthetic polypeptide
  VH of XENP020344

SEQ ID NO: 5961 - protein, 5 aa, Artificial Sequence
  Description of Artificial Sequence: Synthetic peptide
  XENP020344 vhCDR1
SYTMH

SEQ ID NO: 5962 - protein, 17 aa, Artificial Sequence
  Description of Artificial Sequence: Synthetic peptide
  XENP020344 vhCDR2
FISYDGNHKYYADSVKG

SEQ ID NO: 5963 - protein, 9 aa, Artificial Sequence
  Description of Artificial Sequence: Synthetic peptide
  XENP020344 vhCDR3
TGHLGPFDL

SEQ ID NO: 5964 - protein, 215 aa, Artificial Sequence
  Description of Artificial Sequence: Synthetic polypeptide
  XENP020344 [CTLA-4]_H3.4_L0.121_Fab Light Chain
EIVLTQSPGTLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5965 - protein, 108 aa, Artificial Sequence; identical to SEQ ID NO: 2696
  Description of Artificial Sequence: Synthetic polypeptide
  VL of XENP020344

SEQ ID NO: 5966 - protein, 12 aa, Artificial Sequence
  Description of Artificial Sequence: Synthetic peptide
  XENP020344 vlCDR1
RASQSVGSSYLA

SEQ ID NO: 5967 - protein, 7 aa, Artificial Sequence
  Description of Artificial Sequence: Synthetic peptide
  XENP020344 vlCDR2
GASSRAT

SEQ ID NO: 5968 - protein, 9 aa, Artificial Sequence
  Description of Artificial Sequence: Synthetic peptide
  XENP020344 vlCDR3
QQYGSSPWT

SEQ ID NO: 5969 - protein, 221 aa, Artificial Sequence; identical to SEQ ID NO: 5709
  Description of Artificial Sequence: Synthetic polypeptide
  XENP020345 [CTLA-4]_H3.4_L0.122_Fab Heavy Chain

SEQ ID NO: 5970 - protein, 118 aa, Artificial Sequence; identical to SEQ ID NO: 2461
  Description of Artificial Sequence: Synthetic polypeptide
  VH of XENP020345

SEQ ID NO: 5971 - protein, 5 aa, Artificial Sequence
  Description of Artificial Sequence: Synthetic peptide
  XENP020345 vhCDR1
SYTMH

SEQ ID NO: 5972 - protein, 17 aa, Artificial Sequence
  Description of Artificial Sequence: Synthetic peptide
  XENP020345 vhCDR2
FISYDGNHKYYADSVKG

SEQ ID NO: 5973 - protein, 9 aa, Artificial Sequence
  Description of Artificial Sequence: Synthetic peptide
  XENP020345 vhCDR3
TGHLGPFDL

SEQ ID NO: 5974 - protein, 215 aa, Artificial Sequence; identical to SEQ ID NO: 4364
  Description of Artificial Sequence: Synthetic polypeptide
  XENP020345 [CTLA-4]_H3.4_L0.122_Fab Light Chain

SEQ ID NO: 5975 - protein, 108 aa, Artificial Sequence; identical to SEQ ID NO: 1481
  Description of Artificial Sequence: Synthetic polypeptide
  VL of XENP020345

SEQ ID NO: 5976 - protein, 12 aa, Artificial Sequence
  Description of Artificial Sequence: Synthetic peptide
  XENP020345 vlCDR1
RASQSVGSSYLA

SEQ ID NO: 5977 - protein, 7 aa, Artificial Sequence
  Description of Artificial Sequence: Synthetic peptide
  XENP020345 vlCDR2
GAFSRAT

SEQ ID NO: 5978 - protein, 9 aa, Artificial Sequence
  Description of Artificial Sequence: Synthetic peptide
  XENP020345 vlCDR3
QQYGSSPWT

SEQ ID NO: 5979 - protein, 221 aa, Artificial Sequence; identical to SEQ ID NO: 5709
  Description of Artificial Sequence: Synthetic polypeptide
  XENP020346 [CTLA-4]_H3.4_L0.123_Fab Heavy Chain

SEQ ID NO: 5980 - protein, 118 aa, Artificial Sequence; identical to SEQ ID NO: 2461
  Description of Artificial Sequence: Synthetic polypeptide
  VH of XENP020346

SEQ ID NO: 5981 - protein, 5 aa, Artificial Sequence
  Description of Artificial Sequence: Synthetic peptide
  XENP020346 vhCDR1
SYTMH

SEQ ID NO: 5982 - protein, 17 aa, Artificial Sequence
  Description of Artificial Sequence: Synthetic peptide
  XENP020346 vhCDR2
FISYDGNHKYYADSVKG

SEQ ID NO: 5983 - protein, 9 aa, Artificial Sequence
  Description of Artificial Sequence: Synthetic peptide
  XENP020346 vhCDR3
TGHLGPFDL

SEQ ID NO: 5984 - protein, 215 aa, Artificial Sequence
  Description of Artificial Sequence: Synthetic polypeptide
  XENP020346 [CTLA-4]_H3.4_L0.123_Fab Light Chain
EIVLTQSPATLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5985 - protein, 108 aa, Artificial Sequence; identical to SEQ ID NO: 2714
  Description of Artificial Sequence: Synthetic polypeptide
  VL of XENP020346

SEQ ID NO: 5986 - protein, 12 aa, Artificial Sequence
  Description of Artificial Sequence: Synthetic peptide
  XENP020346 vlCDR1
RASQSVSSSYLA

SEQ ID NO: 5987 - protein, 7 aa, Artificial Sequence
  Description of Artificial Sequence: Synthetic peptide
  XENP020346 vlCDR2
GAFSRAT

SEQ ID NO: 5988 - protein, 9 aa, Artificial Sequence
  Description of Artificial Sequence: Synthetic peptide
  XENP020346 vlCDR3
QQYGSSPWT

SEQ ID NO: 5989 - protein, 221 aa, Artificial Sequence; identical to SEQ ID NO: 5709
  Description of Artificial Sequence: Synthetic polypeptide
  XENP020347 [CTLA-4]_H3.4_L0.124_Fab Heavy Chain

SEQ ID NO: 5990 - protein, 118 aa, Artificial Sequence; identical to SEQ ID NO: 2461
  Description of Artificial Sequence: Synthetic polypeptide
  VH of XENP020347

SEQ ID NO: 5991 - protein, 5 aa, Artificial Sequence
  Description of Artificial Sequence: Synthetic peptide
  XENP020347 vhCDR1
SYTMH

SEQ ID NO: 5992 - protein, 17 aa, Artificial Sequence
  Description of Artificial Sequence: Synthetic peptide
  XENP020347 vhCDR2
FISYDGNHKYYADSVKG

SEQ ID NO: 5993 - protein, 9 aa, Artificial Sequence
  Description of Artificial Sequence: Synthetic peptide
  XENP020347 vhCDR3
TGHLGPFDL

SEQ ID NO: 5994 - protein, 215 aa, Artificial Sequence
  Description of Artificial Sequence: Synthetic polypeptide
  XENP020347 [CTLA-4]_H3.4_L0.124_Fab Light Chain
EIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5995 - protein, 108 aa, Artificial Sequence; identical to SEQ ID NO: 2723
  Description of Artificial Sequence: Synthetic polypeptide
  VL of XENP020347

SEQ ID NO: 5996 - protein, 12 aa, Artificial Sequence
  Description of Artificial Sequence: Synthetic peptide
  XENP020347 vlCDR1
RASQSVGSSYLA

SEQ ID NO: 5997 - protein, 7 aa, Artificial Sequence
  Description of Artificial Sequence: Synthetic peptide
  XENP020347 vlCDR2
GASSRAT

SEQ ID NO: 5998 - protein, 9 aa, Artificial Sequence
  Description of Artificial Sequence: Synthetic peptide
  XENP020347 vlCDR3
QQYGSSPWT

SEQ ID NO: 5999 - protein, 221 aa, Artificial Sequence; identical to SEQ ID NO: 5709
  Description of Artificial Sequence: Synthetic polypeptide
  XENP020348 [CTLA-4]_H3.4_L0.125_Fab Heavy Chain

SEQ ID NO: 6000 - protein, 118 aa, Artificial Sequence; identical to SEQ ID NO: 2461
  Description of Artificial Sequence: Synthetic polypeptide
  VH of XENP020348

SEQ ID NO: 6001 - protein, 5 aa, Artificial Sequence
  Description of Artificial Sequence: Synthetic peptide
  XENP020348 vhCDR1
SYTMH

SEQ ID NO: 6002 - protein, 17 aa, Artificial Sequence
  Description of Artificial Sequence: Synthetic peptide
  XENP020348 vhCDR2
FISYDGNHKYYADSVKG

SEQ ID NO: 6003 - protein, 9 aa, Artificial Sequence
  Description of Artificial Sequence: Synthetic peptide
  XENP020348 vhCDR3
TGHLGPFDL

SEQ ID NO: 6004 - protein, 215 aa, Artificial Sequence; identical to SEQ ID NO: 4504
  Description of Artificial Sequence: Synthetic polypeptide
  XENP020348 [CTLA-4]_H3.4_L0.125_Fab Light Chain

SEQ ID NO: 6005 - protein, 108 aa, Artificial Sequence; identical to SEQ ID NO: 1607
  Description of Artificial Sequence: Synthetic polypeptide
  VL of XENP020348

SEQ ID NO: 6006 - protein, 12 aa, Artificial Sequence
  Description of Artificial Sequence: Synthetic peptide
  XENP020348 vlCDR1
RASQSVSSSYLA

SEQ ID NO: 6007 - protein, 7 aa, Artificial Sequence
  Description of Artificial Sequence: Synthetic peptide
  XENP020348 vlCDR2
GAFSRAT

SEQ ID NO: 6008 - protein, 9 aa, Artificial Sequence
  Description of Artificial Sequence: Synthetic peptide
  XENP020348 vlCDR3
QQYGSSPWT

SEQ ID NO: 6009 - protein, 221 aa, Artificial Sequence; identical to SEQ ID NO: 5709
  Description of Artificial Sequence: Synthetic polypeptide
  XENP020349 [CTLA-4]_H3.4_L0.126_Fab Heavy Chain

SEQ ID NO: 6010 - protein, 118 aa, Artificial Sequence; identical to SEQ ID NO: 2461
  Description of Artificial Sequence: Synthetic polypeptide
  VH of XENP020349

SEQ ID NO: 6011 - protein, 5 aa, Artificial Sequence
  Description of Artificial Sequence: Synthetic peptide
  XENP020349 vhCDR1
SYTMH

SEQ ID NO: 6012 - protein, 17 aa, Artificial Sequence
  Description of Artificial Sequence: Synthetic peptide
  XENP020349 vhCDR2
FISYDGNHKYYADSVKG

SEQ ID NO: 6013 - protein, 9 aa, Artificial Sequence
  Description of Artificial Sequence: Synthetic peptide
  XENP020349 vhCDR3
TGHLGPFDL

SEQ ID NO: 6014 - protein, 215 aa, Artificial Sequence; identical to SEQ ID NO: 5014
  Description of Artificial Sequence: Synthetic polypeptide
  XENP020349 [CTLA-4]_H3.4_L0.126_Fab Light Chain

SEQ ID NO: 6015 - protein, 108 aa, Artificial Sequence; identical to SEQ ID NO: 2066
  Description of Artificial Sequence: Synthetic polypeptide
  VL of XENP020349

SEQ ID NO: 6016 - protein, 12 aa, Artificial Sequence
  Description of Artificial Sequence: Synthetic peptide
  XENP020349 vlCDR1
RASQSVGSSYLA

SEQ ID NO: 6017 - protein, 7 aa, Artificial Sequence
  Description of Artificial Sequence: Synthetic peptide
  XENP020349 vlCDR2
GASSRAT

SEQ ID NO: 6018 - protein, 9 aa, Artificial Sequence
  Description of Artificial Sequence: Synthetic peptide
  XENP020349 vlCDR3
QQYGSSPWT

SEQ ID NO: 6019 - protein, 221 aa, Artificial Sequence; identical to SEQ ID NO: 5709
  Description of Artificial Sequence: Synthetic polypeptide
  XENP020350 [CTLA-4]_H3.4_L0.127_Fab Heavy Chain

SEQ ID NO: 6020 - protein, 118 aa, Artificial Sequence; identical to SEQ ID NO: 2461
  Description of Artificial Sequence: Synthetic polypeptide
  VH of XENP020350

SEQ ID NO: 6021 - protein, 5 aa, Artificial Sequence
  Description of Artificial Sequence: Synthetic peptide
  XENP020350 vhCDR1
SYTMH

SEQ ID NO: 6022 - protein, 17 aa, Artificial Sequence
  Description of Artificial Sequence: Synthetic peptide
  XENP020350 vhCDR2
FISYDGNHKYYADSVKG

SEQ ID NO: 6023 - protein, 9 aa, Artificial Sequence
  Description of Artificial Sequence: Synthetic peptide
  XENP020350 vhCDR3
TGHLGPFDL

SEQ ID NO: 6024 - protein, 215 aa, Artificial Sequence
  Description of Artificial Sequence: Synthetic polypeptide
  XENP020350 [CTLA-4]_H3.4_L0.127_Fab Light Chain
EIVLTQSPGTLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6025 - protein, 108 aa, Artificial Sequence; identical to SEQ ID NO: 2750
  Description of Artificial Sequence: Synthetic polypeptide
  VL of XENP020350

SEQ ID NO: 6026 - protein, 12 aa, Artificial Sequence
  Description of Artificial Sequence: Synthetic peptide
  XENP020350 vlCDR1
RASQSVSSSYLA

SEQ ID NO: 6027 - protein, 7 aa, Artificial Sequence
  Description of Artificial Sequence: Synthetic peptide
  XENP020350 vlCDR2
GASSRAT

SEQ ID NO: 6028 - protein, 9 aa, Artificial Sequence
  Description of Artificial Sequence: Synthetic peptide
  XENP020350 vlCDR3
QQYGSSPWT

SEQ ID NO: 6029 - protein, 221 aa, Artificial Sequence; identical to SEQ ID NO: 5709
  Description of Artificial Sequence: Synthetic polypeptide
  XENP020351 [CTLA-4]_H3.4_L0.128_Fab Heavy Chain

SEQ ID NO: 6030 - protein, 118 aa, Artificial Sequence; identical to SEQ ID NO: 2461
  Description of Artificial Sequence: Synthetic polypeptide
  VH of XENP020351

SEQ ID NO: 6031 - protein, 5 aa, Artificial Sequence
  Description of Artificial Sequence: Synthetic peptide
  XENP020351 vhCDR1
SYTMH

SEQ ID NO: 6032 - protein, 17 aa, Artificial Sequence
  Description of Artificial Sequence: Synthetic peptide
  XENP020351 vhCDR2
FISYDGNHKYYADSVKG

SEQ ID NO: 6033 - protein, 9 aa, Artificial Sequence
  Description of Artificial Sequence: Synthetic peptide
  XENP020351 vhCDR3
TGHLGPFDL

SEQ ID NO: 6034 - protein, 215 aa, Artificial Sequence
  Description of Artificial Sequence: Synthetic polypeptide
  XENP020351 [CTLA-4]_H3.4_L0.128_Fab Light Chain
EIVLTQSPATLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6035 - protein, 108 aa, Artificial Sequence; identical to SEQ ID NO: 2759
  Description of Artificial Sequence: Synthetic polypeptide
  VL of XENP020351

SEQ ID NO: 6036 - protein, 12 aa, Artificial Sequence
  Description of Artificial Sequence: Synthetic peptide
  XENP020351 vlCDR1
RASQSVSSSYLA

SEQ ID NO: 6037 - protein, 7 aa, Artificial Sequence
  Description of Artificial Sequence: Synthetic peptide
  XENP020351 vlCDR2
GAFSRAT

SEQ ID NO: 6038 - protein, 9 aa, Artificial Sequence
  Description of Artificial Sequence: Synthetic peptide
  XENP020351 vlCDR3
QQYGSSPWT

SEQ ID NO: 6039 - protein, 221 aa, Artificial Sequence; identical to SEQ ID NO: 5709
  Description of Artificial Sequence: Synthetic polypeptide
  XENP020352 [CTLA-4]_H3.4_L0.129_Fab Heavy Chain

SEQ ID NO: 6040 - protein, 118 aa, Artificial Sequence; identical to SEQ ID NO: 2461
  Description of Artificial Sequence: Synthetic polypeptide
  VH of XENP020352

SEQ ID NO: 6041 - protein, 5 aa, Artificial Sequence
  Description of Artificial Sequence: Synthetic peptide
  XENP020352 vhCDR1
SYTMH

SEQ ID NO: 6042 - protein, 17 aa, Artificial Sequence
  Description of Artificial Sequence: Synthetic peptide
  XENP020352 vhCDR2
FISYDGNHKYYADSVKG

SEQ ID NO: 6043 - protein, 9 aa, Artificial Sequence
  Description of Artificial Sequence: Synthetic peptide
  XENP020352 vhCDR3
TGHLGPFDL

SEQ ID NO: 6044 - protein, 215 aa, Artificial Sequence
  Description of Artificial Sequence: Synthetic polypeptide
  XENP020352 [CTLA-4]_H3.4_L0.129_Fab Light Chain
EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6045 - protein, 108 aa, Artificial Sequence; identical to SEQ ID NO: 2768
  Description of Artificial Sequence: Synthetic polypeptide
  VL of XENP020352

SEQ ID NO: 6046 - protein, 12 aa, Artificial Sequence
  Description of Artificial Sequence: Synthetic peptide
  XENP020352 vlCDR1
RASQSVGSSYLA

SEQ ID NO: 6047 - protein, 7 aa, Artificial Sequence
  Description of Artificial Sequence: Synthetic peptide
  XENP020352 vlCDR2
GASSRAT

SEQ ID NO: 6048 - protein, 9 aa, Artificial Sequence
  Description of Artificial Sequence: Synthetic peptide
  XENP020352 vlCDR3
QQYGSSPWT

SEQ ID NO: 6049 - protein, 221 aa, Artificial Sequence; identical to SEQ ID NO: 5709
  Description of Artificial Sequence: Synthetic polypeptide
  XENP020353 [CTLA-4]_H3.4_L0.130_Fab Heavy Chain

SEQ ID NO: 6050 - protein, 118 aa, Artificial Sequence; identical to SEQ ID NO: 2461
  Description of Artificial Sequence: Synthetic polypeptide
  VH of XENP020353

SEQ ID NO: 6051 - protein, 5 aa, Artificial Sequence
  Description of Artificial Sequence: Synthetic peptide
  XENP020353 vhCDR1
SYTMH

SEQ ID NO: 6052 - protein, 17 aa, Artificial Sequence
  Description of Artificial Sequence: Synthetic peptide
  XENP020353 vhCDR2
FISYDGNHKYYADSVKG

SEQ ID NO: 6053 - protein, 9 aa, Artificial Sequence
  Description of Artificial Sequence: Synthetic peptide
  XENP020353 vhCDR3
TGHLGPFDL

SEQ ID NO: 6054 - protein, 215 aa, Artificial Sequence
  Description of Artificial Sequence: Synthetic polypeptide
  XENP020353 [CTLA-4]_H3.4_L0.130_Fab Light Chain
EIVLTQSPATLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6055 - protein, 108 aa, Artificial Sequence; identical to SEQ ID NO: 2777
  Description of Artificial Sequence: Synthetic polypeptide
  VL of XENP020353

SEQ ID NO: 6056 - protein, 12 aa, Artificial Sequence
  Description of Artificial Sequence: Synthetic peptide
  XENP020353 vlCDR1
RASQSVSSSYLA

SEQ ID NO: 6057 - protein, 7 aa, Artificial Sequence
  Description of Artificial Sequence: Synthetic peptide
  XENP020353 vlCDR2
GASSRAT

SEQ ID NO: 6058 - protein, 9 aa, Artificial Sequence
  Description of Artificial Sequence: Synthetic peptide
  XENP020353 vlCDR3
QQYGSSPWT

SEQ ID NO: 6059 - protein, 221 aa, Artificial Sequence; identical to SEQ ID NO: 5709
  Description of Artificial Sequence: Synthetic polypeptide
  XENP020354 [CTLA-4]_H3.4_L0.131_Fab Heavy Chain

SEQ ID NO: 6060 - protein, 118 aa, Artificial Sequence; identical to SEQ ID NO: 2461
  Description of Artificial Sequence: Synthetic polypeptide
  VH of XENP020354

SEQ ID NO: 6061 - protein, 5 aa, Artificial Sequence
  Description of Artificial Sequence: Synthetic peptide
  XENP020354 vhCDR1
SYTMH

SEQ ID NO: 6062 - protein, 17 aa, Artificial Sequence
  Description of Artificial Sequence: Synthetic peptide
  XENP020354 vhCDR2
FISYDGNHKYYADSVKG

SEQ ID NO: 6063 - protein, 9 aa, Artificial Sequence
  Description of Artificial Sequence: Synthetic peptide
  XENP020354 vhCDR3
TGHLGPFDL

SEQ ID NO: 6064 - protein, 215 aa, Artificial Sequence
  Description of Artificial Sequence: Synthetic polypeptide
  XENP020354 [CTLA-4]_H3.4_L0.131_Fab Light Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6065 - protein, 108 aa, Artificial Sequence; identical to SEQ ID NO: 2786
  Description of Artificial Sequence: Synthetic polypeptide
  VL of XENP020354

SEQ ID NO: 6066 - protein, 12 aa, Artificial Sequence
  Description of Artificial Sequence: Synthetic peptide
  XENP020354 vlCDR1
RASQSVSSSYLA

SEQ ID NO: 6067 - protein, 7 aa, Artificial Sequence
  Description of Artificial Sequence: Synthetic peptide
  XENP020354 vlCDR2
GASSRAT

SEQ ID NO: 6068 - protein, 9 aa, Artificial Sequence
  Description of Artificial Sequence: Synthetic peptide
  XENP020354 vlCDR3
QQYGSSPWT

SEQ ID NO: 6069 - protein, 221 aa, Artificial Sequence; identical to SEQ ID NO: 5709
  Description of Artificial Sequence: Synthetic polypeptide
  XENP020355 [CTLA-4]_H3.4_L0.132_Fab Heavy Chain

SEQ ID NO: 6070 - protein, 118 aa, Artificial Sequence; identical to SEQ ID NO: 2461
  Description of Artificial Sequence: Synthetic polypeptide
  VH of XENP020355

SEQ ID NO: 6071 - protein, 5 aa, Artificial Sequence
  Description of Artificial Sequence: Synthetic peptide
  XENP020355 vhCDR1
SYTMH

SEQ ID NO: 6072 - protein, 17 aa, Artificial Sequence
  Description of Artificial Sequence: Synthetic peptide
  XENP020355 vhCDR2
FISYDGNHKYYADSVKG

SEQ ID NO: 6073 - protein, 9 aa, Artificial Sequence
  Description of Artificial Sequence: Synthetic peptide
  XENP020355 vhCDR3
TGHLGPFDL

SEQ ID NO: 6074 - protein, 215 aa, Artificial Sequence
  Description of Artificial Sequence: Synthetic polypeptide
  XENP020355 [CTLA-4]_H3.4_L0.132_Fab Light Chain
EIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6075 - protein, 108 aa, Artificial Sequence; identical to SEQ ID NO: 2795
  Description of Artificial Sequence: Synthetic polypeptide
  VL of XENP020355

SEQ ID NO: 6076 - protein, 12 aa, Artificial Sequence
  Description of Artificial Sequence: Synthetic peptide
  XENP020355 vlCDR1
RASQSVSSSYLA

SEQ ID NO: 6077 - protein, 7 aa, Artificial Sequence
  Description of Artificial Sequence: Synthetic peptide
  XENP020355 vlCDR2
GASSRAT

SEQ ID NO: 6078 - protein, 9 aa, Artificial Sequence
  Description of Artificial Sequence: Synthetic peptide
  XENP020355 vlCDR3
QQYGSSPWT

SEQ ID NO: 6079 - protein, 221 aa, Artificial Sequence; identical to SEQ ID NO: 5719
  Description of Artificial Sequence: Synthetic polypeptide
  XENP020356 [CTLA-4]_H3.5_L2_Fab Heavy Chain

SEQ ID NO: 6080 - protein, 118 aa, Artificial Sequence; identical to SEQ ID NO: 2470
  Description of Artificial Sequence: Synthetic polypeptide
  VH of XENP020356

SEQ ID NO: 6081 - protein, 5 aa, Artificial Sequence
  Description of Artificial Sequence: Synthetic peptide
  XENP020356 vhCDR1
SYTMH

SEQ ID NO: 6082 - protein, 17 aa, Artificial Sequence
  Description of Artificial Sequence: Synthetic peptide
  XENP020356 vhCDR2
FISYDGNTKYYADSVKG

SEQ ID NO: 6083 - protein, 9 aa, Artificial Sequence
  Description of Artificial Sequence: Synthetic peptide
  XENP020356 vhCDR3
TGHLGPFDL

SEQ ID NO: 6084 - protein, 215 aa, Artificial Sequence; identical to SEQ ID NO: 5474
  Description of Artificial Sequence: Synthetic polypeptide
  XENP020356 [CTLA-4]_H3.5_L2_Fab Light Chain

SEQ ID NO: 6085 - protein, 108 aa, Artificial Sequence; identical to SEQ ID NO: 167
  Description of Artificial Sequence: Synthetic polypeptide
  VL of XENP020356

SEQ ID NO: 6086 - protein, 12 aa, Artificial Sequence
  Description of Artificial Sequence: Synthetic peptide
  XENP020356 vlCDR1
RASQSVGSSYLA

SEQ ID NO: 6087 - protein, 7 aa, Artificial Sequence
  Description of Artificial Sequence: Synthetic peptide
  XENP020356 vlCDR2
GAFSRAT

SEQ ID NO: 6088 - protein, 9 aa, Artificial Sequence
  Description of Artificial Sequence: Synthetic peptide
  XENP020356 vlCDR3
QQYGSSPWT

SEQ ID NO: 6089 - protein, 221 aa, Artificial Sequence; identical to SEQ ID NO: 5719
  Description of Artificial Sequence: Synthetic polypeptide
  XENP020357 [CTLA-4]_H3.5_L2.1_Fab Heavy Chain

SEQ ID NO: 6090 - protein, 118 aa, Artificial Sequence; identical to SEQ ID NO: 2470
  Description of Artificial Sequence: Synthetic polypeptide
  VH of XENP020357

SEQ ID NO: 6091 - protein, 5 aa, Artificial Sequence
  Description of Artificial Sequence: Synthetic peptide
  XENP020357 vhCDR1
SYTMH

SEQ ID NO: 6092 - protein, 17 aa, Artificial Sequence
  Description of Artificial Sequence: Synthetic peptide
  XENP020357 vhCDR2
FISYDGNTKYYADSVKG

SEQ ID NO: 6093 - protein, 9 aa, Artificial Sequence
  Description of Artificial Sequence: Synthetic peptide
  XENP020357 vhCDR3
TGHLGPFDL

SEQ ID NO: 6094 - protein, 215 aa, Artificial Sequence
  Description of Artificial Sequence: Synthetic polypeptide
  XENP020357 [CTLA-4]_H3.5_L2.1_Fab Light Chain
EIVMTQSPATLSVSPGERATLSCRASQSVSSSYLAWYQQKPGQAPRLLIYGAFSRATGIPARFSGSGSGTEFTLTISSLQSEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6095 - protein, 108 aa, Artificial Sequence; identical to SEQ ID NO: 2813
  Description of Artificial Sequence: Synthetic polypeptide
  VL of XENP020357

SEQ ID NO: 6096 - protein, 12 aa, Artificial Sequence
  Description of Artificial Sequence: Synthetic peptide
  XENP020357 vlCDR1
RASQSVSSSYLA

SEQ ID NO: 6097 - protein, 7 aa, Artificial Sequence
  Description of Artificial Sequence: Synthetic peptide
  XENP020357 vlCDR2
GAFSRAT

SEQ ID NO: 6098 - protein, 9 aa, Artificial Sequence
  Description of Artificial Sequence: Synthetic peptide
  XENP020357 vlCDR3
QQYGSSPWT

SEQ ID NO: 6099 - protein, 221 aa, Artificial Sequence; identical to SEQ ID NO: 5719
  Description of Artificial Sequence: Synthetic polypeptide
  XENP020358 [CTLA-4]_H3.5_L2.2_Fab Heavy Chain

SEQ ID NO: 6100 - protein, 118 aa, Artificial Sequence; identical to SEQ ID NO: 2470
  Description of Artificial Sequence: Synthetic polypeptide
  VH of XENP020358

SEQ ID NO: 6101 - protein, 5 aa, Artificial Sequence
  Description of Artificial Sequence: Synthetic peptide
  XENP020358 vhCDR1
SYTMH

SEQ ID NO: 6102 - protein, 17 aa, Artificial Sequence
  Description of Artificial Sequence: Synthetic peptide
  XENP020358 vhCDR2
FISYDGNTKYYADSVKG

SEQ ID NO: 6103 - protein, 9 aa, Artificial Sequence
  Description of Artificial Sequence: Synthetic peptide
  XENP020358 vhCDR3
TGHLGPFDL

SEQ ID NO: 6104 - protein, 215 aa, Artificial Sequence
  Description of Artificial Sequence: Synthetic polypeptide
  XENP020358 [CTLA-4]_H3.5_L2.2_Fab Light Chain
EIVMTQSPATLSVSPGERATLSCRASQSVGSSYLAWYQQKPGQAPRLLIYGASSRATGIPARFSGSGSGTEFTLTISSLQSEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6105 - protein, 108 aa, Artificial Sequence; identical to SEQ ID NO: 2822
  Description of Artificial Sequence: Synthetic polypeptide
  VL of XENP020358

SEQ ID NO: 6106 - protein, 12 aa, Artificial Sequence
  Description of Artificial Sequence: Synthetic peptide
  XENP020358 vlCDR1
RASQSVGSSYLA

SEQ ID NO: 6107 - protein, 7 aa, Artificial Sequence
  Description of Artificial Sequence: Synthetic peptide
  XENP020358 vlCDR2
GASSRAT

SEQ ID NO: 6108 - protein, 9 aa, Artificial Sequence
  Description of Artificial Sequence: Synthetic peptide
  XENP020358 vlCDR3
QQYGSSPWT

SEQ ID NO: 6109 - protein, 221 aa, Artificial Sequence; identical to SEQ ID NO: 5719
  Description of Artificial Sequence: Synthetic polypeptide
  XENP020359 [CTLA-4]_H3.5_L2.3_Fab Heavy Chain

SEQ ID NO: 6110 - protein, 118 aa, Artificial Sequence; identical to SEQ ID NO: 2470
  Description of Artificial Sequence: Synthetic polypeptide
  VH of XENP020359

SEQ ID NO: 6111 - protein, 5 aa, Artificial Sequence
  Description of Artificial Sequence: Synthetic peptide
  XENP020359 vhCDR1
SYTMH

SEQ ID NO: 6112 - protein, 17 aa, Artificial Sequence
  Description of Artificial Sequence: Synthetic peptide
  XENP020359 vhCDR2
FISYDGNTKYYADSVKG

SEQ ID NO: 6113 - protein, 9 aa, Artificial Sequence
  Description of Artificial Sequence: Synthetic peptide
  XENP020359 vhCDR3
TGHLGPFDL

SEQ ID NO: 6114 - protein, 215 aa, Artificial Sequence
  Description of Artificial Sequence: Synthetic polypeptide
  XENP020359 [CTLA-4]_H3.5_L2.3_Fab Light Chain
EIVMTQSPATLSVSPGERATLSCRASQSVSSSYLAWYQQKPGQAPRLLIYGASSRATGIPARFSGSGSGTEFTLTISSLQSEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6115 - protein, 108 aa, Artificial Sequence; identical to SEQ ID NO: 2831
  Description of Artificial Sequence: Synthetic polypeptide
  VL of XENP020359

SEQ ID NO: 6116 - protein, 12 aa, Artificial Sequence
  Description of Artificial Sequence: Synthetic peptide
  XENP020359 vlCDR1
RASQSVSSSYLA

SEQ ID NO: 6117 - protein, 7 aa, Artificial Sequence
  Description of Artificial Sequence: Synthetic peptide
  XENP020359 vlCDR2
GASSRAT

SEQ ID NO: 6118 - protein, 9 aa, Artificial Sequence
  Description of Artificial Sequence: Synthetic peptide
  XENP020359 vlCDR3
QQYGSSPWT

SEQ ID NO: 6119 - protein, 221 aa, Artificial Sequence; identical to SEQ ID NO: 5869
  Description of Artificial Sequence: Synthetic polypeptide
  XENP020422 [CTLA-4]_H3.21_L0.124_Fab Heavy Chain

SEQ ID NO: 6120 - protein, 118 aa, Artificial Sequence; identical to SEQ ID NO: 2614
  Description of Artificial Sequence: Synthetic polypeptide
  VH of XENP020422

SEQ ID NO: 6121 - protein, 5 aa, Artificial Sequence
  Description of Artificial Sequence: Synthetic peptide
  XENP020422 vhCDR1
SYTMH

SEQ ID NO: 6122 - protein, 17 aa, Artificial Sequence
  Description of Artificial Sequence: Synthetic peptide
  XENP020422 vhCDR2
FISYDGNTKYYADSVKG

SEQ ID NO: 6123 - protein, 9 aa, Artificial Sequence
  Description of Artificial Sequence: Synthetic peptide
  XENP020422 vhCDR3
GGLLGPFDL

SEQ ID NO: 6124 - protein, 215 aa, Artificial Sequence; identical to SEQ ID NO: 5994
  Description of Artificial Sequence: Synthetic polypeptide
  XENP020422 [CTLA-4]_H3.21_L0.124_Fab Light Chain

SEQ ID NO: 6125 - protein, 108 aa, Artificial Sequence; identical to SEQ ID NO: 2723
  Description of Artificial Sequence: Synthetic polypeptide
  VL of XENP020422

SEQ ID NO: 6126 - protein, 12 aa, Artificial Sequence
  Description of Artificial Sequence: Synthetic peptide
  XENP020422 vlCDR1
RASQSVGSSYLA

SEQ ID NO: 6127 - protein, 7 aa, Artificial Sequence
  Description of Artificial Sequence: Synthetic peptide
  XENP020422 vlCDR2
GASSRAT

SEQ ID NO: 6128 - protein, 9 aa, Artificial Sequence
  Description of Artificial Sequence: Synthetic peptide
  XENP020422 vlCDR3
QQYGSSPWT

SEQ ID NO: 6129 - protein, 221 aa, Artificial Sequence; identical to SEQ ID NO: 5869
  Description of Artificial Sequence: Synthetic polypeptide
  XENP020423 [CTLA-4]_H3.21_L0.129_Fab Heavy Chain

SEQ ID NO: 6130 - protein, 118 aa, Artificial Sequence; identical to SEQ ID NO: 2614
  Description of Artificial Sequence: Synthetic polypeptide
  VH of XENP020423

SEQ ID NO: 6131 - protein, 5 aa, Artificial Sequence
  Description of Artificial Sequence: Synthetic peptide
  XENP020423 vhCDR1
SYTMH

SEQ ID NO: 6132 - protein, 17 aa, Artificial Sequence
  Description of Artificial Sequence: Synthetic peptide
  XENP020423 vhCDR2
FISYDGNTKYYADSVKG

SEQ ID NO: 6133 - protein, 9 aa, Artificial Sequence
  Description of Artificial Sequence: Synthetic peptide
  XENP020423 vhCDR3
GGLLGPFDL

SEQ ID NO: 6134 - protein, 215 aa, Artificial Sequence; identical to SEQ ID NO: 6044
  Description of Artificial Sequence: Synthetic polypeptide
  XENP020423 [CTLA-4]_H3.21_L0.129_Fab Light Chain

SEQ ID NO: 6135 - protein, 108 aa, Artificial Sequence; identical to SEQ ID NO: 2768
  Description of Artificial Sequence: Synthetic polypeptide
  VL of XENP020423

SEQ ID NO: 6136 - protein, 12 aa, Artificial Sequence
  Description of Artificial Sequence: Synthetic peptide
  XENP020423 vlCDR1
RASQSVGSSYLA

SEQ ID NO: 6137 - protein, 7 aa, Artificial Sequence
  Description of Artificial Sequence: Synthetic peptide
  XENP020423 vlCDR2
GASSRAT

SEQ ID NO: 6138 - protein, 9 aa, Artificial Sequence
  Description of Artificial Sequence: Synthetic peptide
  XENP020423 vlCDR3
QQYGSSPWT

SEQ ID NO: 6139 - protein, 221 aa, Artificial Sequence; identical to SEQ ID NO: 5869
  Description of Artificial Sequence: Synthetic polypeptide
  XENP020424 [CTLA-4]_H3.21_L0.132_Fab Heavy Chain

SEQ ID NO: 6140 - protein, 118 aa, Artificial Sequence; identical to SEQ ID NO: 2614
  Description of Artificial Sequence: Synthetic polypeptide
  VH of XENP020424

SEQ ID NO: 6141 - protein, 5 aa, Artificial Sequence
  Description of Artificial Sequence: Synthetic peptide
  XENP020424 vhCDR1
SYTMH

SEQ ID NO: 6142 - protein, 17 aa, Artificial Sequence
  Description of Artificial Sequence: Synthetic peptide
  XENP020424 vhCDR2
FISYDGNTKYYADSVKG

SEQ ID NO: 6143 - protein, 9 aa, Artificial Sequence
  Description of Artificial Sequence: Synthetic peptide
  XENP020424 vhCDR3
GGLLGPFDL

SEQ ID NO: 6144 - protein, 215 aa, Artificial Sequence; identical to SEQ ID NO: 6074
  Description of Artificial Sequence: Synthetic polypeptide
  XENP020424 [CTLA-4]_H3.21_L0.132_Fab Light Chain

SEQ ID NO: 6145 - protein, 108 aa, Artificial Sequence; identical to SEQ ID NO: 2795
  Description of Artificial Sequence: Synthetic polypeptide
  VL of XENP020424

SEQ ID NO: 6146 - protein, 12 aa, Artificial Sequence
  Description of Artificial Sequence: Synthetic peptide
  XENP020424 vlCDR1
RASQSVSSSYLA

SEQ ID NO: 6147 - protein, 7 aa, Artificial Sequence
  Description of Artificial Sequence: Synthetic peptide
  XENP020424 vlCDR2
GASSRAT

SEQ ID NO: 6148 - protein, 9 aa, Artificial Sequence
  Description of Artificial Sequence: Synthetic peptide
  XENP020424 vlCDR3
QQYGSSPWT

SEQ ID NO: 6149 - protein, 221 aa, Artificial Sequence; identical to SEQ ID NO: 5889
  Description of Artificial Sequence: Synthetic polypeptide
  XENP020425 [CTLA-4]_H3.23_L0.124_Fab Heavy Chain

SEQ ID NO: 6150 - protein, 118 aa, Artificial Sequence; identical to SEQ ID NO: 2632
  Description of Artificial Sequence: Synthetic polypeptide
  VH of XENP020425

SEQ ID NO: 6151 - protein, 5 aa, Artificial Sequence
  Description of Artificial Sequence: Synthetic peptide
  XENP020425 vhCDR1
SYTMH

SEQ ID NO: 6152 - protein, 17 aa, Artificial Sequence
  Description of Artificial Sequence: Synthetic peptide
  XENP020425 vhCDR2
FISYDGNYKYYADSVKG

SEQ ID NO: 6153 - protein, 9 aa, Artificial Sequence
  Description of Artificial Sequence: Synthetic peptide
  XENP020425 vhCDR3
GGHLGPFDL

SEQ ID NO: 6154 - protein, 215 aa, Artificial Sequence; identical to SEQ ID NO: 5994
  Description of Artificial Sequence: Synthetic polypeptide
  XENP020425 [CTLA-4]_H3.23_L0.124_Fab Light Chain

SEQ ID NO: 6155 - protein, 108 aa, Artificial Sequence; identical to SEQ ID NO: 2723
  Description of Artificial Sequence: Synthetic polypeptide
  VL of XENP020425

SEQ ID NO: 6156 - protein, 12 aa, Artificial Sequence
  Description of Artificial Sequence: Synthetic peptide
  XENP020425 vlCDR1
RASQSVGSSYLA

SEQ ID NO: 6157 - protein, 7 aa, Artificial Sequence
  Description of Artificial Sequence: Synthetic peptide
  XENP020425 vlCDR2
GASSRAT

SEQ ID NO: 6158 - protein, 9 aa, Artificial Sequence
  Description of Artificial Sequence: Synthetic peptide
  XENP020425 vlCDR3
QQYGSSPWT

SEQ ID NO: 6159 - protein, 221 aa, Artificial Sequence; identical to SEQ ID NO: 5889
  Description of Artificial Sequence: Synthetic polypeptide
  XENP020426 [CTLA-4]_H3.23_L0.129_Fab Heavy Chain

SEQ ID NO: 6160 - protein, 118 aa, Artificial Sequence; identical to SEQ ID NO: 2632
  Description of Artificial Sequence: Synthetic polypeptide
  VH of XENP020426

SEQ ID NO: 6161 - protein, 5 aa, Artificial Sequence
  Description of Artificial Sequence: Synthetic peptide
  XENP020426 vhCDR1
SYTMH

SEQ ID NO: 6162 - protein, 17 aa, Artificial Sequence
  Description of Artificial Sequence: Synthetic peptide
  XENP020426 vhCDR2
FISYDGNYKYYADSVKG

SEQ ID NO: 6163 - protein, 9 aa, Artificial Sequence
  Description of Artificial Sequence: Synthetic peptide
  XENP020426 vhCDR3
GGHLGPFDL

SEQ ID NO: 6164 - protein, 215 aa, Artificial Sequence; identical to SEQ ID NO: 6044
  Description of Artificial Sequence: Synthetic polypeptide
  XENP020426 [CTLA-4]_H3.23_L0.129_Fab Light Chain

SEQ ID NO: 6165 - protein, 108 aa, Artificial Sequence; identical to SEQ ID NO: 2768
  Description of Artificial Sequence: Synthetic polypeptide
  VL of XENP020426

SEQ ID NO: 6166 - protein, 12 aa, Artificial Sequence
  Description of Artificial Sequence: Synthetic peptide
  XENP020426 vlCDR1
RASQSVGSSYLA

SEQ ID NO: 6167 - protein, 7 aa, Artificial Sequence
  Description of Artificial Sequence: Synthetic peptide
  XENP020426 vlCDR2
GASSRAT

SEQ ID NO: 6168 - protein, 9 aa, Artificial Sequence
  Description of Artificial Sequence: Synthetic peptide
  XENP020426 vlCDR3
QQYGSSPWT

SEQ ID NO: 6169 - protein, 221 aa, Artificial Sequence; identical to SEQ ID NO: 5889
  Description of Artificial Sequence: Synthetic polypeptide
  XENP020427 [CTLA-4]_H3.23_L0.132_Fab Heavy Chain

SEQ ID NO: 6170 - protein, 118 aa, Artificial Sequence; identical to SEQ ID NO: 2632
  Description of Artificial Sequence: Synthetic polypeptide
  VH of XENP020427

SEQ ID NO: 6171 - protein, 5 aa, Artificial Sequence
  Description of Artificial Sequence: Synthetic peptide
  XENP020427 vhCDR1
SYTMH

SEQ ID NO: 6172 - protein, 17 aa, Artificial Sequence
  Description of Artificial Sequence: Synthetic peptide
  XENP020427 vhCDR2
FISYDGNYKYYADSVKG

SEQ ID NO: 6173 - protein, 9 aa, Artificial Sequence
  Description of Artificial Sequence: Synthetic peptide
  XENP020427 vhCDR3
GGHLGPFDL

SEQ ID NO: 6174 - protein, 215 aa, Artificial Sequence; identical to SEQ ID NO: 6074
  Description of Artificial Sequence: Synthetic polypeptide
  XENP020427 [CTLA-4]_H3.23_L0.132_Fab Light Chain

SEQ ID NO: 6175 - protein, 108 aa, Artificial Sequence; identical to SEQ ID NO: 2795
  Description of Artificial Sequence: Synthetic polypeptide
  VL of XENP020427

SEQ ID NO: 6176 - protein, 12 aa, Artificial Sequence
  Description of Artificial Sequence: Synthetic peptide
  XENP020427 vlCDR1
RASQSVSSSYLA

SEQ ID NO: 6177 - protein, 7 aa, Artificial Sequence
  Description of Artificial Sequence: Synthetic peptide
  XENP020427 vlCDR2
GASSRAT

SEQ ID NO: 6178 - protein, 9 aa, Artificial Sequence
  Description of Artificial Sequence: Synthetic peptide
  XENP020427 vlCDR3
QQYGSSPWT

SEQ ID NO: 6179 - protein, 221 aa, Artificial Sequence; identical to SEQ ID NO: 5909
  Description of Artificial Sequence: Synthetic polypeptide
  XENP020428 [CTLA-4]_H3.25_L0.124_Fab Heavy Chain

SEQ ID NO: 6180 - protein, 118 aa, Artificial Sequence; identical to SEQ ID NO: 2650
  Description of Artificial Sequence: Synthetic polypeptide
  VH of XENP020428

SEQ ID NO: 6181 - protein, 5 aa, Artificial Sequence
  Description of Artificial Sequence: Synthetic peptide
  XENP020428 vhCDR1
SYTMH

SEQ ID NO: 6182 - protein, 17 aa, Artificial Sequence
  Description of Artificial Sequence: Synthetic peptide
  XENP020428 vhCDR2
FISYDGNYKYYADSVKG

SEQ ID NO: 6183 - protein, 9 aa, Artificial Sequence
  Description of Artificial Sequence: Synthetic peptide
  XENP020428 vhCDR3
GGLLGPFDL

SEQ ID NO: 6184 - protein, 215 aa, Artificial Sequence; identical to SEQ ID NO: 5994
  Description of Artificial Sequence: Synthetic polypeptide
  XENP020428 [CTLA-4]_H3.25_L0.124_Fab Light Chain

SEQ ID NO: 6185 - protein, 108 aa, Artificial Sequence; identical to SEQ ID NO: 2723
  Description of Artificial Sequence: Synthetic polypeptide
  VL of XENP020428

SEQ ID NO: 6186 - protein, 12 aa, Artificial Sequence
  Description of Artificial Sequence: Synthetic peptide
  XENP020428 vlCDR1
RASQSVGSSYLA

SEQ ID NO: 6187 - protein, 7 aa, Artificial Sequence
  Description of Artificial Sequence: Synthetic peptide
  XENP020428 vlCDR2
GASSRAT

SEQ ID NO: 6188 - protein, 9 aa, Artificial Sequence
  Description of Artificial Sequence: Synthetic peptide
  XENP020428 vlCDR3
QQYGSSPWT

SEQ ID NO: 6189 - protein, 221 aa, Artificial Sequence; identical to SEQ ID NO: 5909
  Description of Artificial Sequence: Synthetic polypeptide
  XENP020429 [CTLA-4]_H3.25_L0.129_Fab Heavy Chain

SEQ ID NO: 6190 - protein, 118 aa, Artificial Sequence; identical to SEQ ID NO: 2650
  Description of Artificial Sequence: Synthetic polypeptide
  VH of XENP020429

SEQ ID NO: 6191 - protein, 5 aa, Artificial Sequence
  Description of Artificial Sequence: Synthetic peptide
  XENP020429 vhCDR1
SYTMH

SEQ ID NO: 6192 - protein, 17 aa, Artificial Sequence
  Description of Artificial Sequence: Synthetic peptide
  XENP020429 vhCDR2
FISYDGNYKYYADSVKG

SEQ ID NO: 6193 - protein, 9 aa, Artificial Sequence
  Description of Artificial Sequence: Synthetic peptide
  XENP020429 vhCDR3
GGLLGPFDL

SEQ ID NO: 6194 - protein, 215 aa, Artificial Sequence; identical to SEQ ID NO: 6044
  Description of Artificial Sequence: Synthetic polypeptide
  XENP020429 [CTLA-4]_H3.25_L0.129_Fab Light Chain

SEQ ID NO: 6195 - protein, 108 aa, Artificial Sequence; identical to SEQ ID NO: 2768
  Description of Artificial Sequence: Synthetic polypeptide
  VL of XENP020429

SEQ ID NO: 6196 - protein, 12 aa, Artificial Sequence
  Description of Artificial Sequence: Synthetic peptide
  XENP020429 vlCDR1
RASQSVGSSYLA

SEQ ID NO: 6197 - protein, 7 aa, Artificial Sequence
  Description of Artificial Sequence: Synthetic peptide
  XENP020429 vlCDR2
GASSRAT

SEQ ID NO: 6198 - protein, 9 aa, Artificial Sequence
  Description of Artificial Sequence: Synthetic peptide
  XENP020429 vlCDR3
QQYGSSPWT

SEQ ID NO: 6199 - protein, 221 aa, Artificial Sequence; identical to SEQ ID NO: 5909
  Description of Artificial Sequence: Synthetic polypeptide
  XENP020430 [CTLA-4]_H3.25_L0.132_Fab Heavy Chain

SEQ ID NO: 6200 - protein, 118 aa, Artificial Sequence; identical to SEQ ID NO: 2650
  Description of Artificial Sequence: Synthetic polypeptide
  VH of XENP020430

SEQ ID NO: 6201 - protein, 5 aa, Artificial Sequence
  Description of Artificial Sequence: Synthetic peptide
  XENP020430 vhCDR1
SYTMH

SEQ ID NO: 6202 - protein, 17 aa, Artificial Sequence
  Description of Artificial Sequence: Synthetic peptide
  XENP020430 vhCDR2
FISYDGNYKYYADSVKG

SEQ ID NO: 6203 - protein, 9 aa, Artificial Sequence
  Description of Artificial Sequence: Synthetic peptide
  XENP020430 vhCDR3
GGLLGPFDL

SEQ ID NO: 6204 - protein, 215 aa, Artificial Sequence; identical to SEQ ID NO: 6074
  Description of Artificial Sequence: Synthetic polypeptide
  XENP020430 [CTLA-4]_H3.25_L0.132_Fab Light Chain

SEQ ID NO: 6205 - protein, 108 aa, Artificial Sequence; identical to SEQ ID NO: 2795
  Description of Artificial Sequence: Synthetic polypeptide
  VL of XENP020430

SEQ ID NO: 6206 - protein, 12 aa, Artificial Sequence
  Description of Artificial Sequence: Synthetic peptide
  XENP020430 vlCDR1
RASQSVSSSYLA

SEQ ID NO: 6207 - protein, 7 aa, Artificial Sequence
  Description of Artificial Sequence: Synthetic peptide
  XENP020430 vlCDR2
GASSRAT

SEQ ID NO: 6208 - protein, 9 aa, Artificial Sequence
  Description of Artificial Sequence: Synthetic peptide
  XENP020430 vlCDR3
QQYGSSPWT

SEQ ID NO: 6209 - protein, 240 aa, Artificial Sequence
  Description of Artificial Sequence: Synthetic polypeptide
  XENP016402 nivolumab_H0.1_L0_scFv(GKPGS)4
QVQLVESGGGVVQPGRSLRLSCKASGITFSNSGMHWVRQAPGKGLEWVAVIWYDGSKRYYADSVKGRFTISRDNSKNTLFLQMNSLRAEDTAVYYCATNDDYWGQGTLVTVSSGKPGSGKPGSGKPGSGKPGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 6210 - protein, 113 aa, Artificial Sequence
  Description of Artificial Sequence: Synthetic polypeptide
  VH of XENP016402
QVQLVESGGGVVQPGRSLRLSCKASGITFSNSGMHWVRQAPGKGLEWVAVIWYDGSKRYYADSVKGRFTISRDNSKNTLFLQMNSLRAEDTAVYYCATNDDYWGQGTLVTVSS

SEQ ID NO: 6211 - protein, 107 aa, Artificial Sequence [sequence omitted]

SEQ ID NO: 6212 - protein, 5 aa, Artificial Sequence
  Description of Artificial Sequence: Synthetic peptide
  XENP016402 vhCDR1
NSGMH

SEQ ID NO: 6213 - protein, 17 aa, Artificial Sequence
  Description of Artificial Sequence: Synthetic peptide
  XENP016402 vhCDR2
VIWYDGSKRYYADSVKG

SEQ ID NO: 6214 - protein, 4 aa, Artificial Sequence
  Description of Artificial Sequence: Synthetic peptide
  XENP016402 vhCDR3
NDDY

SEQ ID NO: 6215 - protein, 11 aa, Artificial Sequence
  Description of Artificial Sequence: Synthetic peptide
  XENP016402 vlCDR1
RASQSVSSYLA

SEQ ID NO: 6216 - protein, 7 aa, Artificial Sequence
  Description of Artificial Sequence: Synthetic peptide
  XENP016402 vlCDR2
DASNRAT

SEQ ID NO: 6217 - protein, 9 aa, Artificial Sequence
  Description of Artificial Sequence: Synthetic peptide
  XENP016402 vlCDR3
QQSSNWPRT

SEQ ID NO: 6218 - protein, 246 aa, Artificial Sequence
  Description of Artificial Sequence: Synthetic polypeptide
  XENP017919 1A2_H1L1_scFv(GKPGS)4
QIQLVQSGAEVKKPGASVKVSCKASGYTFTDYSMHWVRQAPGQGLEWMGWINTETGEPTYADKFQGRVTMTLDTSTSTAYMELSSLRSEDTAVYFCASSPLDYWGQGTLVTVSSGKPGSGKPGSGKPGSGKPGSDLLLTQSPLSLPVTPGEPASISCRSSQSIVHSNGNTYLEWFLQKPGQSPQLLIYKVFNRFSGVPDRFSGSGSGTDFTLKISRVEAEDVGVYYCFQGSHVPFTFGSGTKLEIK

SEQ ID NO: 6219 - protein, 114 aa, Artificial Sequence
  Description of Artificial Sequence: Synthetic polypeptide
  VH of XENP017919
QIQLVQSGAEVKKPGASVKVSCKASGYTFTDYSMHWVRQAPGQGLEWMGWINTETGEPTYADKFQGRVTMTLDTSTSTAYMELSSLRSEDTAVYFCASSPLDYWGQGTLVTVSS

SEQ ID NO: 6220 - protein, 112 aa, Artificial Sequence
  Description of Artificial Sequence: Synthetic polypeptide
  VL of XENP017919
DLLLTQSPLSLPVTPGEPASISCRSSQSIVHSNGNTYLEWFLQKPGQSPQLLIYKVFNRFSGVPDRFSGSGSGTDFTLKISRVEAEDVGVYYCFQGSHVPFTFGSGTKLEIK

SEQ ID NO: 6221 - protein, 5 aa, Artificial Sequence
  Description of Artificial Sequence: Synthetic peptide
  XENP017919 vhCDR1
DYSMH

SEQ ID NO: 6222 - protein, 17 aa, Artificial Sequence
  Description of Artificial Sequence: Synthetic peptide
  XENP017919 vhCDR2
WINTETGEPTYADKFQG

SEQ ID NO: 6223 - protein, 5 aa, Artificial Sequence
  Description of Artificial Sequence: Synthetic peptide
  XENP017919 vhCDR3
SPLDY

SEQ ID NO: 6224 - protein, 16 aa, Artificial Sequence
  Description of Artificial Sequence: Synthetic peptide
  XENP017919 vlCDR1
RSSQSIVHSNGNTYLE

SEQ ID NO: 6225 - protein, 7 aa, Artificial Sequence
  Description of Artificial Sequence: Synthetic peptide
  XENP017919 vlCDR2
KVFNRFS

SEQ ID NO: 6226 - protein, 9 aa, Artificial Sequence
  Description of Artificial Sequence: Synthetic peptide
  XENP017919 vlCDR3
FQGSHVPFT

SEQ ID NO: 6227 - protein, 251 aa, Artificial Sequence
  Description of Artificial Sequence: Synthetic polypeptide
  XENP017920 1C7_H1L1_scFv(GKPGS)4
EVQLLESGGGLVQPGGSLRLSCAASGFAFSSYDMSWVRQAPGKRLEWVSYISSGGGSTYYPDSVKGRFTISRDNSKNTLYLQMNSLRAEDTAVYYCARPLDDYYAPFAYWGQGTLVTVSSGKPGSGKPGSGKPGSGKPGSDIVLTQSPSSLSASVGDRVTITCRASESVDNDGISFMNWFQQKPGKPPKLLIYAASNQGSGVPARFSGSGSGTDFTLTISSLQPEDFATYFCQQSKEVPWTFGGGTKVEIK

SEQ ID NO: 6228 - protein, 120 aa, Artificial Sequence
  Description of Artificial Sequence: Synthetic polypeptide
  VH of XENP017920
EVQLLESGGGLVQPGGSLRLSCAASGFAFSSYDMSWVRQAPGKRLEWVSYISSGGGSTYYPDSVKGRFTISRDNSKNTLYLQMNSLRAEDTAVYYCARPLDDYYAPFAYWGQGTLVTVSS

SEQ ID NO: 6229 - protein, 111 aa, Artificial Sequence
  Description of Artificial Sequence: Synthetic polypeptide
  VL of XENP017920
DIVLTQSPSSLSASVGDRVTITCRASESVDNDGISFMNWFQQKPGKPPKLLIYAASNQGSGVPARFSGSGSGTDFTLTISSLQPEDFATYFCQQSKEVPWTFGGGTKVEIK

SEQ ID NO: 6230 - protein, 5 aa, Artificial Sequence
  Description of Artificial Sequence: Synthetic peptide
  XENP017920 vhCDR1
SYDMS

SEQ ID NO: 6231 - protein, 17 aa, Artificial Sequence
  Description of Artificial Sequence: Synthetic peptide
  XENP017920 vhCDR2
YISSGGGSTYYPDSVKG

SEQ ID NO: 6232 - protein, 11 aa, Artificial Sequence
  Description of Artificial Sequence: Synthetic peptide
  XENP017920 vhCDR3
PLDDYYAPFAY

SEQ ID NO: 6233 - protein, 15 aa, Artificial Sequence
  Description of Artificial Sequence: Synthetic peptide
  XENP017920 vlCDR1
RASESVDNDGISFMN

SEQ ID NO: 6234 - protein, 7 aa, Artificial Sequence
  Description of Artificial Sequence: Synthetic peptide
  XENP017920 vlCDR2
AASNQGS

SEQ ID NO: 6235 - protein, 9 aa, Artificial Sequence
  Description of Artificial Sequence: Synthetic peptide
  XENP017920 vlCDR3
QQSKEVPWT

SEQ ID NO: 6236 - protein, 246 aa, Artificial Sequence
  Description of Artificial Sequence: Synthetic polypeptide
  XENP017921 1G2_H1L1_scFv(GKPGS)4
QVQLVQSGAEVKKPGASVKVSCKVSGFSLTDYGVNWVRQAPGQGLEWMGMIWGDGSTDYNSKFQGRVTMTKDISTSTVYMELSSLRSEDTAVYYCAREYAMDYWGQGTLVTVSSGKPGSGKPGSGKPGSGKPGSDIVMTQSPDSLAVSLGERATINCKSSQSLLNSRTRKNYLAWYQQKPGQSPKLLIFWASTRESGVPDRFTGSGSGTDFTLTISSLQAEDVAVYYCKQSYNLRTFGGGTKVEIK

SEQ ID NO: 6237 - protein, 114 aa, Artificial Sequence
  Description of Artificial Sequence: Synthetic polypeptide
  VH of XENP017921
QVQLVQSGAEVKKPGASVKVSCKVSGFSLTDYGVNWVRQAPGQGLEWMGMIWGDGSTDYNSKFQGRVTMTKDISTSTVYMELSSLRSEDTAVYYCAREYAMDYWGQGTLVTVSS

SEQ ID NO: 6238 - protein, 112 aa, Artificial Sequence
  Description of Artificial Sequence: Synthetic polypeptide
  VL of XENP017921
DIVMTQSPDSLAVSLGERATINCKSSQSLLNSRTRKNYLAWYQQKPGQSPKLLIFWASTRESGVPDRFTGSGSGTDFTLTISSLQAEDVAVYYCKQSYNLRTFGGGTKVEIK

SEQ ID NO: 6239 - protein, 5 aa, Artificial Sequence
  Description of Artificial Sequence: Synthetic peptide
  XENP017921 vhCDR1
DYGVN

SEQ ID NO: 6240 - protein, 16 aa, Artificial Sequence
  Description of Artificial Sequence: Synthetic peptide
  XENP017921 vhCDR2
MIWGDGSTDYNSKFQG

SEQ ID NO: 6241 - protein, 6 aa, Artificial Sequence
  Description of Artificial Sequence: Synthetic peptide
  XENP017921 vhCDR3
EYAMDY

SEQ ID NO: 6242 - protein, 17 aa, Artificial Sequence
  Description of Artificial Sequence: Synthetic peptide
  XENP017921 vlCDR1
KSSQSLLNSRTRKNYLA

SEQ ID NO: 6243 - protein, 7 aa, Artificial Sequence
  Description of Artificial Sequence: Synthetic peptide
  XENP017921 vlCDR2
WASTRES

SEQ ID NO: 6244 - protein, 8 aa, Artificial Sequence
  Description of Artificial Sequence: Synthetic peptide
  XENP017921 vlCDR3
KQSYNLRT

SEQ ID NO: 6245 - protein, 249 aa, Artificial Sequence
  Description of Artificial Sequence: Synthetic polypeptide
  XENP017922 1G6_H1L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6246 - protein, 122 aa, Artificial Sequence
  Description of Artificial Sequence: Synthetic polypeptide
  VH of XENP017922
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6247 - protein, 107 aa, Artificial Sequence
  Description of Artificial Sequence: Synthetic polypeptide
  VL of XENP017922
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6248 - protein, 5 aa, Artificial Sequence
  Description of Artificial Sequence: Synthetic peptide
  XENP017922 vhCDR1
NYWMN

SEQ ID NO: 6249 - protein, 19 aa, Artificial Sequence
  Description of Artificial Sequence: Synthetic peptide
  XENP017922 vhCDR2
EIRLKSNNYATHYAEPVKG

SEQ ID NO: 6250 - protein, 11 aa, Artificial Sequence
  Description of Artificial Sequence: Synthetic peptide
  XENP017922 vhCDR3
YYGNYGGYFDV

SEQ ID NO: 6251 - protein, 11 aa, Artificial Sequence
  Description of Artificial Sequence: Synthetic peptide
  XENP017922 vlCDR1
RASQSVSNDVA

SEQ ID NO: 6252 - protein, 7 aa, Artificial Sequence
  Description of Artificial Sequence: Synthetic peptide
  XENP017922 vlCDR2
YASHRYT

SEQ ID NO: 6253 - protein, 9 aa, Artificial Sequence
  Description of Artificial Sequence: Synthetic peptide
  XENP017922 vlCDR3
QQDYSSPRT

SEQ ID NO: 6254 - protein, 249 aa, Artificial Sequence
  Description of Artificial Sequence: Synthetic polypeptide
  XENP017923 1G6_H1L2_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIK

SEQ ID NO: 6255 - protein, 122 aa, Artificial Sequence; identical to SEQ ID NO: 6246
  Description of Artificial Sequence: Synthetic polypeptide
  VH of XENP017923

SEQ ID NO: 6256 - protein, 107 aa, Artificial Sequence
  Description of Artificial Sequence: Synthetic polypeptide
  VL of XENP017923
SIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIK

SEQ ID NO: 6257 - protein, 5 aa, Artificial Sequence
  Description of Artificial Sequence: Synthetic peptide
  XENP017923 vhCDR1
NYWMN

SEQ ID NO: 6258 - protein, 19 aa, Artificial Sequence
  Description of Artificial Sequence: Synthetic peptide
  XENP017923 vhCDR2
EIRLKSNNYATHYAEPVKG

SEQ ID NO: 6259 - protein, 11 aa, Artificial Sequence
  Description of Artificial Sequence: Synthetic peptide
  XENP017923 vhCDR3
YYGNYGGYFDV

SEQ ID NO: 6260 - protein, 11 aa, Artificial Sequence
  Description of Artificial Sequence: Synthetic peptide
  XENP017923 vlCDR1
RASQSVSNDVA

SEQ ID NO: 6261 - protein, 7 aa, Artificial Sequence
  Description of Artificial Sequence: Synthetic peptide
  XENP017923 vlCDR2
YASHRYT

SEQ ID NO: 6262 - protein, 9 aa, Artificial Sequence
  Description of Artificial Sequence: Synthetic peptide
  XENP017923 vlCDR3
QQDYSSPRT

SEQ ID NO: 6263 - protein, 242 aa, Artificial Sequence
  Description of Artificial Sequence: Synthetic polypeptide
  XENP017924 2A2_H1L1_scFv(GKPGS)4
QVQLVQSGAEVKKPGASVKVSCKASGYTFTNYWMHWVRQAPGQGLEWMGYINPSTGYTEYNQKFQGRVTMTADKSTSTAYMELSSLRSEDTAVYYCATGNYFAYWGQGTLVTVSSGKPGSGKPGSGKPGSGKPGSDIQMTQSPSSLSASVGDRVTITCRPSESLYSYLAWYQQKPGKSPKLLVYNAKTLVEGVPSRFSGSGSGTDFTLTISSLQPEDFATYYCQHHYGTPFTFGSGTKLEIK

SEQ ID NO: 6264 - protein, 115 aa, Artificial Sequence
  Description of Artificial Sequence: Synthetic polypeptide
  VH of XENP017924
QVQLVQSGAEVKKPGASVKVSCKASGYTFTNYWMHWVRQAPGQGLEWMGYINPSTGYTEYNQKFQGRVTMTADKSTSTAYMELSSLRSEDTAVYYCATGNYFAYWGQGTLVTVSS

SEQ ID NO: 6265 - protein, 107 aa, Artificial Sequence
  Description of Artificial Sequence: Synthetic polypeptide
  VL of XENP017924
DIQMTQSPSSLSASVGDRVTITCRPSESLYSYLAWYQQKPGKSPKLLVYNAKTLVEGVPSRFSGSGSGTDFTLTISSLQPEDFATYYCQHHYGTPFTFGSGTKLEIK

SEQ ID NO: 6266 - protein, 5 aa, Artificial Sequence
  Description of Artificial Sequence: Synthetic peptide
  XENP017924 vhCDR1
NYWMH

SEQ ID NO: 6267 - protein, 17 aa, Artificial Sequence
  Description of Artificial Sequence: Synthetic peptide
  XENP017924 vhCDR2
YINPSTGYTEYNQKFQG

SEQ ID NO: 6268 - protein, 6 aa, Artificial Sequence
  Description of Artificial Sequence: Synthetic peptide
  XENP017924 vhCDR3
GNYFAY

SEQ ID NO: 6269 - protein, 11 aa, Artificial Sequence
  Description of Artificial Sequence: Synthetic peptide
  XENP017924 vlCDR1
RPSESLYSYLA

SEQ ID NO: 6270 - protein, 7 aa, Artificial Sequence
  Description of Artificial Sequence: Synthetic peptide
  XENP017924 vlCDR2
NAKTLVE

SEQ ID NO: 6271 - protein, 9 aa, Artificial Sequence
  Description of Artificial Sequence: Synthetic peptide
  XENP017924 vlCDR3
QHHYGTPFT

SEQ ID NO: 6272 - protein, 252 aa, Artificial Sequence
  Description of Artificial Sequence: Synthetic polypeptide
  XENP017925 2F11_H1L1_scFv(GKPGS)4
QVQLVQSGAEVKKPGASVKVSCKGSGYTFTDYVMHWVRQAPGQSLEWMGVISTYYGDASYNQKFQGRVTMTVDKSTSTAYMELSSLRSEDTAVYYCAREGYDGYLYFDVWGAGTLVTVSSGKPGSGKPGSGKPGSGKPGSDVLMTQTPLSSPVTLGQPASISCRSSQSIVHSNGNTYLEWYQQRPGQSPRLLIYKVSNRFSGVPDRFSGSGSGTDFTLKISRVEAEDVGVYYCFQGSHVPYTFGGGTKVEIK

SEQ ID NO: 6273 - protein, 120 aa, Artificial Sequence
  Description of Artificial Sequence: Synthetic polypeptide
  VH of XENP017925
QVQLVQSGAEVKKPGASVKVSCKGSGYTFTDYVMHWVRQAPGQSLEWMGVISTYYGDASYNQKFQGRVTMTVDKSTSTAYMELSSLRSEDTAVYYCAREGYDGYLYFDVWGAGTLVTVSS

SEQ ID NO: 6274 - protein, 112 aa, Artificial Sequence
  Description of Artificial Sequence: Synthetic polypeptide
  VL of XENP017925
DVLMTQTPLSSPVTLGQPASISCRSSQSIVHSNGNTYLEWYQQRPGQSPRLLIYKVSNRFSGVPDRFSGSGSGTDFTLKISRVEAEDVGVYYCFQGSHVPYTFGGGTKVEIK

SEQ ID NO: 6275 - protein, 5 aa, Artificial Sequence
  Description of Artificial Sequence: Synthetic peptide
  XENP017925 vhCDR1
DYVMH

SEQ ID NO: 6276 - protein, 17 aa, Artificial Sequence
  Description of Artificial Sequence: Synthetic peptide
  XENP017925 vhCDR2
VISTYYGDASYNQKFQG

SEQ ID NO: 6277 - protein, 11 aa, Artificial Sequence
  Description of Artificial Sequence: Synthetic peptide
  XENP017925 vhCDR3
EGYDGYLYFDV

SEQ ID NO: 6278 - protein, 16 aa, Artificial Sequence
  Description of Artificial Sequence: Synthetic peptide
  XENP017925 vlCDR1
RSSQSIVHSNGNTYLE

SEQ ID NO: 6279 - protein, 7 aa, Artificial Sequence
  Description of Artificial Sequence: Synthetic peptide
  XENP017925 vlCDR2
KVSNRFS

SEQ ID NO: 6280 - protein, 9 aa, Artificial Sequence
  Description of Artificial Sequence: Synthetic peptide
  XENP017925 vlCDR3
FQGSHVPYT

SEQ ID NO: 6281 - protein, 252 aa, Artificial Sequence
  Description of Artificial Sequence: Synthetic polypeptide
  XENP017926 5H1_H1L1_scFv(GKPGS)4
QVQLVQSGAEVKKPGASVKVSCKGSGYTFTDYVMHWVRQAPGQSLEWMGVISIHYGDGRYNQKFQGRVTMTVDKSTSTAYMELSSLRSEDTAVYYCAREVYDGYLYFDVWGAGTLVTVSSGKPGSGKPGSGKPGSGKPGSDVLMTQSPLSLPVTPGEPASISCRSSQSIVHSNGNTYLEWYLQKPGQSPQLLIYKVSNRFSGVPDRFGGRGSGTDFTLKISRVEAEDVGVYYCFQGSHVPYTFGGGTKVEIK

SEQ ID NO: 6282 - protein, 120 aa, Artificial Sequence
  Description of Artificial Sequence: Synthetic polypeptide
  VH of XENP017926
QVQLVQSGAEVKKPGASVKVSCKGSGYTFTDYVMHWVRQAPGQSLEWMGVISIHYGDGRYNQKFQGRVTMTVDKSTSTAYMELSSLRSEDTAVYYCAREVYDGYLYFDVWGAGTLVTVSS

SEQ ID NO: 6283 - protein, 112 aa, Artificial Sequence
  Description of Artificial Sequence: Synthetic polypeptide
  VL of XENP017926
DVLMTQSPLSLPVTPGEPASISCRSSQSIVHSNGNTYLEWYLQKPGQSPQLLIYKVSNRFSGVPDRFGGRGSGTDFTLKISRVEAEDVGVYYCFQGSHVPYTFGGGTKVEIK

SEQ ID NO: 6284 - protein, 5 aa, Artificial Sequence
  Description of Artificial Sequence: Synthetic peptide
  XENP017926 vhCDR1
DYVMH

SEQ ID NO: 6285 - protein, 17 aa, Artificial Sequence
  Description of Artificial Sequence: Synthetic peptide
  XENP017926 vhCDR2
VISIHYGDGRYNQKFQG

SEQ ID NO: 6286 - protein, 11 aa, Artificial Sequence
  Description of Artificial Sequence: Synthetic peptide
  XENP017926 vhCDR3
EVYDGYLYFDV

SEQ ID NO: 6287 - protein, 16 aa, Artificial Sequence
  Description of Artificial Sequence: Synthetic peptide
  XENP017926 vlCDR1
RSSQSIVHSNGNTYLE

SEQ ID NO: 6288 - protein, 7 aa, Artificial Sequence
  Description of Artificial Sequence: Synthetic peptide
  XENP017926 vlCDR2
KVSNRFS

SEQ ID NO: 6289 - protein, 9 aa, Artificial Sequence
  Description of Artificial Sequence: Synthetic peptide
  XENP017926 vlCDR3
FQGSHVPYT

SEQ ID NO: 6290 - protein, 252 aa, Artificial Sequence
  Description of Artificial Sequence: Synthetic polypeptide
  XENP017927 5H1_H1L2_scFv(GKPGS)4
QVQLVQSGAEVKKPGASVKVSCKGSGYTFTDYVMHWVRQAPGQSLEWMGVISIHYGDGRYNQKFQGRVTMTVDKSTSTAYMELSSLRSEDTAVYYCAREVYDGYLYFDVWGAGTLVTVSSGKPGSGKPGSGKPGSGKPGSDVLMTQSPLSLPVTLGQPASISCRSSQSIVHSNGNTYLEWYQQRPGQSPRLLIYKVSNRFSGVPDRFGGRGSGTDFTLKISRVEAEDVGVYYCFQGSHVPYTFGGGTKVEIK

SEQ ID NO: 6291 - protein, 120 aa, Artificial Sequence; identical to SEQ ID NO: 6282
  Description of Artificial Sequence: Synthetic polypeptide
  VH of XENP017927

SEQ ID NO: 6292 - protein, 112 aa, Artificial Sequence
  Description of Artificial Sequence: Synthetic polypeptide
  VL of XENP017927
DVLMTQSPLSLPVTLGQPASISCRSSQSIVHSNGNTYLEWYQQRPGQSPRLLIYKVSNRFSGVPDRFGGRGSGTDFTLKISRVEAEDVGVYYCFQGSHVPYTFGGGTKVEIK

SEQ ID NO: 6293 - protein, 5 aa, Artificial Sequence
  Description of Artificial Sequence: Synthetic peptide
  XENP017927 vhCDR1
DYVMH

SEQ ID NO: 6294 - protein, 17 aa, Artificial Sequence
  Description of Artificial Sequence: Synthetic peptide
  XENP017927 vhCDR2
VISIHYGDGRYNQKFQG

SEQ ID NO: 6295 - protein, 11 aa, Artificial Sequence
  Description of Artificial Sequence: Synthetic peptide
  XENP017927 vhCDR3
EVYDGYLYFDV

SEQ ID NO: 6296 - protein, 16 aa, Artificial Sequence
  Description of Artificial Sequence: Synthetic peptide
  XENP017927 vlCDR1
RSSQSIVHSNGNTYLE

SEQ ID NO: 6297 - protein, 7 aa, Artificial Sequence
  Description of Artificial Sequence: Synthetic peptide
  XENP017927 vlCDR2
KVSNRFS

SEQ ID NO: 6298 - protein, 9 aa, Artificial Sequence
  Description of Artificial Sequence: Synthetic peptide
  XENP017927 vlCDR3
FQGSHVPYT

SEQ ID NO: 6299 - protein, 247 aa, Artificial Sequence
  Description of Artificial Sequence: Synthetic polypeptide
  XENP017928 10E4_H1L1_scFv(GKPGS)4
QVQLVQSGAEVKKPGASVKVSCKASGYSFTSYWMHWVRQAPGQGLEWMGAIYPGNSDTSYNQKFQGRVTMTADTSTSTAYMELSSLRSEDTAVYYCTRDGNYVRYYFDYWGQGTLVTVSSGKPGSGKPGSGKPGSGKPGSDIQMTQSPSSLSASVGDRVTITCRASQDIGSNLNWLQQKPGKTIKRLIYATSNLDSGVPKRFSGRRSGSDYTLTISSLQPEDFATYYCLQYASSPLTFGTGTKLEIK

SEQ ID NO: 6300 - protein, 120 aa, Artificial Sequence
  Description of Artificial Sequence: Synthetic polypeptide
  VH of XENP017928
QVQLVQSGAEVKKPGASVKVSCKASGYSFTSYWMHWVRQAPGQGLEWMGAIYPGNSDTSYNQKFQGRVTMTADTSTSTAYMELSSLRSEDTAVYYCTRDGNYVRYYFDYWGQGTLVTVSS

SEQ ID NO: 6301 - protein, 107 aa, Artificial Sequence
  Description of Artificial Sequence: Synthetic polypeptide
  VL of XENP017928
DIQMTQSPSSLSASVGDRVTITCRASQDIGSNLNWLQQKPGKTIKRLIYATSNLDSGVPKRFSGRRSGSDYTLTISSLQPEDFATYYCLQYASSPLTFGTGTKLEIK

SEQ ID NO: 6302 - protein, 5 aa, Artificial Sequence
  Description of Artificial Sequence: Synthetic peptide
  XENP017928 vhCDR1
SYWMH

SEQ ID NO: 6303 - protein, 17 aa, Artificial Sequence
  Description of Artificial Sequence: Synthetic peptide
  XENP017928 vhCDR2
AIYPGNSDTSYNQKFQG

SEQ ID NO: 6304 - protein, 11 aa, Artificial Sequence
  Description of Artificial Sequence: Synthetic peptide
  XENP017928 vhCDR3
DGNYVRYYFDY

SEQ ID NO: 6305 - protein, 11 aa, Artificial Sequence
  Description of Artificial Sequence: Synthetic peptide
  XENP017928 vlCDR1
RASQDIGSNLN

SEQ ID NO: 6306 - protein, 7 aa, Artificial Sequence
  Description of Artificial Sequence: Synthetic peptide
  XENP017928 vlCDR2
ATSNLDS

SEQ ID NO: 6307 - protein, 9 aa, Artificial Sequence
  Description of Artificial Sequence: Synthetic peptide
  XENP017928 vlCDR3
LQYASSPLT

SEQ ID NO: 6308 - protein, 247 aa, Artificial Sequence
  Description of Artificial Sequence: Synthetic polypeptide
  XENP017929 4C11_H1L1_scFv(GKPGS)4
QIQLVQSGAEVKKPGASVKVSCKASGYTFTSYWMHWVRQAPGQGLEWMGAIYPGNSDTSYNQKFQGRVTMTADTSTSTAYMELSSLRSEDTAVYYCTNLYYGSSFAMDYWGQGTLVTVSSGKPGSGKPGSGKPGSGKPGSDIKMTQSPSSLSASVGDRVTITCRASQDINTYLSWFQQKPGKSPKTLIYRANRLVDGVPSRFSGSGSGQDYTLTISSLQPEDFATYYCLHYDDFPYTFGGGTKVEIK

SEQ ID NO: 6309 - protein, 120 aa, Artificial Sequence
  Description of Artificial Sequence: Synthetic polypeptide
  VH of XENP017929
QIQLVQSGAEVKKPGASVKVSCKASGYTFTSYWMHWVRQAPGQGLEWMGAIYPGNSDTSYNQKFQGRVTMTADTSTSTAYMELSSLRSEDTAVYYCTNLYYGSSFAMDYWGQGTLVTVSS

SEQ ID NO: 6310 - protein, 107 aa, Artificial Sequence
  Description of Artificial Sequence: Synthetic polypeptide
  VL of XENP017929
DIKMTQSPSSLSASVGDRVTITCRASQDINTYLSWFQQKPGKSPKTLIYRANRLVDGVPSRFSGSGSGQDYTLTISSLQPEDFATYYCLHYDDFPYTFGGGTKVEIK

SEQ ID NO: 6311 - protein, 5 aa, Artificial Sequence
  Description of Artificial Sequence: Synthetic peptide
  XENP017929 vhCDR1
SYWMH

SEQ ID NO: 6312 - protein, 17 aa, Artificial Sequence
  Description of Artificial Sequence: Synthetic peptide
  XENP017929 vhCDR2
AIYPGNSDTSYNQKFQG

SEQ ID NO: 6313 - protein, 11 aa, Artificial Sequence
  Description of Artificial Sequence: Synthetic peptide
  XENP017929 vhCDR3
LYYGSSFAMDY

SEQ ID NO: 6314 - protein, 11 aa, Artificial Sequence
  Description of Artificial Sequence: Synthetic peptide
  XENP017929 vlCDR1
RASQDINTYLS

SEQ ID NO: 6315 - protein, 7 aa, Artificial Sequence
  Description of Artificial Sequence: Synthetic peptide
  XENP017929 vlCDR2
RANRLVD

SEQ ID NO: 6316 - protein, 9 aa, Artificial Sequence
  Description of Artificial Sequence: Synthetic peptide
  XENP017929 vlCDR3
LHYDDFPYT

SEQ ID NO: 6317 - protein, 244 aa, Artificial Sequence
  Description of Artificial Sequence: Synthetic polypeptide
  XENP017930 6A3_H1L1_scFv(GKPGS)4
EVQLLESGGGLVQPGGSLRLSCAASGFTFSSYGMSWVRQAPGKRLEWVSTISGGGRYTYYPDSVKGRFTISRDNSKNTLYLQMNSLRAEDTAVYYCASYYDSSFDYWGQGTLVTVSSGKPGSGKPGSGKPGSGKPGSDIVMTQSPDSLAVSLGERATINCKASQDVGTAVAWYQQKPGQSPKLLIYWASTRHTGVPDRFTGSGSGTDFTLTISSLQAEDVAVYFCQHYSIYPWTFGGGTKVEIK

SEQ ID NO: 6318 - protein, 117 aa, Artificial Sequence
  Description of Artificial Sequence: Synthetic polypeptide
  VH of XENP017930
EVQLLESGGGLVQPGGSLRLSCAASGFTFSSYGMSWVRQAPGKRLEWVSTISGGGRYTYYPDSVKGRFTISRDNSKNTLYLQMNSLRAEDTAVYYCASYYDSSFDYWGQGTLVTVSS

SEQ ID NO: 6319 - protein, 107 aa, Artificial Sequence
  Description of Artificial Sequence: Synthetic polypeptide
  VL of XENP017930
DIVMTQSPDSLAVSLGERATINCKASQDVGTAVAWYQQKPGQSPKLLIYWASTRHTGVPDRFTGSGSGTDFTLTISSLQAEDVAVYFCQHYSIYPWTFGGGTKVEIK

SEQ ID NO: 6320 - protein, 5 aa, Artificial Sequence
  Description of Artificial Sequence: Synthetic peptide
  XENP017930 vhCDR1
SYGMS

SEQ ID NO: 6321 - protein, 17 aa, Artificial Sequence
  Description of Artificial Sequence: Synthetic peptide
  XENP017930 vhCDR2
TISGGGRYTYYPDSVKG

SEQ ID NO: 6322 - protein, 8 aa, Artificial Sequence
  Description of Artificial Sequence: Synthetic peptide
  XENP017930 vhCDR3
YYDSSFDY

SEQ ID NO: 6323 - protein, 11 aa, Artificial Sequence
  Description of Artificial Sequence: Synthetic peptide
  XENP017930 vlCDR1
KASQDVGTAVA

SEQ ID NO: 6324 - protein, 7 aa, Artificial Sequence
  Description of Artificial Sequence: Synthetic peptide
  XENP017930 vlCDR2
WASTRHT

SEQ ID NO: 6325 - protein, 9 aa, Artificial Sequence
  Description of Artificial Sequence: Synthetic peptide
  XENP017930 vlCDR3
QHYSIYPWT

SEQ ID NO: 6326 - protein, 244 aa, Artificial Sequence
  Description of Artificial Sequence: Synthetic polypeptide
  XENP017931 6A3_H1L2_scFv(GKPGS)4
EVQLLESGGGLVQPGGSLRLSCAASGFTFSSYGMSWVRQAPGKRLEWVSTISGGGRYTYYPDSVKGRFTISRDNSKNTLYLQMNSLRAEDTAVYYCASYYDSSFDYWGQGTLVTVSSGKPGSGKPGSGKPGSGKPGSDIVMTQSPATLSVSPGERATLSCRASQDVGTAVAWYQQKPGQSPRLLIYWASTRHTGVPDRFTGSGSGTEFTLTISSLQSEDFAVYFCQHYSIYPWTFGGGTKVEIK

SEQ ID NO: 6327 - protein, 117 aa, Artificial Sequence; identical to SEQ ID NO: 6318
  Description of Artificial Sequence: Synthetic polypeptide
  VH of XENP017931

SEQ ID NO: 6328 - protein, 107 aa, Artificial Sequence
  Description of Artificial Sequence: Synthetic polypeptide
  VL of XENP017931
DIVMTQSPATLSVSPGERATLSCRASQDVGTAVAWYQQKPGQSPRLLIYWASTRHTGVPDRFTGSGSGTEFTLTISSLQSEDFAVYFCQHYSIYPWTFGGGTKVEIK

SEQ ID NO: 6329 - protein, 5 aa, Artificial Sequence
  Description of Artificial Sequence: Synthetic peptide
  XENP017931 vhCDR1
SYGMS

SEQ ID NO: 6330 - protein, 17 aa, Artificial Sequence
  Description of Artificial Sequence: Synthetic peptide
  XENP017931 vhCDR2
TISGGGRYTYYPDSVKG

SEQ ID NO: 6331 - protein, 8 aa, Artificial Sequence
  Description of Artificial Sequence: Synthetic peptide
  XENP017931 vhCDR3
YYDSSFDY

SEQ ID NO: 6332 - protein, 11 aa, Artificial Sequence
  Description of Artificial Sequence: Synthetic peptide
  XENP017931 vlCDR1
RASQDVGTAVA

SEQ ID NO: 6333 - protein, 7 aa, Artificial Sequence
  Description of Artificial Sequence: Synthetic peptide
  XENP017931 vlCDR2
WASTRHT

SEQ ID NO: 6334 - protein, 9 aa, Artificial Sequence
  Description of Artificial Sequence: Synthetic peptide
  XENP017931 vlCDR3
QHYSIYPWT

SEQ ID NO: 6335 - protein, 244 aa, Artificial Sequence
  Description of Artificial Sequence: Synthetic polypeptide
  XENP017932 6A3_H1L3_scFv(GKPGS)4
EVQLLESGGGLVQPGGSLRLSCAASGFTFSSYGMSWVRQAPGKRLEWVSTISGGGRYTYYPDSVKGRFTISRDNSKNTLYLQMNSLRAEDTAVYYCASYYDSSFDYWGQGTLVTVSSGKPGSGKPGSGKPGSGKPGSDIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIK

SEQ ID NO: 6336 - protein, 117 aa, Artificial Sequence; identical to SEQ ID NO: 6318
  Description of Artificial Sequence: Synthetic polypeptide
  VH of XENP017932

SEQ ID NO: 6337 - protein, 107 aa, Artificial Sequence
  Description of Artificial Sequence: Synthetic polypeptide
  VL of XENP017932
DIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIK

SEQ ID NO: 6338 - protein, 5 aa, Artificial Sequence
  Description of Artificial Sequence: Synthetic peptide
  XENP017932 vhCDR1
SYGMS

SEQ ID NO: 6339 - protein, 17 aa, Artificial Sequence
  Description of Artificial Sequence: Synthetic peptide
  XENP017932 vhCDR2
TISGGGRYTYYPDSVKG

SEQ ID NO: 6340 - protein, 8 aa, Artificial Sequence
  Description of Artificial Sequence: Synthetic peptide
  XENP017932 vhCDR3
YYDSSFDY

SEQ ID NO: 6341 - protein, 11 aa, Artificial Sequence
  Description of Artificial Sequence: Synthetic peptide
  XENP017932 vlCDR1
RASQDVGTAVA

SEQ ID NO: 6342 - protein, 7 aa, Artificial Sequence
  Description of Artificial Sequence: Synthetic peptide
  XENP017932 vlCDR2
WASTRHT

SEQ ID NO: 6343 - protein, 9 aa, Artificial Sequence
  Description of Artificial Sequence: Synthetic peptide
  XENP017932 vlCDR3
QHYSIYPWT

SEQ ID NO: 6344 - protein, 244 aa, Artificial Sequence
  Description of Artificial Sequence: Synthetic polypeptide
  XENP017933 6A3_H2L3_scFv(GKPGS)4
QVQLVESGGGLVKPGGSLRLSCAASGFTFSSYGMSWVRQAPGKRLEWVSTISGGGRYTYYPDSVKGRFTISRDNAKNSLYLQMNSLRAEDTAVYYCASYYDSSFDYWGQGTLVTVSSGKPGSGKPGSGKPGSGKPGSDIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIK

SEQ ID NO: 6345 - protein, 117 aa, Artificial Sequence
  Description of Artificial Sequence: Synthetic polypeptide
  VH of XENP017933
QVQLVESGGGLVKPGGSLRLSCAASGFTFSSYGMSWVRQAPGKRLEWVSTISGGGRYTYYPDSVKGRFTISRDNAKNSLYLQMNSLRAEDTAVYYCASYYDSSFDYWGQGTLVTVSS

SEQ ID NO: 6346 - protein, 107 aa, Artificial Sequence; identical to SEQ ID NO: 6337
  Description of Artificial Sequence: Synthetic polypeptide
  VL of XENP017933

SEQ ID NO: 6347 - protein, 5 aa, Artificial Sequence
  Description of Artificial Sequence: Synthetic peptide
  XENP017933 vhCDR1
SYGMS

SEQ ID NO: 6348 - protein, 17 aa, Artificial Sequence
  Description of Artificial Sequence: Synthetic peptide
  XENP017933 vhCDR2
TISGGGRYTYYPDSVKG

SEQ ID NO: 6349 - protein, 8 aa, Artificial Sequence
  Description of Artificial Sequence: Synthetic peptide
  XENP017933 vhCDR3
YYDSSFDY

SEQ ID NO: 6350 - protein, 11 aa, Artificial Sequence
  Description of Artificial Sequence: Synthetic peptide
  XENP017933 vlCDR1
RASQDVGTAVA

SEQ ID NO: 6351 - protein, 7 aa, Artificial Sequence
  Description of Artificial Sequence: Synthetic peptide
  XENP017933 vlCDR2
WASTRHT

SEQ ID NO: 6352 - protein, 9 aa, Artificial Sequence
  Description of Artificial Sequence: Synthetic peptide
  XENP017933 vlCDR3
QHYSIYPWT

SEQ ID NO: 6353 - protein, 244 aa, Artificial Sequence
  Description of Artificial Sequence: Synthetic polypeptide
  XENP017934 6A3_H1.1_L3_scFv(GKPGS)4
EVQLLESGGGLVQPGGSLRLSCAASGFTFSSYGMSWVRQAPGKGLEWVSTISGGGRYTYYPDSVKGRFTISRDNSKNTLYLQMNSLRAEDTAVYYCASYYDSSFDYWGQGTLVTVSSGKPGSGKPGSGKPGSGKPGSDIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIK

SEQ ID NO: 6354 - protein, 117 aa, Artificial Sequence
  Description of Artificial Sequence: Synthetic polypeptide
  VH of XENP017934
EVQLLESGGGLVQPGGSLRLSCAASGFTFSSYGMSWVRQAPGKGLEWVSTISGGGRYTYYPDSVKGRFTISRDNSKNTLYLQMNSLRAEDTAVYYCASYYDSSFDYWGQGTLVTVSS

SEQ ID NO: 6355 - protein, 107 aa, Artificial Sequence; identical to SEQ ID NO: 6337
  Description of Artificial Sequence: Synthetic polypeptide
  VL of XENP017934

SEQ ID NO: 6356 - protein, 5 aa, Artificial Sequence
  Description of Artificial Sequence: Synthetic peptide
  XENP017934 vhCDR1
SYGMS

SEQ ID NO: 6357 - protein, 17 aa, Artificial Sequence
  Description of Artificial Sequence: Synthetic peptide
  XENP017934 vhCDR2
TISGGGRYTYYPDSVKG

SEQ ID NO: 6358 - protein, 8 aa, Artificial Sequence
  Description of Artificial Sequence: Synthetic peptide
  XENP017934 vhCDR3
YYDSSFDY

SEQ ID NO: 6359 - protein, 11 aa, Artificial Sequence
  Description of Artificial Sequence: Synthetic peptide
  XENP017934 vlCDR1
RASQDVGTAVA

SEQ ID NO: 6360 - protein, 7 aa, Artificial Sequence
  Description of Artificial Sequence: Synthetic peptide
  XENP017934 vlCDR2
WASTRHT

SEQ ID NO: 6361 - protein, 9 aa, Artificial Sequence
  Description of Artificial Sequence: Synthetic peptide
  XENP017934 vlCDR3
QHYSIYPWT

SEQ ID NO: 6362 - protein, 249 aa, Artificial Sequence
  Description of Artificial Sequence: Synthetic polypeptide
  XENP018493 1G6_H1.1_L1_scFv(GKPGS)4
QVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6363 - protein, 122 aa, Artificial Sequence
  Description of Artificial Sequence: Synthetic polypeptide
  VH of XENP018493
QVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6364 - protein, 107 aa, Artificial Sequence; identical to SEQ ID NO: 6247
  Description of Artificial Sequence: Synthetic polypeptide
  VL of XENP018493

SEQ ID NO: 6365 - protein, 5 aa, Artificial Sequence
  Description of Artificial Sequence: Synthetic peptide
  XENP018493 vhCDR1
NYWMN

SEQ ID NO: 6366 - protein, 19 aa, Artificial Sequence
  Description of Artificial Sequence: Synthetic peptide
  XENP018493 vhCDR2
EIRLKSNNYATHYAEPVKG

SEQ ID NO: 6367 - protein, 11 aa, Artificial Sequence
  Description of Artificial Sequence: Synthetic peptide
  XENP018493 vhCDR3
YYGNYGGYFDV

SEQ ID NO: 6368 - protein, 11 aa, Artificial Sequence
  Description of Artificial Sequence: Synthetic peptide
  XENP018493 vlCDR1
RASQSVSNDVA

SEQ ID NO: 6369 - protein, 7 aa, Artificial Sequence
  Description of Artificial Sequence: Synthetic peptide
  XENP018493 vlCDR2
YASHRYT

SEQ ID NO: 6370 - protein, 9 aa, Artificial Sequence
  Description of Artificial Sequence: Synthetic peptide
  XENP018493 vlCDR3
QQDYSSPRT

SEQ ID NO: 6371 - protein, 249 aa, Artificial Sequence
  Description of Artificial Sequence: Synthetic polypeptide
  XENP018494 1G6_H1.2_L1_scFv(GKPGS)4
EVKLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6372 - protein, 122 aa, Artificial Sequence
  Description of Artificial Sequence: Synthetic polypeptide
  VH of XENP018494
EVKLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6373 - protein, 107 aa, Artificial Sequence; identical to SEQ ID NO: 6247
  Description of Artificial Sequence: Synthetic polypeptide
  VL of XENP018494

SEQ ID NO: 6374 - protein, 5 aa, Artificial Sequence
  Description of Artificial Sequence: Synthetic peptide
  XENP018494 vhCDR1
NYWMN

SEQ ID NO: 6375 - protein, 19 aa, Artificial Sequence
  Description of Artificial Sequence: Synthetic peptide
  XENP018494 vhCDR2
EIRLKSNNYATHYAEPVKG

SEQ ID NO: 6376 - protein, 11 aa, Artificial Sequence
  Description of Artificial Sequence: Synthetic peptide
  XENP018494 vhCDR3
YYGNYGGYFDV

SEQ ID NO: 6377 - protein, 11 aa, Artificial Sequence
  Description of Artificial Sequence: Synthetic peptide
  XENP018494 vlCDR1
RASQSVSNDVA

SEQ ID NO: 6378 - protein, 7 aa, Artificial Sequence
  Description of Artificial Sequence: Synthetic peptide
  XENP018494 vlCDR2
YASHRYT

SEQ ID NO: 6379 - protein, 9 aa, Artificial Sequence
  Description of Artificial Sequence: Synthetic peptide
  XENP018494 vlCDR3
QQDYSSPRT

SEQ ID NO: 6380 - protein, 249 aa, Artificial Sequence
  Description of Artificial Sequence: Synthetic polypeptide
  XENP018495 1G6_H1.3_L1_scFv(GKPGS)4
EVQLEESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6381 - protein, 122 aa, Artificial Sequence
  Description of Artificial Sequence: Synthetic polypeptide
  VH of XENP018495
EVQLEESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6382 - protein, 107 aa, Artificial Sequence; identical to SEQ ID NO: 6247
  Description of Artificial Sequence: Synthetic polypeptide
  VL of XENP018495

SEQ ID NO: 6383 - protein, 5 aa, Artificial Sequence
  Description of Artificial Sequence: Synthetic peptide
  XENP018495 vhCDR1
NYWMN

SEQ ID NO: 6384 - protein, 19 aa, Artificial Sequence
  Description of Artificial Sequence: Synthetic peptide
  XENP018495 vhCDR2
EIRLKSNNYATHYAEPVKG

SEQ ID NO: 6385 - protein, 11 aa, Artificial Sequence
  Description of Artificial Sequence: Synthetic peptide
  XENP018495 vhCDR3
YYGNYGGYFDV

SEQ ID NO: 6386 - protein, 11 aa, Artificial Sequence
  Description of Artificial Sequence: Synthetic peptide
  XENP018495 vlCDR1
RASQSVSNDVA

SEQ ID NO: 6387 - protein, 7 aa, Artificial Sequence
  Description of Artificial Sequence: Synthetic peptide
  XENP018495 vlCDR2
YASHRYT

SEQ ID NO: 6388 - protein, 9 aa, Artificial Sequence
  Description of Artificial Sequence: Synthetic peptide
  XENP018495 vlCDR3
QQDYSSPRT

SEQ ID NO: 6389 - protein, 249 aa, Artificial Sequence
  Description of Artificial Sequence: Synthetic polypeptide
  XENP018496 1G6_H1.4_L1_scFv(GKPGS)4
EVQLVESGGGLVQPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6390 - protein, 122 aa, Artificial Sequence
  Description of Artificial Sequence: Synthetic polypeptide
  VH of XENP018496
EVQLVESGGGLVQPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6391 - protein, 107 aa, Artificial Sequence; identical to SEQ ID NO: 6247
  Description of Artificial Sequence: Synthetic polypeptide
  VL of XENP018496

SEQ ID NO: 6392 - protein, 5 aa, Artificial Sequence
  Description of Artificial Sequence: Synthetic peptide
  XENP018496 vhCDR1
NYWMN

SEQ ID NO: 6393 - protein, 19 aa, Artificial Sequence
  Description of Artificial Sequence: Synthetic peptide
  XENP018496 vhCDR2
EIRLKSNNYATHYAEPVKG

SEQ ID NO: 6394 - protein, 11 aa, Artificial Sequence
  Description of Artificial Sequence: Synthetic peptide
  XENP018496 vhCDR3
YYGNYGGYFDV

SEQ ID NO: 6395 - protein, 11 aa, Artificial Sequence
  Description of Artificial Sequence: Synthetic peptide
  XENP018496 vlCDR1
RASQSVSNDVA

SEQ ID NO: 6396 - protein, 7 aa, Artificial Sequence
  Description of Artificial Sequence: Synthetic peptide
  XENP018496 vlCDR2
YASHRYT

SEQ ID NO: 6397 - protein, 9 aa, Artificial Sequence
  Description of Artificial Sequence: Synthetic peptide
  XENP018496 vlCDR3
QQDYSSPRT

SEQ ID NO: 6398 - protein, 249 aa, Artificial Sequence
  Description of Artificial Sequence: Synthetic polypeptide
  XENP018501 1G6_H1.5_L1_scFv(GKPGS)4
EVQLVESGGGLVRPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6399 - protein, 122 aa, Artificial Sequence
  Description of Artificial Sequence: Synthetic polypeptide
  VH of XENP018501
EVQLVESGGGLVRPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6400 - protein, 107 aa, Artificial Sequence; identical to SEQ ID NO: 6247
  Description of Artificial Sequence: Synthetic polypeptide
  VL of XENP018501

SEQ ID NO: 6401 - protein, 5 aa, Artificial Sequence
  Description of Artificial Sequence: Synthetic peptide
  XENP018501 vhCDR1
NYWMN

SEQ ID NO: 6402 - protein, 19 aa, Artificial Sequence
  Description of Artificial Sequence: Synthetic peptide
  XENP018501 vhCDR2
EIRLKSNNYATHYAEPVKG

SEQ ID NO: 6403 - protein, 11 aa, Artificial Sequence
  Description of Artificial Sequence: Synthetic peptide
  XENP018501 vhCDR3
YYGNYGGYFDV

SEQ ID NO: 6404 - protein, 11 aa, Artificial Sequence
  Description of Artificial Sequence: Synthetic peptide
  XENP018501 vlCDR1
RASQSVSNDVA

SEQ ID NO: 6405 - protein, 7 aa, Artificial Sequence
  Description of Artificial Sequence: Synthetic peptide
  XENP018501 vlCDR2
YASHRYT

SEQ ID NO: 6406 - protein, 9 aa, Artificial Sequence
  Description of Artificial Sequence: Synthetic peptide
  XENP018501 vlCDR3
QQDYSSPRT

SEQ ID NO: 6407 - protein, 249 aa, Artificial Sequence
  Description of Artificial Sequence: Synthetic polypeptide
  XENP018502 1G6_H1.6_L1_scFv(GKPGS)4
EVQLVESGGGLVKPGGSMRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6408 - protein, 122 aa, Artificial Sequence
  Description of Artificial Sequence: Synthetic polypeptide
  VH of XENP018502
EVQLVESGGGLVKPGGSMRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6409 - protein, 107 aa, Artificial Sequence; identical to SEQ ID NO: 6247
  Description of Artificial Sequence: Synthetic polypeptide
  VL of XENP018502

SEQ ID NO: 6410 - protein, 5 aa, Artificial Sequence
  Description of Artificial Sequence: Synthetic peptide
  XENP018502 vhCDR1
NYWMN

SEQ ID NO: 6411 - protein, 19 aa, Artificial Sequence
  Description of Artificial Sequence: Synthetic peptide
  XENP018502 vhCDR2
EIRLKSNNYATHYAEPVKG

SEQ ID NO: 6412 - protein, 11 aa, Artificial Sequence
  Description of Artificial Sequence: Synthetic peptide
  XENP018502 vhCDR3
YYGNYGGYFDV

SEQ ID NO: 6413 - protein, 11 aa, Artificial Sequence
  Description of Artificial Sequence: Synthetic peptide
  XENP018502 vlCDR1
RASQSVSNDVA

SEQ ID NO: 6414 - protein, 7 aa, Artificial Sequence
  Description of Artificial Sequence: Synthetic peptide
  XENP018502 vlCDR2
YASHRYT

SEQ ID NO: 6415 - protein, 9 aa, Artificial Sequence
  Description of Artificial Sequence: Synthetic peptide
  XENP018502 vlCDR3
QQDYSSPRT

SEQ ID NO: 6416 - protein, 249 aa, Artificial Sequence
  Description of Artificial Sequence: Synthetic polypeptide
  XENP018503 1G6_H1.7_L1_scFv(GKPGS)4
EVQLVESGGGLVKPGGSLKLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6417 - protein, 122 aa, Artificial Sequence
  Description of Artificial Sequence: Synthetic polypeptide
  VH of XENP018503
EVQLVESGGGLVKPGGSLKLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6418 - protein, 107 aa, Artificial Sequence; identical to SEQ ID NO: 6247
  Description of Artificial Sequence: Synthetic polypeptide
  VL of XENP018503

SEQ ID NO: 6419 - protein, 5 aa, Artificial Sequence
  Description of Artificial Sequence: Synthetic peptide
  XENP018503 vhCDR1
NYWMN

SEQ ID NO: 6420 - protein, 19 aa, Artificial Sequence
  Description of Artificial Sequence: Synthetic peptide
  XENP018503 vhCDR2
EIRLKSNNYATHYAEPVKG

SEQ ID NO: 6421 - protein, 11 aa, Artificial Sequence
  Description of Artificial Sequence: Synthetic peptide
  XENP018503 vhCDR3
YYGNYGGYFDV

SEQ ID NO: 6422 - protein, 11 aa, Artificial Sequence
  Description of Artificial Sequence: Synthetic peptide
  XENP018503 vlCDR1
RASQSVSNDVA

SEQ ID NO: 6423 - protein, 7 aa, Artificial Sequence
  Description of Artificial Sequence: Synthetic peptide
  XENP018503 vlCDR2
YASHRYT

SEQ ID NO: 6424 - protein, 9 aa, Artificial Sequence
  Description of Artificial Sequence: Synthetic peptide
  XENP018503 vlCDR3
QQDYSSPRT

SEQ ID NO: 6425 - protein, 249 aa, Artificial Sequence
  Description of Artificial Sequence: Synthetic polypeptide
  XENP018504 1G6_H1.8_L1_scFv(GKPGS)4
EVQLVESGGGLVKPGGSLRLSCVASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6426 - protein, 122 aa, Artificial Sequence
  Description of Artificial Sequence: Synthetic polypeptide
  VH of XENP018504
EVQLVESGGGLVKPGGSLRLSCVASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6427 - protein, 107 aa, Artificial Sequence; identical to SEQ ID NO: 6247
  Description of Artificial Sequence: Synthetic polypeptide
  VL of XENP018504

SEQ ID NO: 6428 - protein, 5 aa, Artificial Sequence
  Description of Artificial Sequence: Synthetic peptide
  XENP018504 vhCDR1
NYWMN

SEQ ID NO: 6429 - protein, 19 aa, Artificial Sequence
  Description of Artificial Sequence: Synthetic peptide
  XENP018504 vhCDR2
EIRLKSNNYATHYAEPVKG

SEQ ID NO: 6430 - protein, 11 aa, Artificial Sequence
  Description of Artificial Sequence: Synthetic peptide
  XENP018504 vhCDR3
YYGNYGGYFDV

SEQ ID NO: 6431 - protein, 11 aa, Artificial Sequence
  Description of Artificial Sequence: Synthetic peptide
  XENP018504 vlCDR1
RASQSVSNDVA

SEQ ID NO: 6432 - protein, 7 aa, Artificial Sequence
  Description of Artificial Sequence: Synthetic peptide
  XENP018504 vlCDR2
YASHRYT

SEQ ID NO: 6433 - protein, 9 aa, Artificial Sequence
  Description of Artificial Sequence: Synthetic peptide
  XENP018504 vlCDR3
QQDYSSPRT

SEQ ID NO: 6434 - protein, 249 aa, Artificial Sequence
  Description of Artificial Sequence: Synthetic polypeptide
  XENP018505 1G6_H1.9_L1_scFv(GKPGS)4
EVQLVESGGGLVKPGGSLRLSCAASGFTVSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6435 - protein, 122 aa, Artificial Sequence
  Description of Artificial Sequence: Synthetic polypeptide
  VH of XENP018505
EVQLVESGGGLVKPGGSLRLSCAASGFTVSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6436 - protein, 107 aa, Artificial Sequence; identical to SEQ ID NO: 6247
  Description of Artificial Sequence: Synthetic polypeptide
  VL of XENP018505

SEQ ID NO: 6437 - protein, 5 aa, Artificial Sequence
  Description of Artificial Sequence: Synthetic peptide
  XENP018505 vhCDR1
NYWMN

SEQ ID NO: 6438 - protein, 19 aa, Artificial Sequence
  Description of Artificial Sequence: Synthetic peptide
  XENP018505 vhCDR2
EIRLKSNNYATHYAEPVKG

SEQ ID NO: 6439 - protein, 11 aa, Artificial Sequence
  Description of Artificial Sequence: Synthetic peptide
  XENP018505 vhCDR3
YYGNYGGYFDV

SEQ ID NO: 6440 - protein, 11 aa, Artificial Sequence
  Description of Artificial Sequence: Synthetic peptide
  XENP018505 vlCDR1
RASQSVSNDVA

SEQ ID NO: 6441 - protein, 7 aa, Artificial Sequence
  Description of Artificial Sequence: Synthetic peptide
  XENP018505 vlCDR2
YASHRYT

SEQ ID NO: 6442 - protein, 9 aa, Artificial Sequence
  Description of Artificial Sequence: Synthetic peptide
  XENP018505 vlCDR3
QQDYSSPRT

SEQ ID NO: 6443 - protein, 249 aa, Artificial Sequence
  Description of Artificial Sequence: Synthetic polypeptide
  XENP018506 1G6_H1.10_L1_scFv(GKPGS)4
EVQLVESGGGLVKPGGSLRLSCAASGFTFTNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6444 - protein, 122 aa, Artificial Sequence
  Description of Artificial Sequence: Synthetic polypeptide
  VH of XENP018506
EVQLVESGGGLVKPGGSLRLSCAASGFTFTNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6445 - protein, 107 aa, Artificial Sequence; identical to SEQ ID NO: 6247
  Description of Artificial Sequence: Synthetic polypeptide
  VL of XENP018506

SEQ ID NO: 6446 - protein, 5 aa, Artificial Sequence
  Description of Artificial Sequence: Synthetic peptide
  XENP018506 vhCDR1
NYWMN

SEQ ID NO: 6447 - protein, 19 aa, Artificial Sequence
  Description of Artificial Sequence: Synthetic peptide
  XENP018506 vhCDR2
EIRLKSNNYATHYAEPVKG

SEQ ID NO: 6448 - protein, 11 aa, Artificial Sequence
  Description of Artificial Sequence: Synthetic peptide
  XENP018506 vhCDR3
YYGNYGGYFDV

SEQ ID NO: 6449 - protein, 11 aa, Artificial Sequence
  Description of Artificial Sequence: Synthetic peptide
  XENP018506 vlCDR1
RASQSVSNDVA

SEQ ID NO: 6450 - protein, 7 aa, Artificial Sequence
  Description of Artificial Sequence: Synthetic peptide
  XENP018506 vlCDR2
YASHRYT

SEQ ID NO: 6451 - protein, 9 aa, Artificial Sequence
  Description of Artificial Sequence: Synthetic peptide
  XENP018506 vlCDR3
QQDYSSPRT

SEQ ID NO: 6452 - protein, 249 aa, Artificial Sequence
  Description of Artificial Sequence: Synthetic polypeptide
  XENP018507 1G6_H1.11_L1_scFv(GKPGS)4
EVQLVESGGGLVKPGGSLRLSCAASGFTFANYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6453 - protein, 122 aa, Artificial Sequence
  Description of Artificial Sequence: Synthetic polypeptide
  VH of XENP018507
EVQLVESGGGLVKPGGSLRLSCAASGFTFANYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6454 - protein, 107 aa, Artificial Sequence; identical to SEQ ID NO: 6247
  Description of Artificial Sequence: Synthetic polypeptide
  VL of XENP018507

SEQ ID NO: 6455 - protein, 5 aa, Artificial Sequence
  Description of Artificial Sequence: Synthetic peptide
  XENP018507 vhCDR1
NYWMN

SEQ ID NO: 6456 - protein, 19 aa, Artificial Sequence
  Description of Artificial Sequence: Synthetic peptide
  XENP018507 vhCDR2
EIRLKSNNYATHYAEPVKG

SEQ ID NO: 6457 - protein, 11 aa, Artificial Sequence
  Description of Artificial Sequence: Synthetic peptide
  XENP018507 vhCDR3
YYGNYGGYFDV

SEQ ID NO: 6458 - protein, 11 aa, Artificial Sequence
  Description of Artificial Sequence: Synthetic peptide
  XENP018507 vlCDR1
RASQSVSNDVA

SEQ ID NO: 6459 - protein, 7 aa, Artificial Sequence
  Description of Artificial Sequence: Synthetic peptide
  XENP018507 vlCDR2
YASHRYT

SEQ ID NO: 6460 - protein, 9 aa, Artificial Sequence
  Description of Artificial Sequence: Synthetic peptide
  XENP018507 vlCDR3
QQDYSSPRT

SEQ ID NO: 6461 - protein, 249 aa, Artificial Sequence
  Description of Artificial Sequence: Synthetic polypeptide
  XENP018508 1G6_H1.12_L1_scFv(GKPGS)4
EVQLVESGGGLVKPGGSLRLSCAASGFTFQNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6462 - protein, 122 aa, Artificial Sequence
  Description of Artificial Sequence: Synthetic polypeptide
  VH of XENP018508
EVQLVESGGGLVKPGGSLRLSCAASGFTFQNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6463 - protein, 107 aa, Artificial Sequence; identical to SEQ ID NO: 6247
  Description of Artificial Sequence: Synthetic polypeptide
  VL of XENP018508

SEQ ID NO: 6464 - protein, 5 aa, Artificial Sequence
  Description of Artificial Sequence: Synthetic peptide
  XENP018508 vhCDR1
NYWMN

SEQ ID NO: 6465 - protein, 19 aa, Artificial Sequence
  Description of Artificial Sequence: Synthetic peptide
  XENP018508 vhCDR2
EIRLKSNNYATHYAEPVKG

SEQ ID NO: 6466 - protein, 11 aa, Artificial Sequence
  Description of Artificial Sequence: Synthetic peptide
  XENP018508 vhCDR3
YYGNYGGYFDV

SEQ ID NO: 6467 - protein, 11 aa, Artificial Sequence
  Description of Artificial Sequence: Synthetic peptide
  XENP018508 vlCDR1
RASQSVSNDVA

SEQ ID NO: 6468 - protein, 7 aa, Artificial Sequence
  Description of Artificial Sequence: Synthetic peptide
  XENP018508 vlCDR2
YASHRYT

SEQ ID NO: 6469 - protein, 9 aa, Artificial Sequence
  Description of Artificial Sequence: Synthetic peptide
  XENP018508 vlCDR3
QQDYSSPRT

SEQ ID NO: 6470 - protein, 249 aa, Artificial Sequence
  Description of Artificial Sequence: Synthetic polypeptide
  XENP018509 1G6_H1.13_L1_scFv(GKPGS)4
EVQLVESGGGLVKPGGSLRLSCAASGFTFGNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6471 - protein, 122 aa, Artificial Sequence
  Description of Artificial Sequence: Synthetic polypeptide
  VH of XENP018509
EVQLVESGGGLVKPGGSLRLSCAASGFTFGNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6472 - protein, 107 aa, Artificial Sequence; identical to SEQ ID NO: 6247
  Description of Artificial Sequence: Synthetic polypeptide
  VL of XENP018509

SEQ ID NO: 6473 - protein, 5 aa, Artificial Sequence
  Description of Artificial Sequence: Synthetic peptide
  XENP018509 vhCDR1
NYWMN

SEQ ID NO: 6474 - protein, 19 aa, Artificial Sequence
  Description of Artificial Sequence: Synthetic peptide
  XENP018509 vhCDR2
EIRLKSNNYATHYAEPVKG

SEQ ID NO: 6475 - protein, 11 aa, Artificial Sequence
  Description of Artificial Sequence: Synthetic peptide
  XENP018509 vhCDR3
YYGNYGGYFDV

SEQ ID NO: 6476 - protein, 11 aa, Artificial Sequence
  Description of Artificial Sequence: Synthetic peptide
  XENP018509 vlCDR1
RASQSVSNDVA

SEQ ID NO: 6477 - protein, 7 aa, Artificial Sequence
  Description of Artificial Sequence: Synthetic peptide
  XENP018509 vlCDR2
YASHRYT

SEQ ID NO: 6478 - protein, 9 aa, Artificial Sequence
  Description of Artificial Sequence: Synthetic peptide
  XENP018509 vlCDR3
QQDYSSPRT

SEQ ID NO: 6479 - protein, 249 aa, Artificial Sequence
  Description of Artificial Sequence: Synthetic polypeptide
  XENP018510 1G6_H1.14_L1_scFv(GKPGS)4
EVQLVESGGGLVKPGGSLRLSCAASGFTFVNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6480 - protein, 122 aa, Artificial Sequence
  Description of Artificial Sequence: Synthetic polypeptide
  VH of XENP018510
EVQLVESGGGLVKPGGSLRLSCAASGFTFVNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6481 - protein, 107 aa, Artificial Sequence; identical to SEQ ID NO: 6247
  Description of Artificial Sequence: Synthetic polypeptide
  VL of XENP018510

SEQ ID NO: 6482 - protein, 5 aa, Artificial Sequence
  Description of Artificial Sequence: Synthetic peptide
  XENP018510 vhCDR1
NYWMN

SEQ ID NO: 6483 - protein, 19 aa, Artificial Sequence
  Description of Artificial Sequence: Synthetic peptide
  XENP018510 vhCDR2
EIRLKSNNYATHYAEPVKG

SEQ ID NO: 6484 - protein, 11 aa, Artificial Sequence
  Description of Artificial Sequence: Synthetic peptide
  XENP018510 vhCDR3
YYGNYGGYFDV

SEQ ID NO: 6485 - protein, 11 aa, Artificial Sequence
  Description of Artificial Sequence: Synthetic peptide
  XENP018510 vlCDR1
RASQSVSNDVA

SEQ ID NO: 6486 - protein, 7 aa, Artificial Sequence
  Description of Artificial Sequence: Synthetic peptide
  XENP018510 vlCDR2
YASHRYT

SEQ ID NO: 6487 - protein, 9 aa, Artificial Sequence
  Description of Artificial Sequence: Synthetic peptide
  XENP018510 vlCDR3
QQDYSSPRT

SEQ ID NO: 6488 - protein, 249 aa, Artificial Sequence
  Description of Artificial Sequence: Synthetic polypeptide
  XENP018511 1G6_H1.15_L1_scFv(GKPGS)4
EVQLVESGGGLVKPGGSLRLSCAASGFTFHNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6489 - protein, 122 aa, Artificial Sequence
  Description of Artificial Sequence: Synthetic polypeptide
  VH of XENP018511
EVQLVESGGGLVKPGGSLRLSCAASGFTFHNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6490 - protein, 107 aa, Artificial Sequence; identical to SEQ ID NO: 6247
  Description of Artificial Sequence: Synthetic polypeptide
  VL of XENP018511

SEQ ID NO: 6491 - protein, 5 aa, Artificial Sequence
  Description of Artificial Sequence: Synthetic peptide
  XENP018511 vhCDR1
NYWMN

SEQ ID NO: 6492 - protein, 19 aa, Artificial Sequence
  Description of Artificial Sequence: Synthetic peptide
  XENP018511 vhCDR2
EIRLKSNNYATHYAEPVKG

SEQ ID NO: 6493 - protein, 11 aa, Artificial Sequence
  Description of Artificial Sequence: Synthetic peptide
  XENP018511 vhCDR3
YYGNYGGYFDV

SEQ ID NO: 6494 - protein, 11 aa, Artificial Sequence
  Description of Artificial Sequence: Synthetic peptide
  XENP018511 vlCDR1
RASQSVSNDVA

SEQ ID NO: 6495 - protein, 7 aa, Artificial Sequence
  Description of Artificial Sequence: Synthetic peptide
  XENP018511 vlCDR2
YASHRYT

SEQ ID NO: 6496 - protein, 9 aa, Artificial Sequence
  Description of Artificial Sequence: Synthetic peptide
  XENP018511 vlCDR3
QQDYSSPRT

SEQ ID NO: 6497 - protein, 249 aa, Artificial Sequence
  Description of Artificial Sequence: Synthetic polypeptide
  XENP018512 1G6_H1.16_L1_scFv(GKPGS)4
EVQLVESGGGLVKPGGSLRLSCAASGFTFDNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6498 - protein, 122 aa, Artificial Sequence
  Description of Artificial Sequence: Synthetic polypeptide
  VH of XENP018512
EVQLVESGGGLVKPGGSLRLSCAASGFTFDNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6499 - protein, 107 aa, Artificial Sequence; identical to SEQ ID NO: 6247
  Description of Artificial Sequence: Synthetic polypeptide
  VL of XENP018512

SEQ ID NO: 6500 - protein, 5 aa, Artificial Sequence
  Description of Artificial Sequence: Synthetic peptide
  XENP018512 vhCDR1
NYWMN

SEQ ID NO: 6501 - protein, 19 aa, Artificial Sequence
  Description of Artificial Sequence: Synthetic peptide
  XENP018512 vhCDR2
EIRLKSNNYATHYAEPVKG

SEQ ID NO: 6502 - protein, 11 aa, Artificial Sequence
  Description of Artificial Sequence: Synthetic peptide
  XENP018512 vhCDR3
YYGNYGGYFDV

SEQ ID NO: 6503 - protein, 11 aa, Artificial Sequence
  Description of Artificial Sequence: Synthetic peptide
  XENP018512 vlCDR1
RASQSVSNDVA

SEQ ID NO: 6504 - protein, 7 aa, Artificial Sequence
  Description of Artificial Sequence: Synthetic peptide
  XENP018512 vlCDR2
YASHRYT

SEQ ID NO: 6505 - protein, 9 aa, Artificial Sequence
  Description of Artificial Sequence: Synthetic peptide
  XENP018512 vlCDR3
QQDYSSPRT

SEQ ID NO: 6506 - protein, 249 aa, Artificial Sequence
  Description of Artificial Sequence: Synthetic polypeptide
  XENP018513 1G6_H1.17_L1_scFv(GKPGS)4
EVQLVESGGGLVKPGGSLRLSCAASGFTFKNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6507 - protein, 122 aa, Artificial Sequence
  Description of Artificial Sequence: Synthetic polypeptide
  VH of XENP018513
EVQLVESGGGLVKPGGSLRLSCAASGFTFKNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6508 - protein, 107 aa, Artificial Sequence; identical to SEQ ID NO: 6247
  Description of Artificial Sequence: Synthetic polypeptide
  VL of XENP018513

SEQ ID NO: 6509 - protein, 5 aa, Artificial Sequence
  Description of Artificial Sequence: Synthetic peptide
  XENP018513 vhCDR1
NYWMN

SEQ ID NO: 6510 - protein, 19 aa, Artificial Sequence
  Description of Artificial Sequence: Synthetic peptide
  XENP018513 vhCDR2
EIRLKSNNYATHYAEPVKG

SEQ ID NO: 6511 - protein, 11 aa, Artificial Sequence
  Description of Artificial Sequence: Synthetic peptide
  XENP018513 vhCDR3
YYGNYGGYFDV

SEQ ID NO: 6512 - protein, 11 aa, Artificial Sequence
  Description of Artificial Sequence: Synthetic peptide
  XENP018513 vlCDR1
RASQSVSNDVA

SEQ ID NO: 6513 - protein, 7 aa, Artificial Sequence
  Description of Artificial Sequence: Synthetic peptide
  XENP018513 vlCDR2
YASHRYT

SEQ ID NO: 6514 - protein, 9 aa, Artificial Sequence
  Description of Artificial Sequence: Synthetic peptide
  XENP018513 vlCDR3
QQDYSSPRT

SEQ ID NO: 6515 - protein, 249 aa, Artificial Sequence
  Description of Artificial Sequence: Synthetic polypeptide
  XENP018514 1G6_H1.18_L1_scFv(GKPGS)4
EVQLVESGGGLVKPGGSLRLSCAASGFTFYNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6516 - protein, 122 aa, Artificial Sequence
  Description of Artificial Sequence: Synthetic polypeptide
  VH of XENP018514
EVQLVESGGGLVKPGGSLRLSCAASGFTFYNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6517 - protein, 107 aa, Artificial Sequence; identical to SEQ ID NO: 6247
  Description of Artificial Sequence: Synthetic polypeptide
  VL of XENP018514

SEQ ID NO: 6518 - protein, 5 aa, Artificial Sequence
  Description of Artificial Sequence: Synthetic peptide
  XENP018514 vhCDR1
NYWMN

SEQ ID NO: 6519 - protein, 19 aa, Artificial Sequence
  Description of Artificial Sequence: Synthetic peptide
  XENP018514 vhCDR2
EIRLKSNNYATHYAEPVKG

SEQ ID NO: 6520 - protein, 11 aa, Artificial Sequence
  Description of Artificial Sequence: Synthetic peptide
  XENP018514 vhCDR3
YYGNYGGYFDV

SEQ ID NO: 6521 - protein, 11 aa, Artificial Sequence
  Description of Artificial Sequence: Synthetic peptide
  XENP018514 vlCDR1
RASQSVSNDVA

SEQ ID NO: 6522 - protein, 7 aa, Artificial Sequence
  Description of Artificial Sequence: Synthetic peptide
  XENP018514 vlCDR2
YASHRYT

SEQ ID NO: 6523 - protein, 9 aa, Artificial Sequence
  Description of Artificial Sequence: Synthetic peptide
  XENP018514 vlCDR3
QQDYSSPRT

SEQ ID NO: 6524 - protein, 249 aa, Artificial Sequence
  Description of Artificial Sequence: Synthetic polypeptide
  XENP018515 1G6_H1.19_L1_scFv(GKPGS)4
EVQLVESGGGLVKPGGSLRLSCAASGFTFSDYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6525 - protein, 122 aa, Artificial Sequence
  Description of Artificial Sequence: Synthetic polypeptide
  VH of XENP018515
EVQLVESGGGLVKPGGSLRLSCAASGFTFSDYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6526 - protein, 107 aa, Artificial Sequence; identical to SEQ ID NO: 6247
  Description of Artificial Sequence: Synthetic polypeptide
  VL of XENP018515

SEQ ID NO: 6527 - protein, 5 aa, Artificial Sequence
  Description of Artificial Sequence: Synthetic peptide
  XENP018515 vhCDR1
DYWMN

SEQ ID NO: 6528 - protein, 19 aa, Artificial Sequence
  Description of Artificial Sequence: Synthetic peptide
  XENP018515 vhCDR2
EIRLKSNNYATHYAEPVKG

SEQ ID NO: 6529 - protein, 11 aa, Artificial Sequence
  Description of Artificial Sequence: Synthetic peptide
  XENP018515 vhCDR3
YYGNYGGYFDV

SEQ ID NO: 6530 - protein, 11 aa, Artificial Sequence
  Description of Artificial Sequence: Synthetic peptide
  XENP018515 vlCDR1
RASQSVSNDVA

SEQ ID NO: 6531 - protein, 7 aa, Artificial Sequence
  Description of Artificial Sequence: Synthetic peptide
  XENP018515 vlCDR2
YASHRYT

SEQ ID NO: 6532 - protein, 9 aa, Artificial Sequence
  Description of Artificial Sequence: Synthetic peptide
  XENP018515 vlCDR3
QQDYSSPRT

SEQ ID NO: 6533 - protein, 249 aa, Artificial Sequence
  Description of Artificial Sequence: Synthetic polypeptide
  XENP018516 1G6_H1.20_L1_scFv(GKPGS)4
EVQLVESGGGLVKPGGSLRLSCAASGFTFSHYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6534 - protein, 122 aa, Artificial Sequence
  Description of Artificial Sequence: Synthetic polypeptide
  VH of XENP018516
EVQLVESGGGLVKPGGSLRLSCAASGFTFSHYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6535 - protein, 107 aa, Artificial Sequence; identical to SEQ ID NO: 6247
  Description of Artificial Sequence: Synthetic polypeptide
  VL of XENP018516

SEQ ID NO: 6536 - protein, 5 aa, Artificial Sequence
  Description of Artificial Sequence: Synthetic peptide
  XENP018516 vhCDR1
HYWMN

SEQ ID NO: 6537 - protein, 19 aa, Artificial Sequence
  Description of Artificial Sequence: Synthetic peptide
  XENP018516 vhCDR2
EIRLKSNNYATHYAEPVKG

SEQ ID NO: 6538 - protein, 11 aa, Artificial Sequence
  Description of Artificial Sequence: Synthetic peptide
  XENP018516 vhCDR3
YYGNYGGYFDV

SEQ ID NO: 6539 - protein, 11 aa, Artificial Sequence
  Description of Artificial Sequence: Synthetic peptide
  XENP018516 vlCDR1
RASQSVSNDVA

SEQ ID NO: 6540 - protein, 7 aa, Artificial Sequence
  Description of Artificial Sequence: Synthetic peptide
  XENP018516 vlCDR2
YASHRYT

SEQ ID NO: 6541 - protein, 9 aa, Artificial Sequence
  Description of Artificial Sequence: Synthetic peptide
  XENP018516 vlCDR3
QQDYSSPRT

SEQ ID NO: 6542 - protein, 249 aa, Artificial Sequence
  Description of Artificial Sequence: Synthetic polypeptide
  XENP018517 1G6_H1.21_L1_scFv(GKPGS)4
EVQLVESGGGLVKPGGSLRLSCAASGFTFSEYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6543 - protein, 122 aa, Artificial Sequence
  Description of Artificial Sequence: Synthetic polypeptide
  VH of XENP018517
EVQLVESGGGLVKPGGSLRLSCAASGFTFSEYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6544 - protein, 107 aa, Artificial Sequence; identical to SEQ ID NO: 6247
  Description of Artificial Sequence: Synthetic polypeptide
  VL of XENP018517

SEQ ID NO: 6545 - protein, 5 aa, Artificial Sequence
  Description of Artificial Sequence: Synthetic peptide
  XENP018517 vhCDR1
EYWMN

SEQ ID NO: 6546 - protein, 19 aa, Artificial Sequence
  Description of Artificial Sequence: Synthetic peptide
  XENP018517 vhCDR2
EIRLKSNNYATHYAEPVKG

SEQ ID NO: 6547 - protein, 11 aa, Artificial Sequence
  Description of Artificial Sequence: Synthetic peptide
  XENP018517 vhCDR3
YYGNYGGYFDV

SEQ ID NO: 6548 - protein, 11 aa, Artificial Sequence
  Description of Artificial Sequence: Synthetic peptide
  XENP018517 vlCDR1
RASQSVSNDVA

SEQ ID NO: 6549 - protein, 7 aa, Artificial Sequence
  Description of Artificial Sequence: Synthetic peptide
  XENP018517 vlCDR2
YASHRYT

SEQ ID NO: 6550 - protein, 9 aa, Artificial Sequence
  Description of Artificial Sequence: Synthetic peptide
  XENP018517 vlCDR3
QQDYSSPRT

SEQ ID NO: 6551 - protein, 249 aa, Artificial Sequence
  Description of Artificial Sequence: Synthetic polypeptide
  XENP018518 1G6_H1.22_L1_scFv(GKPGS)4
EVQLVESGGGLVKPGGSLRLSCAASGFTFSSYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6552 - protein, 122 aa, Artificial Sequence
  Description of Artificial Sequence: Synthetic polypeptide
  VH of XENP018518
EVQLVESGGGLVKPGGSLRLSCAASGFTFSSYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6553 - protein, 107 aa, Artificial Sequence; identical to SEQ ID NO: 6247
  Description of Artificial Sequence: Synthetic polypeptide
  VL of XENP018518

SEQ ID NO: 6554 - protein, 5 aa, Artificial Sequence
  Description of Artificial Sequence: Synthetic peptide
  XENP018518 vhCDR1
SYWMN

SEQ ID NO: 6555 - protein, 19 aa, Artificial Sequence
  Description of Artificial Sequence: Synthetic peptide
  XENP018518 vhCDR2
EIRLKSNNYATHYAEPVKG

SEQ ID NO: 6556 - protein, 11 aa, Artificial Sequence
  Description of Artificial Sequence: Synthetic peptide
  XENP018518 vhCDR3
YYGNYGGYFDV

SEQ ID NO: 6557 - protein, 11 aa, Artificial Sequence
  Description of Artificial Sequence: Synthetic peptide
  XENP018518 vlCDR1
RASQSVSNDVA

SEQ ID NO: 6558 - protein, 7 aa, Artificial Sequence
  Description of Artificial Sequence: Synthetic peptide
  XENP018518 vlCDR2
YASHRYT

SEQ ID NO: 6559 - protein, 9 aa, Artificial Sequence
  Description of Artificial Sequence: Synthetic peptide
  XENP018518 vlCDR3
QQDYSSPRT

SEQ ID NO: 6560 - protein, 249 aa, Artificial Sequence
  Description of Artificial Sequence: Synthetic polypeptide
  XENP018519 1G6_H1.23_L1_scFv(GKPGS)4
EVQLVESGGGLVKPGGSLRLSCAASGFTFSRYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6561 - protein, 122 aa, Artificial Sequence
  Description of Artificial Sequence: Synthetic polypeptide
  VH of XENP018519
EVQLVESGGGLVKPGGSLRLSCAASGFTFSRYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6562 - protein, 107 aa, Artificial Sequence; identical to SEQ ID NO: 6247
  Description of Artificial Sequence: Synthetic polypeptide
  VL of XENP018519

SEQ ID NO: 6563 - protein, 5 aa, Artificial Sequence
  Description of Artificial Sequence: Synthetic peptide
  XENP018519 vhCDR1
RYWMN

SEQ ID NO: 6564 - protein, 19 aa, Artificial Sequence
  Description of Artificial Sequence: Synthetic peptide
  XENP018519 vhCDR2
EIRLKSNNYATHYAEPVKG

SEQ ID NO: 6565 - protein, 11 aa, Artificial Sequence
  Description of Artificial Sequence: Synthetic peptide
  XENP018519 vhCDR3
YYGNYGGYFDV

SEQ ID NO: 6566 - protein, 11 aa, Artificial Sequence
  Description of Artificial Sequence: Synthetic peptide
  XENP018519 vlCDR1
RASQSVSNDVA

SEQ ID NO: 6567 - protein, 7 aa, Artificial Sequence
  Description of Artificial Sequence: Synthetic peptide
  XENP018519 vlCDR2
YASHRYT

SEQ ID NO: 6568 - protein, 9 aa, Artificial Sequence
  Description of Artificial Sequence: Synthetic peptide
  XENP018519 vlCDR3
QQDYSSPRT

SEQ ID NO: 6569 - protein, 249 aa, Artificial Sequence
  Description of Artificial Sequence: Synthetic polypeptide
  XENP018520 1G6_H1.24_L1_scFv(GKPGS)4
EVQLVESGGGLVKPGGSLRLSCAASGFTFSLYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6570 - protein, 122 aa, Artificial Sequence
  Description of Artificial Sequence: Synthetic polypeptide
  VH of XENP018520
EVQLVESGGGLVKPGGSLRLSCAASGFTFSLYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6571 - protein, 107 aa, Artificial Sequence; identical to SEQ ID NO: 6247
  Description of Artificial Sequence: Synthetic polypeptide
  VL of XENP018520

SEQ ID NO: 6572 - protein, 5 aa, Artificial Sequence
  Description of Artificial Sequence: Synthetic peptide
  XENP018520 vhCDR1
LYWMN

SEQ ID NO: 6573 - protein, 19 aa, Artificial Sequence
  Description of Artificial Sequence: Synthetic peptide
  XENP018520 vhCDR2
EIRLKSNNYATHYAEPVKG

SEQ ID NO: 6574 - protein, 11 aa, Artificial Sequence
  Description of Artificial Sequence: Synthetic peptide
  XENP018520 vhCDR3
YYGNYGGYFDV

SEQ ID NO: 6575 - protein, 11 aa, Artificial Sequence
  Description of Artificial Sequence: Synthetic peptide
  XENP018520 vlCDR1
RASQSVSNDVA

SEQ ID NO: 6576 - protein, 7 aa, Artificial Sequence
  Description of Artificial Sequence: Synthetic peptide
  XENP018520 vlCDR2
YASHRYT

SEQ ID NO: 6577 - protein, 9 aa, Artificial Sequence
  Description of Artificial Sequence: Synthetic peptide
  XENP018520 vlCDR3
QQDYSSPRT

SEQ ID NO: 6578 - protein, 249 aa, Artificial Sequence
  Description of Artificial Sequence: Synthetic polypeptide
  XENP018521 1G6_H1.25_L1_scFv(GKPGS)4
EVQLVESGGGLVKPGGSLRLSCAASGFTFSTYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6579 - protein, 122 aa, Artificial Sequence
  Description of Artificial Sequence: Synthetic polypeptide
  VH of XENP018521
EVQLVESGGGLVKPGGSLRLSCAASGFTFSTYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6580 - protein, 107 aa, Artificial Sequence; identical to SEQ ID NO: 6247
  Description of Artificial Sequence: Synthetic polypeptide
  VL of XENP018521

SEQ ID NO: 6581 - protein, 5 aa, Artificial Sequence
  Description of Artificial Sequence: Synthetic peptide
  XENP018521 vhCDR1
TYWMN

SEQ ID NO: 6582 - protein, 19 aa, Artificial Sequence
  Description of Artificial Sequence: Synthetic peptide
  XENP018521 vhCDR2
EIRLKSNNYATHYAEPVKG

SEQ ID NO: 6583 - protein, 11 aa, Artificial Sequence
  Description of Artificial Sequence: Synthetic peptide
  XENP018521 vhCDR3
YYGNYGGYFDV

SEQ ID NO: 6584 - protein, 11 aa, Artificial Sequence
  Description of Artificial Sequence: Synthetic peptide
  XENP018521 vlCDR1
RASQSVSNDVA

SEQ ID NO: 6585 - protein, 7 aa, Artificial Sequence
  Description of Artificial Sequence: Synthetic peptide
  XENP018521 vlCDR2
YASHRYT

SEQ ID NO: 6586 - protein, 9 aa, Artificial Sequence
  Description of Artificial Sequence: Synthetic peptide
  XENP018521 vlCDR3
QQDYSSPRT

SEQ ID NO: 6587 - protein, 249 aa, Artificial Sequence
  Description of Artificial Sequence: Synthetic polypeptide
  XENP018522 1G6_H1.26_L1_scFv(GKPGS)4
EVQLVESGGGLVKPGGSLRLSCAASGFTFSGYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6588 - protein, 122 aa, Artificial Sequence
  Description of Artificial Sequence: Synthetic polypeptide
  VH of XENP018522
EVQLVESGGGLVKPGGSLRLSCAASGFTFSGYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6589 - protein, 107 aa, Artificial Sequence; identical to SEQ ID NO: 6247
  Description of Artificial Sequence: Synthetic polypeptide
  VL of XENP018522

SEQ ID NO: 6590 - protein, 5 aa, Artificial Sequence
  Description of Artificial Sequence: Synthetic peptide
  XENP018522 vhCDR1
GYWMN

SEQ ID NO: 6591 - protein, 19 aa, Artificial Sequence
  Description of Artificial Sequence: Synthetic peptide
  XENP018522 vhCDR2
EIRLKSNNYATHYAEPVKG

SEQ ID NO: 6592 - protein, 11 aa, Artificial Sequence
  Description of Artificial Sequence: Synthetic peptide
  XENP018522 vhCDR3
YYGNYGGYFDV

SEQ ID NO: 6593 - protein, 11 aa, Artificial Sequence
  Description of Artificial Sequence: Synthetic peptide
  XENP018522 vlCDR1
RASQSVSNDVA

SEQ ID NO: 6594 - protein, 7 aa, Artificial Sequence
  Description of Artificial Sequence: Synthetic peptide
  XENP018522 vlCDR2
YASHRYT

SEQ ID NO: 6595 - protein, 9 aa, Artificial Sequence
  Description of Artificial Sequence: Synthetic peptide
  XENP018522 vlCDR3
QQDYSSPRT

SEQ ID NO: 6596 - protein, 249 aa, Artificial Sequence
  Description of Artificial Sequence: Synthetic polypeptide
  XENP018523 1G6_H1.27_L1_scFv(GKPGS)4
EVQLVESGGGLVKPGGSLRLSCAASGFTFSYYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6597 - protein, 122 aa, Artificial Sequence
  Description of Artificial Sequence: Synthetic polypeptide
  VH of XENP018523
EVQLVESGGGLVKPGGSLRLSCAASGFTFSYYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6598 - protein, 107 aa, Artificial Sequence; identical to SEQ ID NO: 6247
  Description of Artificial Sequence: Synthetic polypeptide
  VL of XENP018523

SEQ ID NO: 6599 - protein, 5 aa, Artificial Sequence
  Description of Artificial Sequence: Synthetic peptide
  XENP018523 vhCDR1
YYWMN

SEQ ID NO: 6600 - protein, 19 aa, Artificial Sequence
  Description of Artificial Sequence: Synthetic peptide
  XENP018523 vhCDR2
EIRLKSNNYATHYAEPVKG

SEQ ID NO: 6601 - protein, 11 aa, Artificial Sequence
  Description of Artificial Sequence: Synthetic peptide
  XENP018523 vhCDR3
YYGNYGGYFDV

SEQ ID NO: 6602 - protein, 11 aa, Artificial Sequence
  Description of Artificial Sequence: Synthetic peptide
  XENP018523 vlCDR1
RASQSVSNDVA

SEQ ID NO: 6603 - protein, 7 aa, Artificial Sequence
  Description of Artificial Sequence: Synthetic peptide
  XENP018523 vlCDR2
YASHRYT

SEQ ID NO: 6604 - protein, 9 aa, Artificial Sequence
  Description of Artificial Sequence: Synthetic peptide
  XENP018523 vlCDR3
QQDYSSPRT

SEQ ID NO: 6605 - protein, 249 aa, Artificial Sequence
  Description of Artificial Sequence: Synthetic polypeptide
  XENP018524 1G6_H1.28_L1_scFv(GKPGS)4
EVQLVESGGGLVKPGGSLRLSCAASGFTFSNFWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6606 - protein, 122 aa, Artificial Sequence
  Description of Artificial Sequence: Synthetic polypeptide
  VH of XENP018524
EVQLVESGGGLVKPGGSLRLSCAASGFTFSNFWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6607 - protein, 107 aa, Artificial Sequence; identical to SEQ ID NO: 6247
  Description of Artificial Sequence: Synthetic polypeptide
  VL of XENP018524

SEQ ID NO: 6608 - protein, 5 aa, Artificial Sequence
  Description of Artificial Sequence: Synthetic peptide
  XENP018524 vhCDR1
NFWMN

SEQ ID NO: 6609 - protein, 19 aa, Artificial Sequence
  Description of Artificial Sequence: Synthetic peptide
  XENP018524 vhCDR2
EIRLKSNNYATHYAEPVKG

SEQ ID NO: 6610 - protein, 11 aa, Artificial Sequence
  Description of Artificial Sequence: Synthetic peptide
  XENP018524 vhCDR3
YYGNYGGYFDV

SEQ ID NO: 6611 - protein, 11 aa, Artificial Sequence
  Description of Artificial Sequence: Synthetic peptide
  XENP018524 vlCDR1
RASQSVSNDVA

SEQ ID NO: 6612 - protein, 7 aa, Artificial Sequence
  Description of Artificial Sequence: Synthetic peptide
  XENP018524 vlCDR2
YASHRYT

SEQ ID NO: 6613 - protein, 9 aa, Artificial Sequence
  Description of Artificial Sequence: Synthetic peptide
  XENP018524 vlCDR3
QQDYSSPRT

SEQ ID NO: 6614 - protein, 249 aa, Artificial Sequence
  Description of Artificial Sequence: Synthetic polypeptide
  XENP018525 1G6_H1.29_L1_scFv(GKPGS)4
EVQLVESGGGLVKPGGSLRLSCAASGFTFSNHWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6615 - protein, 122 aa, Artificial Sequence
  Description of Artificial Sequence: Synthetic polypeptide
  VH of XENP018525
EVQLVESGGGLVKPGGSLRLSCAASGFTFSNHWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6616 - protein, 107 aa, Artificial Sequence; identical to SEQ ID NO: 6247
  Description of Artificial Sequence: Synthetic polypeptide
  VL of XENP018525

SEQ ID NO: 6617 - protein, 5 aa, Artificial Sequence
  Description of Artificial Sequence: Synthetic peptide
  XENP018525 vhCDR1
NHWMN

SEQ ID NO: 6618 - protein, 19 aa, Artificial Sequence
  Description of Artificial Sequence: Synthetic peptide
  XENP018525 vhCDR2
EIRLKSNNYATHYAEPVKG

SEQ ID NO: 6619 - protein, 11 aa, Artificial Sequence
  Description of Artificial Sequence: Synthetic peptide
  XENP018525 vhCDR3
YYGNYGGYFDV

SEQ ID NO: 6620 - protein, 11 aa, Artificial Sequence
  Description of Artificial Sequence: Synthetic peptide
  XENP018525 vlCDR1
RASQSVSNDVA

SEQ ID NO: 6621 - protein, 7 aa, Artificial Sequence
  Description of Artificial Sequence: Synthetic peptide
  XENP018525 vlCDR2
YASHRYT

SEQ ID NO: 6622 - protein, 9 aa, Artificial Sequence
  Description of Artificial Sequence: Synthetic peptide
  XENP018525 vlCDR3
QQDYSSPRT

SEQ ID NO: 6623 - protein, 249 aa, Artificial Sequence
  Description of Artificial Sequence: Synthetic polypeptide
  XENP018526 1G6_H1.30_L1_scFv(GKPGS)4
EVQLVESGGGLVKPGGSLRLSCAASGFTFSNLWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6624 - protein, 122 aa, Artificial Sequence
  Description of Artificial Sequence: Synthetic polypeptide
  VH of XENP018526
EVQLVESGGGLVKPGGSLRLSCAASGFTFSNLWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6625 - protein, 107 aa, Artificial Sequence; identical to SEQ ID NO: 6247
  Description of Artificial Sequence: Synthetic polypeptide
  VL of XENP018526

SEQ ID NO: 6626 - protein, 5 aa, Artificial Sequence
  Description of Artificial Sequence: Synthetic peptide
  XENP018526 vhCDR1
NLWMN

SEQ ID NO: 6627 - protein, 19 aa, Artificial Sequence
  Description of Artificial Sequence: Synthetic peptide
  XENP018526 vhCDR2
EIRLKSNNYATHYAEPVKG

SEQ ID NO: 6628 - protein, 11 aa, Artificial Sequence
  Description of Artificial Sequence: Synthetic peptide
  XENP018526 vhCDR3
YYGNYGGYFDV

SEQ ID NO: 6629 - protein, 11 aa, Artificial Sequence
  Description of Artificial Sequence: Synthetic peptide
  XENP018526 vlCDR1
RASQSVSNDVA

SEQ ID NO: 6630 - protein, 7 aa, Artificial Sequence
  Description of Artificial Sequence: Synthetic peptide
  XENP018526 vlCDR2
YASHRYT

SEQ ID NO: 6631 - protein, 9 aa, Artificial Sequence
  Description of Artificial Sequence: Synthetic peptide
  XENP018526 vlCDR3
QQDYSSPRT

SEQ ID NO: 6632 - protein, 249 aa, Artificial Sequence
  Description of Artificial Sequence: Synthetic polypeptide
  XENP018527 1G6_H1.31_L1_scFv(GKPGS)4
EVQLVESGGGLVKPGGSLRLSCAASGFTFSNWWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6633 - protein, 122 aa, Artificial Sequence
  Description of Artificial Sequence: Synthetic polypeptide
  VH of XENP018527
EVQLVESGGGLVKPGGSLRLSCAASGFTFSNWWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6634 - protein, 107 aa, Artificial Sequence; identical to SEQ ID NO: 6247
  Description of Artificial Sequence: Synthetic polypeptide
  VL of XENP018527

SEQ ID NO: 6635 - protein, 5 aa, Artificial Sequence
  Description of Artificial Sequence: Synthetic peptide
  XENP018527 vhCDR1
NWWMN

SEQ ID NO: 6636 - protein, 19 aa, Artificial Sequence
  Description of Artificial Sequence: Synthetic peptide
  XENP018527 vhCDR2
EIRLKSNNYATHYAEPVKG

SEQ ID NO: 6637 - protein, 11 aa, Artificial Sequence
  Description of Artificial Sequence: Synthetic peptide
  XENP018527 vhCDR3
YYGNYGGYFDV

SEQ ID NO: 6638 - protein, 11 aa, Artificial Sequence
  Description of Artificial Sequence: Synthetic peptide
  XENP018527 vlCDR1
RASQSVSNDVA

SEQ ID NO: 6639 - protein, 7 aa, Artificial Sequence
  Description of Artificial Sequence: Synthetic peptide
  XENP018527 vlCDR2
YASHRYT

SEQ ID NO: 6640 - protein, 9 aa, Artificial Sequence
  Description of Artificial Sequence: Synthetic peptide
  XENP018527 vlCDR3
QQDYSSPRT

SEQ ID NO: 6641 - protein, 249 aa, Artificial Sequence
  Description of Artificial Sequence: Synthetic polypeptide
  XENP018528 1G6_H1.32_L1_scFv(GKPGS)4
EVQLVESGGGLVKPGGSLRLSCAASGFTFSNVWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6642 - protein, 122 aa, Artificial Sequence
  Description of Artificial Sequence: Synthetic polypeptide
  VH of XENP018528
EVQLVESGGGLVKPGGSLRLSCAASGFTFSNVWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6643 - protein, 107 aa, Artificial Sequence; identical to SEQ ID NO: 6247
  Description of Artificial Sequence: Synthetic polypeptide
  VL of XENP018528

SEQ ID NO: 6644 - protein, 5 aa, Artificial Sequence
  Description of Artificial Sequence: Synthetic peptide
  XENP018528 vhCDR1
NVWMN

SEQ ID NO: 6645 - protein, 19 aa, Artificial Sequence
  Description of Artificial Sequence: Synthetic peptide
  XENP018528 vhCDR2
EIRLKSNNYATHYAEPVKG

SEQ ID NO: 6646 - protein, 11 aa, Artificial Sequence
  Description of Artificial Sequence: Synthetic peptide
  XENP018528 vhCDR3
YYGNYGGYFDV

SEQ ID NO: 6647 - protein, 11 aa, Artificial Sequence
  Description of Artificial Sequence: Synthetic peptide
  XENP018528 vlCDR1
RASQSVSNDVA

SEQ ID NO: 6648 - protein, 7 aa, Artificial Sequence
  Description of Artificial Sequence: Synthetic peptide
  XENP018528 vlCDR2
YASHRYT

SEQ ID NO: 6649 - protein, 9 aa, Artificial Sequence
  Description of Artificial Sequence: Synthetic peptide
  XENP018528 vlCDR3
QQDYSSPRT

SEQ ID NO: 6650 - protein, 249 aa, Artificial Sequence
  Description of Artificial Sequence: Synthetic polypeptide
  XENP018529 1G6_H1.33_L1_scFv(GKPGS)4
EVQLVESGGGLVKPGGSLRLSCAASGFTFSNAWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6651 - protein, 122 aa, Artificial Sequence
  Description of Artificial Sequence: Synthetic polypeptide
  VH of XENP018529
EVQLVESGGGLVKPGGSLRLSCAASGFTFSNAWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6652 - protein, 107 aa, Artificial Sequence; identical to SEQ ID NO: 6247
  Description of Artificial Sequence: Synthetic polypeptide
  VL of XENP018529

SEQ ID NO: 6653 - protein, 5 aa, Artificial Sequence
  Description of Artificial Sequence: Synthetic peptide
  XENP018529 vhCDR1
NAWMN

SEQ ID NO: 6654 - protein, 19 aa, Artificial Sequence
  Description of Artificial Sequence: Synthetic peptide
  XENP018529 vhCDR2
EIRLKSNNYATHYAEPVKG

SEQ ID NO: 6655 - protein, 11 aa, Artificial Sequence
  Description of Artificial Sequence: Synthetic peptide
  XENP018529 vhCDR3
YYGNYGGYFDV

SEQ ID NO: 6656 - protein, 11 aa, Artificial Sequence
  Description of Artificial Sequence: Synthetic peptide
  XENP018529 vlCDR1
RASQSVSNDVA

SEQ ID NO: 6657 - protein, 7 aa, Artificial Sequence
  Description of Artificial Sequence: Synthetic peptide
  XENP018529 vlCDR2
YASHRYT

SEQ ID NO: 6658 - protein, 9 aa, Artificial Sequence
  Description of Artificial Sequence: Synthetic peptide
  XENP018529 vlCDR3
QQDYSSPRT

SEQ ID NO: 6659 - protein, 249 aa, Artificial Sequence
  Description of Artificial Sequence: Synthetic polypeptide
  XENP018530 1G6_H1.34_L1_scFv(GKPGS)4
EVQLVESGGGLVKPGGSLRLSCAASGFTFSNQWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6660 - protein, 122 aa, Artificial Sequence
  Description of Artificial Sequence: Synthetic polypeptide
  VH of XENP018530
EVQLVESGGGLVKPGGSLRLSCAASGFTFSNQWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6661 - protein, 107 aa, Artificial Sequence; identical to SEQ ID NO: 6247
  Description of Artificial Sequence: Synthetic polypeptide
  VL of XENP018530

SEQ ID NO: 6662 - protein, 5 aa, Artificial Sequence
  Description of Artificial Sequence: Synthetic peptide
  XENP018530 vhCDR1
NQWMN

SEQ ID NO: 6663 - protein, 19 aa, Artificial Sequence
  Description of Artificial Sequence: Synthetic peptide
  XENP018530 vhCDR2
EIRLKSNNYATHYAEPVKG

SEQ ID NO: 6664 - protein, 11 aa, Artificial Sequence
  Description of Artificial Sequence: Synthetic peptide
  XENP018530 vhCDR3
YYGNYGGYFDV

SEQ ID NO: 6665 - protein, 11 aa, Artificial Sequence
  Description of Artificial Sequence: Synthetic peptide
  XENP018530 vlCDR1
RASQSVSNDVA

SEQ ID NO: 6666 - protein, 7 aa, Artificial Sequence
  Description of Artificial Sequence: Synthetic peptide
  XENP018530 vlCDR2
YASHRYT

SEQ ID NO: 6667 - protein, 9 aa, Artificial Sequence
  Description of Artificial Sequence: Synthetic peptide
  XENP018530 vlCDR3
QQDYSSPRT

SEQ ID NO: 6668 - protein, 249 aa, Artificial Sequence
  Description of Artificial Sequence: Synthetic polypeptide
  XENP018531 1G6_H1.35_L1_scFv(GKPGS)4
EVQLVESGGGLVKPGGSLRLSCAASGFTFSNDWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6669 - protein, 122 aa, Artificial Sequence
  Description of Artificial Sequence: Synthetic polypeptide
  VH of XENP018531
EVQLVESGGGLVKPGGSLRLSCAASGFTFSNDWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6670 - protein, 107 aa, Artificial Sequence; identical to SEQ ID NO: 6247
  Description of Artificial Sequence: Synthetic polypeptide
  VL of XENP018531

SEQ ID NO: 6671 - protein, 5 aa, Artificial Sequence
  Description of Artificial Sequence: Synthetic peptide
  XENP018531 vhCDR1
NDWMN

SEQ ID NO: 6672 - protein, 19 aa, Artificial Sequence
  Description of Artificial Sequence: Synthetic peptide
  XENP018531 vhCDR2
EIRLKSNNYATHYAEPVKG

SEQ ID NO: 6673 - protein, 11 aa, Artificial Sequence
  Description of Artificial Sequence: Synthetic peptide
  XENP018531 vhCDR3
YYGNYGGYFDV

SEQ ID NO: 6674 - protein, 11 aa, Artificial Sequence
  Description of Artificial Sequence: Synthetic peptide
  XENP018531 vlCDR1
RASQSVSNDVA

SEQ ID NO: 6675 - protein, 7 aa, Artificial Sequence
  Description of Artificial Sequence: Synthetic peptide
  XENP018531 vlCDR2
YASHRYT

SEQ ID NO: 6676 - protein, 9 aa, Artificial Sequence
  Description of Artificial Sequence: Synthetic peptide
  XENP018531 vlCDR3
QQDYSSPRT

SEQ ID NO: 6677 - protein, 249 aa, Artificial Sequence
  Description of Artificial Sequence: Synthetic polypeptide
  XENP018532 1G6_H1.36_L1_scFv(GKPGS)4
EVQLVESGGGLVKPGGSLRLSCAASGFTFSNKWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6678 - protein, 122 aa, Artificial Sequence
  Description of Artificial Sequence: Synthetic polypeptide
  VH of XENP018532
EVQLVESGGGLVKPGGSLRLSCAASGFTFSNKWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6679 - protein, 107 aa, Artificial Sequence; identical to SEQ ID NO: 6247
  Description of Artificial Sequence: Synthetic polypeptide
  VL of XENP018532

SEQ ID NO: 6680 - protein, 5 aa, Artificial Sequence
  Description of Artificial Sequence: Synthetic peptide
  XENP018532 vhCDR1
NKWMN

SEQ ID NO: 6681 - protein, 19 aa, Artificial Sequence
  Description of Artificial Sequence: Synthetic peptide
  XENP018532 vhCDR2
EIRLKSNNYATHYAEPVKG

SEQ ID NO: 6682 - protein, 11 aa, Artificial Sequence
  Description of Artificial Sequence: Synthetic peptide
  XENP018532 vhCDR3
YYGNYGGYFDV

SEQ ID NO: 6683 - protein, 11 aa, Artificial Sequence
  Description of Artificial Sequence: Synthetic peptide
  XENP018532 vlCDR1
RASQSVSNDVA

SEQ ID NO: 6684 - protein, 7 aa, Artificial Sequence
  Description of Artificial Sequence: Synthetic peptide
  XENP018532 vlCDR2
YASHRYT

SEQ ID NO: 6685 - protein, 9 aa, Artificial Sequence
  Description of Artificial Sequence: Synthetic peptide
  XENP018532 vlCDR3
QQDYSSPRT

SEQ ID NO: 6686 - protein, 249 aa, Artificial Sequence
  Description of Artificial Sequence: Synthetic polypeptide
  XENP018533 1G6_H1.37_L1_scFv(GKPGS)4
EVQLVESGGGLVKPGGSLRLSCAASGFTFSNYGMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6687 - protein, 122 aa, Artificial Sequence
  Description of Artificial Sequence: Synthetic polypeptide
  VH of XENP018533
EVQLVESGGGLVKPGGSLRLSCAASGFTFSNYGMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6688 - protein, 107 aa, Artificial Sequence; identical to SEQ ID NO: 6247
  Description of Artificial Sequence: Synthetic polypeptide
  VL of XENP018533

SEQ ID NO: 6689 - protein, 5 aa, Artificial Sequence
  Description of Artificial Sequence: Synthetic peptide
  XENP018533 vhCDR1
NYGMN

SEQ ID NO: 6690 - protein, 19 aa, Artificial Sequence
  Description of Artificial Sequence: Synthetic peptide
  XENP018533 vhCDR2
EIRLKSNNYATHYAEPVKG

SEQ ID NO: 6691 - protein, 11 aa, Artificial Sequence
  Description of Artificial Sequence: Synthetic peptide
  XENP018533 vhCDR3
YYGNYGGYFDV

SEQ ID NO: 6692 - protein, 11 aa, Artificial Sequence
  Description of Artificial Sequence: Synthetic peptide
  XENP018533 vlCDR1
RASQSVSNDVA

SEQ ID NO: 6693 - protein, 7 aa, Artificial Sequence
  Description of Artificial Sequence: Synthetic peptide
  XENP018533 vlCDR2
YASHRYT

SEQ ID NO: 6694 - protein, 9 aa, Artificial Sequence
  Description of Artificial Sequence: Synthetic peptide
  XENP018533 vlCDR3
QQDYSSPRT

SEQ ID NO: 6695 - protein, 249 aa, Artificial Sequence
  Description of Artificial Sequence: Synthetic polypeptide
  XENP018534 1G6_H1.38_L1_scFv(GKPGS)4
EVQLVESGGGLVKPGGSLRLSCAASGFTFSNYAMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6696 - protein, 122 aa, Artificial Sequence
  Description of Artificial Sequence: Synthetic polypeptide
  VH of XENP018534
EVQLVESGGGLVKPGGSLRLSCAASGFTFSNYAMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6697 - protein, 107 aa, Artificial Sequence; identical to SEQ ID NO: 6247
  Description of Artificial Sequence: Synthetic polypeptide
  VL of XENP018534

SEQ ID NO: 6698 - protein, 5 aa, Artificial Sequence
  Description of Artificial Sequence: Synthetic peptide
  XENP018534 vhCDR1
NYAMN

SEQ ID NO: 6699 - protein, 19 aa, Artificial Sequence
  Description of Artificial Sequence: Synthetic peptide
  XENP018534 vhCDR2
EIRLKSNNYATHYAEPVKG

SEQ ID NO: 6700 - protein, 11 aa, Artificial Sequence
  Description of Artificial Sequence: Synthetic peptide
  XENP018534 vhCDR3
YYGNYGGYFDV

SEQ ID NO: 6701 - protein, 11 aa, Artificial Sequence
  Description of Artificial Sequence: Synthetic peptide
  XENP018534 vlCDR1
RASQSVSNDVA

SEQ ID NO: 6702 - protein, 7 aa, Artificial Sequence
  Description of Artificial Sequence: Synthetic peptide
  XENP018534 vlCDR2
YASHRYT

SEQ ID NO: 6703 - protein, 9 aa, Artificial Sequence
  Description of Artificial Sequence: Synthetic peptide
  XENP018534 vlCDR3
QQDYSSPRT

SEQ ID NO: 6704 - protein, 249 aa, Artificial Sequence
  Description of Artificial Sequence: Synthetic polypeptide
  XENP018535 1G6_H1.39_L1_scFv(GKPGS)4
EVQLVESGGGLVKPGGSLRLSCAASGFTFSNYYMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6705 - protein, 122 aa, Artificial Sequence
  Description of Artificial Sequence: Synthetic polypeptide
  VH of XENP018535
EVQLVESGGGLVKPGGSLRLSCAASGFTFSNYYMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6706 - protein, 107 aa, Artificial Sequence; identical to SEQ ID NO: 6247
  Description of Artificial Sequence: Synthetic polypeptide
  VL of XENP018535

SEQ ID NO: 6707 - protein, 5 aa, Artificial Sequence
  Description of Artificial Sequence: Synthetic peptide
  XENP018535 vhCDR1
NYYMN

SEQ ID NO: 6708 - protein, 19 aa, Artificial Sequence
  Description of Artificial Sequence: Synthetic peptide
  XENP018535 vhCDR2
EIRLKSNNYATHYAEPVKG

SEQ ID NO: 6709 - protein, 11 aa, Artificial Sequence
  Description of Artificial Sequence: Synthetic peptide
  XENP018535 vhCDR3
YYGNYGGYFDV

SEQ ID NO: 6710 - protein, 11 aa, Artificial Sequence
  Description of Artificial Sequence: Synthetic peptide
  XENP018535 vlCDR1
RASQSVSNDVA

SEQ ID NO: 6711 - protein, 7 aa, Artificial Sequence
  Description of Artificial Sequence: Synthetic peptide
  XENP018535 vlCDR2
YASHRYT

SEQ ID NO: 6712 - protein, 9 aa, Artificial Sequence
  Description of Artificial Sequence: Synthetic peptide
  XENP018535 vlCDR3
QQDYSSPRT

SEQ ID NO: 6713 - protein, 249 aa, Artificial Sequence
  Description of Artificial Sequence: Synthetic polypeptide
  XENP018536 1G6_H1.40_L1_scFv(GKPGS)4
EVQLVESGGGLVKPGGSLRLSCAASGFTFSNYDMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6714 - protein, 122 aa, Artificial Sequence
  Description of Artificial Sequence: Synthetic polypeptide
  VH of XENP018536
EVQLVESGGGLVKPGGSLRLSCAASGFTFSNYDMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6715 - protein, 107 aa, Artificial Sequence; identical to SEQ ID NO: 6247
  Description of Artificial Sequence: Synthetic polypeptide
  VL of XENP018536

SEQ ID NO: 6716 - protein, 5 aa, Artificial Sequence
  Description of Artificial Sequence: Synthetic peptide
  XENP018536 vhCDR1
NYDMN

SEQ ID NO: 6717 - protein, 19 aa, Artificial Sequence
  Description of Artificial Sequence: Synthetic peptide
  XENP018536 vhCDR2
EIRLKSNNYATHYAEPVKG

SEQ ID NO: 6718 - protein, 11 aa, Artificial Sequence
  Description of Artificial Sequence: Synthetic peptide
  XENP018536 vhCDR3
YYGNYGGYFDV

SEQ ID NO: 6719 - protein, 11 aa, Artificial Sequence
  Description of Artificial Sequence: Synthetic peptide
  XENP018536 vlCDR1
RASQSVSNDVA

SEQ ID NO: 6720 - protein, 7 aa, Artificial Sequence
  Description of Artificial Sequence: Synthetic peptide
  XENP018536 vlCDR2
YASHRYT

SEQ ID NO: 6721 - protein, 9 aa, Artificial Sequence
  Description of Artificial Sequence: Synthetic peptide
  XENP018536 vlCDR3
QQDYSSPRT

SEQ ID NO: 6722 - protein, 249 aa, Artificial Sequence
  Description of Artificial Sequence: Synthetic polypeptide
  XENP018537 1G6_H1.41_L1_scFv(GKPGS)4
EVQLVESGGGLVKPGGSLRLSCAASGFTFSNYWMSWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6723 - protein, 122 aa, Artificial Sequence
  Description of Artificial Sequence: Synthetic polypeptide
  VH of XENP018537
EVQLVESGGGLVKPGGSLRLSCAASGFTFSNYWMSWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6724 - protein, 107 aa, Artificial Sequence; identical to SEQ ID NO: 6247
  Description of Artificial Sequence: Synthetic polypeptide
  VL of XENP018537

SEQ ID NO: 6725 - protein, 5 aa, Artificial Sequence
  Description of Artificial Sequence: Synthetic peptide
  XENP018537 vhCDR1
NYWMS

SEQ ID NO: 6726 - protein, 19 aa, Artificial Sequence
  Description of Artificial Sequence: Synthetic peptide
  XENP018537 vhCDR2
EIRLKSNNYATHYAEPVKG

SEQ ID NO: 6727 - protein, 11 aa, Artificial Sequence
  Description of Artificial Sequence: Synthetic peptide
  XENP018537 vhCDR3
YYGNYGGYFDV

SEQ ID NO: 6728 - protein, 11 aa, Artificial Sequence
  Description of Artificial Sequence: Synthetic peptide
  XENP018537 vlCDR1
RASQSVSNDVA

SEQ ID NO: 6729 - protein, 7 aa, Artificial Sequence
  Description of Artificial Sequence: Synthetic peptide
  XENP018537 vlCDR2
YASHRYT

SEQ ID NO: 6730 - protein, 9 aa, Artificial Sequence
  Description of Artificial Sequence: Synthetic peptide
  XENP018537 vlCDR3
QQDYSSPRT

SEQ ID NO: 6731 - protein, 249 aa, Artificial Sequence
  Description of Artificial Sequence: Synthetic polypeptide
  XENP018538 1G6_H1.42_L1_scFv(GKPGS)4
EVQLVESGGGLVKPGGSLRLSCAASGFTFSNYWMHWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6732 - protein, 122 aa, Artificial Sequence
  Description of Artificial Sequence: Synthetic polypeptide
  VH of XENP018538
EVQLVESGGGLVKPGGSLRLSCAASGFTFSNYWMHWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6733 - protein, 107 aa, Artificial Sequence; identical to SEQ ID NO: 6247
  Description of Artificial Sequence: Synthetic polypeptide
  VL of XENP018538

SEQ ID NO: 6734 - protein, 5 aa, Artificial Sequence
  Description of Artificial Sequence: Synthetic peptide
  XENP018538 vhCDR1
NYWMH

SEQ ID NO: 6735 - protein, 19 aa, Artificial Sequence
  Description of Artificial Sequence: Synthetic peptide
  XENP018538 vhCDR2
EIRLKSNNYATHYAEPVKG

SEQ ID NO: 6736 - protein, 11 aa, Artificial Sequence
  Description of Artificial Sequence: Synthetic peptide
  XENP018538 vhCDR3
YYGNYGGYFDV

SEQ ID NO: 6737 - protein, 11 aa, Artificial Sequence
  Description of Artificial Sequence: Synthetic peptide
  XENP018538 vlCDR1
RASQSVSNDVA

SEQ ID NO: 6738 - protein, 7 aa, Artificial Sequence
  Description of Artificial Sequence: Synthetic peptide
  XENP018538 vlCDR2
YASHRYT

SEQ ID NO: 6739 - protein, 9 aa, Artificial Sequence
  Description of Artificial Sequence: Synthetic peptide
  XENP018538 vlCDR3
QQDYSSPRT

SEQ ID NO: 6740 - protein, 249 aa, Artificial Sequence
  Description of Artificial Sequence: Synthetic polypeptide
  XENP018539 1G6_H1.43_L1_scFv(GKPGS)4
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6741 - protein, 122 aa, Artificial Sequence
  Description of Artificial Sequence: Synthetic polypeptide
  VH of XENP018539
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6742 - protein, 107 aa, Artificial Sequence; identical to SEQ ID NO: 6247
  Description of Artificial Sequence: Synthetic polypeptide
  VL of XENP018539

SEQ ID NO: 6743 - protein, 5 aa, Artificial Sequence
  Description of Artificial Sequence: Synthetic peptide
  XENP018539 vhCDR1
NYWMD

SEQ ID NO: 6744 - protein, 19 aa, Artificial Sequence
  Description of Artificial Sequence: Synthetic peptide
  XENP018539 vhCDR2
EIRLKSNNYATHYAEPVKG

SEQ ID NO: 6745 - protein, 11 aa, Artificial Sequence
  Description of Artificial Sequence: Synthetic peptide
  XENP018539 vhCDR3
YYGNYGGYFDV

SEQ ID NO: 6746 - protein, 11 aa, Artificial Sequence
  Description of Artificial Sequence: Synthetic peptide
  XENP018539 vlCDR1
RASQSVSNDVA

SEQ ID NO: 6747 - protein, 7 aa, Artificial Sequence
  Description of Artificial Sequence: Synthetic peptide
  XENP018539 vlCDR2
YASHRYT

SEQ ID NO: 6748 - protein, 9 aa, Artificial Sequence
  Description of Artificial Sequence: Synthetic peptide
  XENP018539 vlCDR3
QQDYSSPRT

SEQ ID NO: 6749 - protein, 249 aa, Artificial Sequence
  Description of Artificial Sequence: Synthetic polypeptide
  XENP018540 1G6_H1.44_L1_scFv(GKPGS)4
EVQLVESGGGLVKPGGSLRLSCAASGFTFSNYWMGWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6750 - protein, 122 aa, Artificial Sequence
  Description of Artificial Sequence: Synthetic polypeptide
  VH of XENP018540
EVQLVESGGGLVKPGGSLRLSCAASGFTFSNYWMGWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6751 - protein, 107 aa, Artificial Sequence; identical to SEQ ID NO: 6247
  Description of Artificial Sequence: Synthetic polypeptide
  VL of XENP018540

SEQ ID NO: 6752 - protein, 5 aa, Artificial Sequence
  Description of Artificial Sequence: Synthetic peptide
  XENP018540 vhCDR1
NYWMG

SEQ ID NO: 6753 - protein, 19 aa, Artificial Sequence
  Description of Artificial Sequence: Synthetic peptide
  XENP018540 vhCDR2
EIRLKSNNYATHYAEPVKG

SEQ ID NO: 6754 - protein, 11 aa, Artificial Sequence
  Description of Artificial Sequence: Synthetic peptide
  XENP018540 vhCDR3
YYGNYGGYFDV

SEQ ID NO: 6755 - protein, 11 aa, Artificial Sequence
  Description of Artificial Sequence: Synthetic peptide
  XENP018540 vlCDR1
RASQSVSNDVA

SEQ ID NO: 6756 - protein, 7 aa, Artificial Sequence
  Description of Artificial Sequence: Synthetic peptide
  XENP018540 vlCDR2
YASHRYT

SEQ ID NO: 6757 - protein, 9 aa, Artificial Sequence
  Description of Artificial Sequence: Synthetic peptide
  XENP018540 vlCDR3
QQDYSSPRT

SEQ ID NO: 6758 - protein, 249 aa, Artificial Sequence
  Description of Artificial Sequence: Synthetic polypeptide
  XENP018541 1G6_H1.45_L1_scFv(GKPGS)4
EVQLVESGGGLVKPGGSLRLSCAASGFTFSNYWMNWARQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6759 - protein, 122 aa, Artificial Sequence
  Description of Artificial Sequence: Synthetic polypeptide
  VH of XENP018541
EVQLVESGGGLVKPGGSLRLSCAASGFTFSNYWMNWARQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6760 - protein, 107 aa, Artificial Sequence; identical to SEQ ID NO: 6247
  Description of Artificial Sequence: Synthetic polypeptide
  VL of XENP018541

SEQ ID NO: 6761 - protein, 5 aa, Artificial Sequence
  Description of Artificial Sequence: Synthetic peptide
  XENP018541 vhCDR1
NYWMN

SEQ ID NO: 6762 - protein, 19 aa, Artificial Sequence
  Description of Artificial Sequence: Synthetic peptide
  XENP018541 vhCDR2
EIRLKSNNYATHYAEPVKG

SEQ ID NO: 6763 - protein, 11 aa, Artificial Sequence
  Description of Artificial Sequence: Synthetic peptide
  XENP018541 vhCDR3
YYGNYGGYFDV

SEQ ID NO: 6764 - protein, 11 aa, Artificial Sequence
  Description of Artificial Sequence: Synthetic peptide
  XENP018541 vlCDR1
RASQSVSNDVA

SEQ ID NO: 6765 - protein, 7 aa, Artificial Sequence
  Description of Artificial Sequence: Synthetic peptide
  XENP018541 vlCDR2
YASHRYT

SEQ ID NO: 6766 - protein, 9 aa, Artificial Sequence
  Description of Artificial Sequence: Synthetic peptide
  XENP018541 vlCDR3
QQDYSSPRT

SEQ ID NO: 6767 - protein, 249 aa, Artificial Sequence
  Description of Artificial Sequence: Synthetic polypeptide
  XENP018542 1G6_H1.46_L1_scFv(GKPGS)4
EVQLVESGGGLVKPGGSLRLSCAASGFTFSNYWMNWIRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6768 - protein, 122 aa, Artificial Sequence
  Description of Artificial Sequence: Synthetic polypeptide
  VH of XENP018542
EVQLVESGGGLVKPGGSLRLSCAASGFTFSNYWMNWIRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6769 - protein, 107 aa, Artificial Sequence; identical to SEQ ID NO: 6247
  Description of Artificial Sequence: Synthetic polypeptide
  VL of XENP018542

SEQ ID NO: 6770 - protein, 5 aa, Artificial Sequence
  Description of Artificial Sequence: Synthetic peptide
  XENP018542 vhCDR1
NYWMN

SEQ ID NO: 6771 - protein, 19 aa, Artificial Sequence
  Description of Artificial Sequence: Synthetic peptide
  XENP018542 vhCDR2
EIRLKSNNYATHYAEPVKG

SEQ ID NO: 6772 - protein, 11 aa, Artificial Sequence
  Description of Artificial Sequence: Synthetic peptide
  XENP018542 vhCDR3
YYGNYGGYFDV

SEQ ID NO: 6773 - protein, 11 aa, Artificial Sequence
  Description of Artificial Sequence: Synthetic peptide
  XENP018542 vlCDR1
RASQSVSNDVA

SEQ ID NO: 6774 - protein, 7 aa, Artificial Sequence
  Description of Artificial Sequence: Synthetic peptide
  XENP018542 vlCDR2
YASHRYT

SEQ ID NO: 6775 - protein, 9 aa, Artificial Sequence
  Description of Artificial Sequence: Synthetic peptide
  XENP018542 vlCDR3
QQDYSSPRT

SEQ ID NO: 6776 - protein, 249 aa, Artificial Sequence
  Description of Artificial Sequence: Synthetic polypeptide
  XENP018543 1G6_H1.47_L1_scFv(GKPGS)4
EVQLVESGGGLVKPGGSLRLSCAASGFTFSNYWMNWFRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6777 - protein, 122 aa, Artificial Sequence
  Description of Artificial Sequence: Synthetic polypeptide
  VH of XENP018543
EVQLVESGGGLVKPGGSLRLSCAASGFTFSNYWMNWFRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6778 - protein, 107 aa, Artificial Sequence; identical to SEQ ID NO: 6247
  Description of Artificial Sequence: Synthetic polypeptide
  VL of XENP018543

SEQ ID NO: 6779 - protein, 5 aa, Artificial Sequence
  Description of Artificial Sequence: Synthetic peptide
  XENP018543 vhCDR1
NYWMN

SEQ ID NO: 6780 - protein, 19 aa, Artificial Sequence
  Description of Artificial Sequence: Synthetic peptide
  XENP018543 vhCDR2
EIRLKSNNYATHYAEPVKG

SEQ ID NO: 6781 - protein, 11 aa, Artificial Sequence
  Description of Artificial Sequence: Synthetic peptide
  XENP018543 vhCDR3
YYGNYGGYFDV

SEQ ID NO: 6782 - protein, 11 aa, Artificial Sequence
  Description of Artificial Sequence: Synthetic peptide
  XENP018543 vlCDR1
RASQSVSNDVA

SEQ ID NO: 6783 - protein, 7 aa, Artificial Sequence
  Description of Artificial Sequence: Synthetic peptide
  XENP018543 vlCDR2
YASHRYT

SEQ ID NO: 6784 - protein, 9 aa, Artificial Sequence
  Description of Artificial Sequence: Synthetic peptide
  XENP018543 vlCDR3
QQDYSSPRT

SEQ ID NO: 6785 - protein, 249 aa, Artificial Sequence
  Description of Artificial Sequence: Synthetic polypeptide
  XENP018544 1G6_H1.48_L1_scFv(GKPGS)4
EVQLVESGGGLVKPGGSLRLSCAASGFTFSNYWMNWVRKAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6786 - protein, 122 aa, Artificial Sequence
  Description of Artificial Sequence: Synthetic polypeptide
  VH of XENP018544
EVQLVESGGGLVKPGGSLRLSCAASGFTFSNYWMNWVRKAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6787 - protein, 107 aa, Artificial Sequence; identical to SEQ ID NO: 6247
  Description of Artificial Sequence: Synthetic polypeptide
  VL of XENP018544

SEQ ID NO: 6788 - protein, 11 aa, Artificial Sequence
  Description of Artificial Sequence: Synthetic peptide
  XENP018544 vlCDR1
RASQSVSNDVA

SEQ ID NO: 6789 - protein, 7 aa, Artificial Sequence
  Description of Artificial Sequence: Synthetic peptide
  XENP018544 vlCDR2
YASHRYT

SEQ ID NO: 6790 - protein, 9 aa, Artificial Sequence
  Description of Artificial Sequence: Synthetic peptide
  XENP018544 vlCDR3
QQDYSSPRT

SEQ ID NO: 6791 - protein, 249 aa, Artificial Sequence
  Description of Artificial Sequence: Synthetic polypeptide
  XENP018545 1G6_H1.49_L1_scFv(GKPGS)4
EVQLVESGGGLVKPGGSLRLSCAASGFTFSNYWMNWVRQSPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6792 - protein, 122 aa, Artificial Sequence
  Description of Artificial Sequence: Synthetic polypeptide
  VH of XENP018545
EVQLVESGGGLVKPGGSLRLSCAASGFTFSNYWMNWVRQSPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6793 - protein, 107 aa, Artificial Sequence; identical to SEQ ID NO: 6247
  Description of Artificial Sequence: Synthetic polypeptide
  VL of XENP018545

SEQ ID NO: 6794 - protein, 5 aa, Artificial Sequence
  Description of Artificial Sequence: Synthetic peptide
  XENP018545 vhCDR1
NYWMN

SEQ ID NO: 6795 - protein, 19 aa, Artificial Sequence
  Description of Artificial Sequence: Synthetic peptide
  XENP018545 vhCDR2
EIRLKSNNYATHYAEPVKG

SEQ ID NO: 6796 - protein, 11 aa, Artificial Sequence
  Description of Artificial Sequence: Synthetic peptide
  XENP018545 vhCDR3
YYGNYGGYFDV

SEQ ID NO: 6797 - protein, 11 aa, Artificial Sequence
  Description of Artificial Sequence: Synthetic peptide
  XENP018545 vlCDR1
RASQSVSNDVA

SEQ ID NO: 6798 - protein, 7 aa, Artificial Sequence
  Description of Artificial Sequence: Synthetic peptide
  XENP018545 vlCDR2
YASHRYT

SEQ ID NO: 6799 - protein, 9 aa, Artificial Sequence
  Description of Artificial Sequence: Synthetic peptide
  XENP018545 vlCDR3
QQDYSSPRT

SEQ ID NO: 6800 - protein, 249 aa, Artificial Sequence
  Description of Artificial Sequence: Synthetic polypeptide
  XENP018546 1G6_H1.50_L1_scFv(GKPGS)4
EVQLVESGGGLVKPGGSLRLSCAASGFTFSNYWMNWVRQAPEKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6801 - protein, 122 aa, Artificial Sequence
  Description of Artificial Sequence: Synthetic polypeptide
  VH of XENP018546
EVQLVESGGGLVKPGGSLRLSCAASGFTFSNYWMNWVRQAPEKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6802 - protein, 107 aa, Artificial Sequence; identical to SEQ ID NO: 6247
  Description of Artificial Sequence: Synthetic polypeptide
  VL of XENP018546

SEQ ID NO: 6803 - protein, 5 aa, Artificial Sequence
  Description of Artificial Sequence: Synthetic peptide
  XENP018546 vhCDR1
NYWMN

SEQ ID NO: 6804 - protein, 19 aa, Artificial Sequence
  Description of Artificial Sequence: Synthetic peptide
  XENP018546 vhCDR2
EIRLKSNNYATHYAEPVKG

SEQ ID NO: 6805 - protein, 11 aa, Artificial Sequence
  Description of Artificial Sequence: Synthetic peptide
  XENP018546 vhCDR3
YYGNYGGYFDV

SEQ ID NO: 6806 - protein, 11 aa, Artificial Sequence
  Description of Artificial Sequence: Synthetic peptide
  XENP018546 vlCDR1
RASQSVSNDVA

SEQ ID NO: 6807 - protein, 7 aa, Artificial Sequence
  Description of Artificial Sequence: Synthetic peptide
  XENP018546 vlCDR2
YASHRYT

SEQ ID NO: 6808 - protein, 9 aa, Artificial Sequence
  Description of Artificial Sequence: Synthetic peptide
  XENP018546 vlCDR3
QQDYSSPRT

SEQ ID NO: 6809 - protein, 249 aa, Artificial Sequence
  Description of Artificial Sequence: Synthetic polypeptide
  XENP018547 1G6_H1.51_L1_scFv(GKPGS)4
EVQLVESGGGLVKPGGSLRLSCAASGFTFSNYWMNWVRQAPGKGLEYVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6810 - protein, 122 aa, Artificial Sequence
  Description of Artificial Sequence: Synthetic polypeptide
  VH of XENP018547
EVQLVESGGGLVKPGGSLRLSCAASGFTFSNYWMNWVRQAPGKGLEYVGEIRLKSNNYATHYAEPVKGRFTISRDDSKSTVYLQMNSLKTEDTAVYYCTRYYGNYGGYFDVWGAGTLVTVSS

SEQ ID NO: 6811 - protein, 107 aa, Artificial Sequence; identical to SEQ ID NO: 6247
  Description of Artificial Sequence: Synthetic polypeptide
  VL of XENP018547

SEQ ID NO: 6812 - protein, 5 aa, Artificial Sequence
  Description of Artificial Sequence: Synthetic peptide
  XENP018547 vhCDR1
NYWMN

SEQ ID NO: 6813 - protein, 19 aa, Artificial Sequence
  Description of Artificial Sequence: Synthetic peptide
  XENP018547 vhCDR2
EIRLKSNNYATHYAEPVKG

SEQ ID NO: 6814 - protein, 11 aa, Artificial Sequence
  Description of Artificial Sequence: Synthetic peptide
  XENP018547 vhCDR3
YYGNYGGYFDV

SEQ ID NO: 6815 - protein, 11 aa, Artificial Sequence
  Description of Artificial Sequence: Synthetic peptide
  XENP018547 vlCDR1
RASQSVSNDVA

SEQ ID NO: 6816 - protein, 7 aa, Artificial Sequence
  Description of Artificial Sequence: Synthetic peptide
  XENP018547 vlCDR2
YASHRYT

SEQ ID NO: 6817 - protein, 9 aa, Artificial Sequence
  Description of Artificial Sequence: Synthetic peptide
  XENP018547 vlCDR3
QQDYSSPRT

SEQ ID NO: 6818 - protein, 249 aa, Artificial Sequence
  Description of Artificial Sequence: Synthetic polypeptide
  XENP018548 1G6_H1.52_L1_scFv(GKPGS)4
EVQLVESGGGLVKPGGSLRLSCAASGFTFSNYWMNWVRQAPGKGLEWVAEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6819 - protein, 122 aa, Artificial Sequence
  Description of Artificial Sequence: Synthetic polypeptide
  VH of XENP018548
EVQLVESGGGLVKPGGSLRLSCAASGFTFSNYWMNWVRQAPGKGLEWVAEIRLKSNNYATHYAEPVKGRFTISRDDSKSTVYLQMNSLKTEDTAVYYCTRYYGNYGGYFDVWGAGTLVTVSS

SEQ ID NO: 6820 - protein, 107 aa, Artificial Sequence; identical to SEQ ID NO: 6247
  Description of Artificial Sequence: Synthetic polypeptide
  VL of XENP018548

SEQ ID NO: 6821 - protein, 5 aa, Artificial Sequence
  Description of Artificial Sequence: Synthetic peptide
  XENP018548 vhCDR1
NYWMN

SEQ ID NO: 6822 - protein, 19 aa, Artificial Sequence
  Description of Artificial Sequence: Synthetic peptide
  XENP018548 vhCDR2
EIRLKSNNYATHYAEPVKG

SEQ ID NO: 6823 - protein, 11 aa, Artificial Sequence
  Description of Artificial Sequence: Synthetic peptide
  XENP018548 vhCDR3
YYGNYGGYFDV

SEQ ID NO: 6824 - protein, 11 aa, Artificial Sequence
  Description of Artificial Sequence: Synthetic peptide
  XENP018548 vlCDR1
RASQSVSNDVA

SEQ ID NO: 6825 - protein, 7 aa, Artificial Sequence
  Description of Artificial Sequence: Synthetic peptide
  XENP018548 vlCDR2
YASHRYT

SEQ ID NO: 6826 - protein, 9 aa, Artificial Sequence
  Description of Artificial Sequence: Synthetic peptide
  XENP018548 vlCDR3
QQDYSSPRT

SEQ ID NO: 6827 - protein, 249 aa, Artificial Sequence
  Description of Artificial Sequence: Synthetic polypeptide
  XENP018549 1G6_H1.53_L1_scFv(GKPGS)4
EVQLVESGGGLVKPGGSLRLSCAASGFTFSNYWMNWVRQAPGKGLEWVSEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6828 - protein, 122 aa, Artificial Sequence
  Description of Artificial Sequence: Synthetic polypeptide
  VH of XENP018549
EVQLVESGGGLVKPGGSLRLSCAASGFTFSNYWMNWVRQAPGKGLEWVSEIRLKSNNYATHYAEPVKGRFTISRDDSKSTVYLQMNSLKTEDTAVYYCTRYYGNYGGYFDVWGAGTLVTVSS

SEQ ID NO: 6829 - protein, 107 aa, Artificial Sequence; identical to SEQ ID NO: 6247
  Description of Artificial Sequence: Synthetic polypeptide
  VL of XENP018549

SEQ ID NO: 6830 - protein, 5 aa, Artificial Sequence
  Description of Artificial Sequence: Synthetic peptide
  XENP018549 vhCDR1
NYWMN

SEQ ID NO: 6831 - protein, 19 aa, Artificial Sequence
  Description of Artificial Sequence: Synthetic peptide
  XENP018549 vhCDR2
EIRLKSNNYATHYAEPVKG

SEQ ID NO: 6832 - protein, 11 aa, Artificial Sequence
  Description of Artificial Sequence: Synthetic peptide
  XENP018549 vhCDR3
YYGNYGGYFDV

SEQ ID NO: 6833 - protein, 11 aa, Artificial Sequence
  Description of Artificial Sequence: Synthetic peptide
  XENP018549 vlCDR1
RASQSVSNDVA

SEQ ID NO: 6834 - protein, 7 aa, Artificial Sequence
  Description of Artificial Sequence: Synthetic peptide
  XENP018549 vlCDR2
YASHRYT

SEQ ID NO: 6835 - protein, 9 aa, Artificial Sequence
  Description of Artificial Sequence: Synthetic peptide
  XENP018549 vlCDR3
QQDYSSPRT

SEQ ID NO: 6836 - protein, 249 aa, Artificial Sequence
  Description of Artificial Sequence: Synthetic polypeptide
  XENP018550 1G6_H1.54_L1_scFv(GKPGS)4
EVQLVESGGGLVKPGGSLRLSCAASGFTFSNYWMNWVRQAPGKGLEWVGQIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6837 - protein, 122 aa, Artificial Sequence
  Description of Artificial Sequence: Synthetic polypeptide
  VH of XENP018550
EVQLVESGGGLVKPGGSLRLSCAASGFTFSNYWMNWVRQAPGKGLEWVGQIRLKSNNYATHYAEPVKGRFTISRDDSKSTVYLQMNSLKTEDTAVYYCTRYYGNYGGYFDVWGAGTLVTVSS

SEQ ID NO: 6838 - protein, 107 aa, Artificial Sequence; identical to SEQ ID NO: 6247
  Description of Artificial Sequence: Synthetic polypeptide
  VL of XENP018550

SEQ ID NO: 6839 - protein, 5 aa, Artificial Sequence
  Description of Artificial Sequence: Synthetic peptide
  XENP018550 vhCDR1
NYWMN

SEQ ID NO: 6840 - protein, 19 aa, Artificial Sequence
  Description of Artificial Sequence: Synthetic peptide
  XENP018550 vhCDR2
QIRLKSNNYATHYAEPVKG

SEQ ID NO: 6841 - protein, 11 aa, Artificial Sequence
  Description of Artificial Sequence: Synthetic peptide
  XENP018550 vhCDR3
YYGNYGGYFDV

SEQ ID NO: 6842 - protein, 11 aa, Artificial Sequence
  Description of Artificial Sequence: Synthetic peptide
  XENP018550 vlCDR1
RASQSVSNDVA

SEQ ID NO: 6843 - protein, 7 aa, Artificial Sequence
  Description of Artificial Sequence: Synthetic peptide
  XENP018550 vlCDR2
YASHRYT

SEQ ID NO: 6844 - protein, 9 aa, Artificial Sequence
  Description of Artificial Sequence: Synthetic peptide
  XENP018550 vlCDR3
QQDYSSPRT

SEQ ID NO: 6845 - protein, 249 aa, Artificial Sequence
  Description of Artificial Sequence: Synthetic polypeptide
  XENP018551 1G6_H1.55_L1_scFv(GKPGS)4
EVQLVESGGGLVKPGGSLRLSCAASGFTFSNYWMNWVRQAPGKGLEWVGDIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6846 - protein, 122 aa, Artificial Sequence
  Description of Artificial Sequence: Synthetic polypeptide
  VH of XENP018551
EVQLVESGGGLVKPGGSLRLSCAASGFTFSNYWMNWVRQAPGKGLEWVGDIRLKSNNYATHYAEPVKGRFTISRDDSKSTVYLQMNSLKTEDTAVYYCTRYYGNYGGYFDVWGAGTLVTVSS

SEQ ID NO: 6847 - protein, 107 aa, Artificial Sequence; identical to SEQ ID NO: 6247
  Description of Artificial Sequence: Synthetic polypeptide
  VL of XENP018551

SEQ ID NO: 6848 - protein, 5 aa, Artificial Sequence
  Description of Artificial Sequence: Synthetic peptide
  XENP018551 vhCDR1
NYWMN

SEQ ID NO: 6849 - protein, 19 aa, Artificial Sequence
  Description of Artificial Sequence: Synthetic peptide
  XENP018551 vhCDR2
DIRLKSNNYATHYAEPVKG

SEQ ID NO: 6850 - protein, 11 aa, Artificial Sequence
  Description of Artificial Sequence: Synthetic peptide
  XENP018551 vhCDR3
YYGNYGGYFDV

SEQ ID NO: 6851 - protein, 11 aa, Artificial Sequence
  Description of Artificial Sequence: Synthetic peptide
  XENP018551 vlCDR1
RASQSVSNDVA

SEQ ID NO: 6852 - protein, 7 aa, Artificial Sequence
  Description of Artificial Sequence: Synthetic peptide
  XENP018551 vlCDR2
YASHRYT

SEQ ID NO: 6853 - protein, 9 aa, Artificial Sequence
  Description of Artificial Sequence: Synthetic peptide
  XENP018551 vlCDR3
QQDYSSPRT

SEQ ID NO: 6854 - protein, 249 aa, Artificial Sequence
  Description of Artificial Sequence: Synthetic polypeptide
  XENP018552 1G6_H1.56_L1_scFv(GKPGS)4
EVQLVESGGGLVKPGGSLRLSCAASGFTFSNYWMNWVRQAPGKGLEWVGKIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6855 - protein, 122 aa, Artificial Sequence
  Description of Artificial Sequence: Synthetic polypeptide
  VH of XENP018552
EVQLVESGGGLVKPGGSLRLSCAASGFTFSNYWMNWVRQAPGKGLEWVGKIRLKSNNYATHYAEPVKGRFTISRDDSKSTVYLQMNSLKTEDTAVYYCTRYYGNYGGYFDVWGAGTLVTVSS

SEQ ID NO: 6856 - protein, 107 aa, Artificial Sequence; identical to SEQ ID NO: 6247
  Description of Artificial Sequence: Synthetic polypeptide
  VL of XENP018552

SEQ ID NO: 6857 - protein, 5 aa, Artificial Sequence
  Description of Artificial Sequence: Synthetic peptide
  XENP018552 vhCDR1
NYWMN

SEQ ID NO: 6858 - protein, 19 aa, Artificial Sequence
  Description of Artificial Sequence: Synthetic peptide
  XENP018552 vhCDR2
KIRLKSNNYATHYAEPVKG

SEQ ID NO: 6859 - protein, 11 aa, Artificial Sequence
  Description of Artificial Sequence: Synthetic peptide
  XENP018552 vhCDR3
YYGNYGGYFDV

SEQ ID NO: 6860 - protein, 11 aa, Artificial Sequence
  Description of Artificial Sequence: Synthetic peptide
  XENP018552 vlCDR1
RASQSVSNDVA

SEQ ID NO: 6861 - protein, 7 aa, Artificial Sequence
  Description of Artificial Sequence: Synthetic peptide
  XENP018552 vlCDR2
YASHRYT

SEQ ID NO: 6862 - protein, 9 aa, Artificial Sequence
  Description of Artificial Sequence: Synthetic peptide
  XENP018552 vlCDR3
QQDYSSPRT

SEQ ID NO: 6863 - protein, 249 aa, Artificial Sequence
  Description of Artificial Sequence: Synthetic polypeptide
  XENP018553 1G6_H1.57_L1_scFv(GKPGS)4
EVQLVESGGGLVKPGGSLRLSCAASGFTFSNYWMNWVRQAPGKGLEWVGSIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6864 - protein, 122 aa, Artificial Sequence
  Description of Artificial Sequence: Synthetic polypeptide
  VH of XENP018553
EVQLVESGGGLVKPGGSLRLSCAASGFTFSNYWMNWVRQAPGKGLEWVGSIRLKSNNYATHYAEPVKGRFTISRDDSKSTVYLQMNSLKTEDTAVYYCTRYYGNYGGYFDVWGAGTLVTVSS

SEQ ID NO: 6865 - protein, 107 aa, Artificial Sequence; identical to SEQ ID NO: 6247
  Description of Artificial Sequence: Synthetic polypeptide
  VL of XENP018553

SEQ ID NO: 6866 - protein, 5 aa, Artificial Sequence
  Description of Artificial Sequence: Synthetic peptide
  XENP018553 vhCDR1
NYWMN

SEQ ID NO: 6867 - protein, 19 aa, Artificial Sequence
  Description of Artificial Sequence: Synthetic peptide
  XENP018553 vhCDR2
SIRLKSNNYATHYAEPVKG

SEQ ID NO: 6868 - protein, 11 aa, Artificial Sequence
  Description of Artificial Sequence: Synthetic peptide
  XENP018553 vhCDR3
YYGNYGGYFDV

SEQ ID NO: 6869 - protein, 11 aa, Artificial Sequence
  Description of Artificial Sequence: Synthetic peptide
  XENP018553 vlCDR1
RASQSVSNDVA

SEQ ID NO: 6870 - protein, 7 aa, Artificial Sequence
  Description of Artificial Sequence: Synthetic peptide
  XENP018553 vlCDR2
YASHRYT

SEQ ID NO: 6871 - protein, 9 aa, Artificial Sequence
  Description of Artificial Sequence: Synthetic peptide
  XENP018553 vlCDR3
QQDYSSPRT

SEQ ID NO: 6872 - protein, 249 aa, Artificial Sequence
  Description of Artificial Sequence: Synthetic polypeptide
  XENP018554 1G6_H1.58_L1_scFv(GKPGS)4
EVQLVESGGGLVKPGGSLRLSCAASGFTFSNYWMNWVRQAPGKGLEWVGHIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6873 - protein, 122 aa, Artificial Sequence
  Description of Artificial Sequence: Synthetic polypeptide
  VH of XENP018554
EVQLVESGGGLVKPGGSLRLSCAASGFTFSNYWMNWVRQAPGKGLEWVGHIRLKSNNYATHYAEPVKGRFTISRDDSKSTVYLQMNSLKTEDTAVYYCTRYYGNYGGYFDVWGAGTLVTVSS

SEQ ID NO: 6874 - protein, 107 aa, Artificial Sequence; identical to SEQ ID NO: 6247
  Description of Artificial Sequence: Synthetic polypeptide
  VL of XENP018554

SEQ ID NO: 6875 - protein, 5 aa, Artificial Sequence
  Description of Artificial Sequence: Synthetic peptide
  XENP018554 vhCDR1
NYWMN

SEQ ID NO: 6876 - protein, 19 aa, Artificial Sequence
  Description of Artificial Sequence: Synthetic peptide
  XENP018554 vhCDR2
HIRLKSNNYATHYAEPVKG

SEQ ID NO: 6877 - protein, 11 aa, Artificial Sequence
  Description of Artificial Sequence: Synthetic peptide
  XENP018554 vhCDR3
YYGNYGGYFDV

SEQ ID NO: 6878 - protein, 11 aa, Artificial Sequence
  Description of Artificial Sequence: Synthetic peptide
  XENP018554 vlCDR1
RASQSVSNDVA

SEQ ID NO: 6879 - protein, 7 aa, Artificial Sequence
  Description of Artificial Sequence: Synthetic peptide
  XENP018554 vlCDR2
YASHRYT

SEQ ID NO: 6880 - protein, 9 aa, Artificial Sequence
  Description of Artificial Sequence: Synthetic peptide
  XENP018554 vlCDR3
QQDYSSPRT

SEQ ID NO: 6881 - protein, 249 aa, Artificial Sequence
  Description of Artificial Sequence: Synthetic polypeptide
  XENP018555 1G6_H1.59_L1_scFv(GKPGS)4
EVQLVESGGGLVKPGGSLRLSCAASGFTFSNYWMNWVRQAPGKGLEWVGAIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6882 - protein, 122 aa, Artificial Sequence
  Description of Artificial Sequence: Synthetic polypeptide
  VH of XENP018555
EVQLVESGGGLVKPGGSLRLSCAASGFTFSNYWMNWVRQAPGKGLEWVGAIRLKSNNYATHYAEPVKGRFTISRDDSKSTVYLQMNSLKTEDTAVYYCTRYYGNYGGYFDVWGAGTLVTVSS

SEQ ID NO: 6883 - protein, 107 aa, Artificial Sequence; identical to SEQ ID NO: 6247
  Description of Artificial Sequence: Synthetic polypeptide
  VL of XENP018555

SEQ ID NO: 6884 - protein, 5 aa, Artificial Sequence
  Description of Artificial Sequence: Synthetic peptide
  XENP018555 vhCDR1
NYWMN

SEQ ID NO: 6885 - protein, 19 aa, Artificial Sequence
  Description of Artificial Sequence: Synthetic peptide
  XENP018555 vhCDR2
AIRLKSNNYATHYAEPVKG

SEQ ID NO: 6886 - protein, 11 aa, Artificial Sequence
  Description of Artificial Sequence: Synthetic peptide
  XENP018555 vhCDR3
YYGNYGGYFDV

SEQ ID NO: 6887 - protein, 11 aa, Artificial Sequence
  Description of Artificial Sequence: Synthetic peptide
  XENP018555 vlCDR1
RASQSVSNDVA

SEQ ID NO: 6888 - protein, 7 aa, Artificial Sequence
  Description of Artificial Sequence: Synthetic peptide
  XENP018555 vlCDR2
YASHRYT

SEQ ID NO: 6889 - protein, 9 aa, Artificial Sequence
  Description of Artificial Sequence: Synthetic peptide
  XENP018555 vlCDR3
QQDYSSPRT

SEQ ID NO: 6890 - protein, 249 aa, Artificial Sequence
  Description of Artificial Sequence: Synthetic polypeptide
  XENP018556 1G6_H1.60_L1_scFv(GKPGS)4
EVQLVESGGGLVKPGGSLRLSCAASGFTFSNYWMNWVRQAPGKGLEWVGGIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6891 - protein, 122 aa, Artificial Sequence
  Description of Artificial Sequence: Synthetic polypeptide
  VH of XENP018556
EVQLVESGGGLVKPGGSLRLSCAASGFTFSNYWMNWVRQAPGKGLEWVGGIRLKSNNYATHYAEPVKGRFTISRDDSKSTVYLQMNSLKTEDTAVYYCTRYYGNYGGYFDVWGAGTLVTVSS

SEQ ID NO: 6892 - protein, 107 aa, Artificial Sequence; identical to SEQ ID NO: 6247
  Description of Artificial Sequence: Synthetic polypeptide
  VL of XENP018556

SEQ ID NO: 6893 - protein, 5 aa, Artificial Sequence
  Description of Artificial Sequence: Synthetic peptide
  XENP018556 vhCDR1
NYWMN

SEQ ID NO: 6894 - protein, 19 aa, Artificial Sequence
  Description of Artificial Sequence: Synthetic peptide
  XENP018556 vhCDR2
GIRLKSNNYATHYAEPVKG

SEQ ID NO: 6895 - protein, 11 aa, Artificial Sequence
  Description of Artificial Sequence: Synthetic peptide
  XENP018556 vhCDR3
YYGNYGGYFDV

SEQ ID NO: 6896 - protein, 11 aa, Artificial Sequence
  Description of Artificial Sequence: Synthetic peptide
  XENP018556 vlCDR1
RASQSVSNDVA

SEQ ID NO: 6897 - protein, 7 aa, Artificial Sequence
  Description of Artificial Sequence: Synthetic peptide
  XENP018556 vlCDR2
YASHRYT

SEQ ID NO: 6898 - protein, 9 aa, Artificial Sequence
  Description of Artificial Sequence: Synthetic peptide
  XENP018556 vlCDR3
QQDYSSPRT

SEQ ID NO: 6899 - protein, 249 aa, Artificial Sequence
  Description of Artificial Sequence: Synthetic polypeptide
  XENP018557 1G6_H1.61_L1_scFv(GKPGS)4
EVQLVESGGGLVKPGGSLRLSCAASGFTFSNYWMNWVRQAPGKGLEWVGYIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6900 - protein, 122 aa, Artificial Sequence
  Description of Artificial Sequence: Synthetic polypeptide
  VH of XENP018557
EVQLVESGGGLVKPGGSLRLSCAASGFTFSNYWMNWVRQAPGKGLEWVGYIRLKSNNYATHYAEPVKGRFTISRDDSKSTVYLQMNSLKTEDTAVYYCTRYYGNYGGYFDVWGAGTLVTVSS

SEQ ID NO: 6901 - protein, 107 aa, Artificial Sequence; identical to SEQ ID NO: 6247
  Description of Artificial Sequence: Synthetic polypeptide
  VL of XENP018557

SEQ ID NO: 6902 - protein, 5 aa, Artificial Sequence
  Description of Artificial Sequence: Synthetic peptide
  XENP018557 vhCDR1
NYWMN

SEQ ID NO: 6903 - protein, 19 aa, Artificial Sequence
  Description of Artificial Sequence: Synthetic peptide
  XENP018557 vhCDR2
YIRLKSNNYATHYAEPVKG

SEQ ID NO: 6904 - protein, 11 aa, Artificial Sequence
  Description of Artificial Sequence: Synthetic peptide
  XENP018557 vhCDR3
YYGNYGGYFDV

SEQ ID NO: 6905 - protein, 11 aa, Artificial Sequence
  Description of Artificial Sequence: Synthetic peptide
  XENP018557 vlCDR1
RASQSVSNDVA

SEQ ID NO: 6906 - protein, 7 aa, Artificial Sequence
  Description of Artificial Sequence: Synthetic peptide
  XENP018557 vlCDR2
YASHRYT

SEQ ID NO: 6907 - protein, 9 aa, Artificial Sequence
  Description of Artificial Sequence: Synthetic peptide
  XENP018557 vlCDR3
QQDYSSPRT

SEQ ID NO: 6908 - protein, 249 aa, Artificial Sequence
  Description of Artificial Sequence: Synthetic polypeptide
  XENP018558 1G6_H1.62_L1_scFv(GKPGS)4
EVQLVESGGGLVKPGGSLRLSCAASGFTFSNYWMNWVRQAPGKGLEWVGIIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6909 - protein, 122 aa, Artificial Sequence
  Description of Artificial Sequence: Synthetic polypeptide
  VH of XENP018558
EVQLVESGGGLVKPGGSLRLSCAASGFTFSNYWMNWVRQAPGKGLEWVGIIRLKSNNYATHYAEPVKGRFTISRDDSKSTVYLQMNSLKTEDTAVYYCTRYYGNYGGYFDVWGAGTLVTVSS

SEQ ID NO: 6910 - protein, 107 aa, Artificial Sequence; identical to SEQ ID NO: 6247
  Description of Artificial Sequence: Synthetic polypeptide
  VL of XENP018558

SEQ ID NO: 6911 - protein, 5 aa, Artificial Sequence
  Description of Artificial Sequence: Synthetic peptide
  XENP018558 vhCDR1
NYWMN

SEQ ID NO: 6912 - protein, 19 aa, Artificial Sequence
  Description of Artificial Sequence: Synthetic peptide
  XENP018558 vhCDR2
IIRLKSNNYATHYAEPVKG

SEQ ID NO: 6913 - protein, 11 aa, Artificial Sequence
  Description of Artificial Sequence: Synthetic peptide
  XENP018558 vhCDR3
YYGNYGGYFDV

SEQ ID NO: 6914 - protein, 11 aa, Artificial Sequence
  Description of Artificial Sequence: Synthetic peptide
  XENP018558 vlCDR1
RASQSVSNDVA

SEQ ID NO: 6915 - protein, 7 aa, Artificial Sequence
  Description of Artificial Sequence: Synthetic peptide
  XENP018558 vlCDR2
YASHRYT

SEQ ID NO: 6916 - protein, 9 aa, Artificial Sequence
  Description of Artificial Sequence: Synthetic peptide
  XENP018558 vlCDR3
QQDYSSPRT

SEQ ID NO: 6917 - protein, 249 aa, Artificial Sequence
  Description of Artificial Sequence: Synthetic polypeptide
  XENP018559 1G6_H1.63_L1_scFv(GKPGS)4
EVQLVESGGGLVKPGGSLRLSCAASGFTFSNYWMNWVRQAPGKGLEWVGEVRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6918 - protein, 122 aa, Artificial Sequence
  Description of Artificial Sequence: Synthetic polypeptide
  VH of XENP018559
EVQLVESGGGLVKPGGSLRLSCAASGFTFSNYWMNWVRQAPGKGLEWVGEVRLKSNNYATHYAEPVKGRFTISRDDSKSTVYLQMNSLKTEDTAVYYCTRYYGNYGGYFDVWGAGTLVTVSS

SEQ ID NO: 6919 - protein, 107 aa, Artificial Sequence; identical to SEQ ID NO: 6247
  Description of Artificial Sequence: Synthetic polypeptide
  VL of XENP018559

SEQ ID NO: 6920 - protein, 5 aa, Artificial Sequence
  Description of Artificial Sequence: Synthetic peptide
  XENP018559 vhCDR1
NYWMN

SEQ ID NO: 6921 - protein, 19 aa, Artificial Sequence
  Description of Artificial Sequence: Synthetic peptide
  XENP018559 vhCDR2
EVRLKSNNYATHYAEPVKG

SEQ ID NO: 6922 - protein, 11 aa, Artificial Sequence
  Description of Artificial Sequence: Synthetic peptide
  XENP018559 vhCDR3
YYGNYGGYFDV

SEQ ID NO: 6923 - protein, 11 aa, Artificial Sequence
  Description of Artificial Sequence: Synthetic peptide
  XENP018559 vlCDR1
RASQSVSNDVA

SEQ ID NO: 6924 - protein, 7 aa, Artificial Sequence
  Description of Artificial Sequence: Synthetic peptide
  XENP018559 vlCDR2
YASHRYT

SEQ ID NO: 6925 - protein, 9 aa, Artificial Sequence
  Description of Artificial Sequence: Synthetic peptide
  XENP018559 vlCDR3
QQDYSSPRT

SEQ ID NO: 6926 - protein, 249 aa, Artificial Sequence
  Description of Artificial Sequence: Synthetic polypeptide
  XENP018560 1G6_H1.64_L1_scFv(GKPGS)4
EVQLVESGGGLVKPGGSLRLSCAASGFTFSNYWMNWVRQAPGKGLEWVGEITLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6927 - protein, 122 aa, Artificial Sequence
  Description of Artificial Sequence: Synthetic polypeptide
  VH of XENP018560
EVQLVESGGGLVKPGGSLRLSCAASGFTFSNYWMNWVRQAPGKGLEWVGEITLKSNNYATHYAEPVKGRFTISRDDSKSTVYLQMNSLKTEDTAVYYCTRYYGNYGGYFDVWGAGTLVTVSS

SEQ ID NO: 6928 - protein, 107 aa, Artificial Sequence; identical to SEQ ID NO: 6247
  Description of Artificial Sequence: Synthetic polypeptide
  VL of XENP018560

SEQ ID NO: 6929 - protein, 5 aa, Artificial Sequence
  Description of Artificial Sequence: Synthetic peptide
  XENP018560 vhCDR1
NYWMN

SEQ ID NO: 6930 - protein, 19 aa, Artificial Sequence
  Description of Artificial Sequence: Synthetic peptide
  XENP018560 vhCDR2
EITLKSNNYATHYAEPVKG

SEQ ID NO: 6931 - protein, 11 aa, Artificial Sequence
  Description of Artificial Sequence: Synthetic peptide
  XENP018560 vhCDR3
YYGNYGGYFDV

SEQ ID NO: 6932 - protein, 11 aa, Artificial Sequence
  Description of Artificial Sequence: Synthetic peptide
  XENP018560 vlCDR1
RASQSVSNDVA

SEQ ID NO: 6933 - protein, 7 aa, Artificial Sequence
  Description of Artificial Sequence: Synthetic peptide
  XENP018560 vlCDR2
YASHRYT

SEQ ID NO: 6934 - protein, 9 aa, Artificial Sequence
  Description of Artificial Sequence: Synthetic peptide
  XENP018560 vlCDR3
QQDYSSPRT

SEQ ID NO: 6935 - protein, 249 aa, Artificial Sequence
  Description of Artificial Sequence: Synthetic polypeptide
  XENP018561 1G6_H1.65_L1_scFv(GKPGS)4
EVQLVESGGGLVKPGGSLRLSCAASGFTFSNYWMNWVRQAPGKGLEWVGEIKLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6936 - protein, 122 aa, Artificial Sequence
  Description of Artificial Sequence: Synthetic polypeptide
  VH of XENP018561
EVQLVESGGGLVKPGGSLRLSCAASGFTFSNYWMNWVRQAPGKGLEWVGEIKLKSNNYATHYAEPVKGRFTISRDDSKSTVYLQMNSLKTEDTAVYYCTRYYGNYGGYFDVWGAGTLVTVSS

SEQ ID NO: 6937 - protein, 107 aa, Artificial Sequence; identical to SEQ ID NO: 6247
  Description of Artificial Sequence: Synthetic polypeptide
  VL of XENP018561

SEQ ID NO: 6938 - protein, 5 aa, Artificial Sequence
  Description of Artificial Sequence: Synthetic peptide
  XENP018561 vhCDR1
NYWMN

SEQ ID NO: 6939 - protein, 19 aa, Artificial Sequence
  Description of Artificial Sequence: Synthetic peptide
  XENP018561 vhCDR2
EIKLKSNNYATHYAEPVKG

SEQ ID NO: 6940 - protein, 11 aa, Artificial Sequence
  Description of Artificial Sequence: Synthetic peptide
  XENP018561 vhCDR3
YYGNYGGYFDV

SEQ ID NO: 6941 - protein, 11 aa, Artificial Sequence
  Description of Artificial Sequence: Synthetic peptide
  XENP018561 vlCDR1
RASQSVSNDVA

SEQ ID NO: 6942 - protein, 7 aa, Artificial Sequence
  Description of Artificial Sequence: Synthetic peptide
  XENP018561 vlCDR2
YASHRYT

SEQ ID NO: 6943 - protein, 9 aa, Artificial Sequence
  Description of Artificial Sequence: Synthetic peptide
  XENP018561 vlCDR3
QQDYSSPRT

SEQ ID NO: 6944 - protein, 249 aa, Artificial Sequence
  Description of Artificial Sequence: Synthetic polypeptide
  XENP018562 1G6_H1.66_L1_scFv(GKPGS)4
EVQLVESGGGLVKPGGSLRLSCAASGFTFSNYWMNWVRQAPGKGLEWVGEIELKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6945 - protein, 122 aa, Artificial Sequence
  Description of Artificial Sequence: Synthetic polypeptide
  VH of XENP018562
EVQLVESGGGLVKPGGSLRLSCAASGFTFSNYWMNWVRQAPGKGLEWVGEIELKSNNYATHYAEPVKGRFTISRDDSKSTVYLQMNSLKTEDTAVYYCTRYYGNYGGYFDVWGAGTLVTVSS

SEQ ID NO: 6946 - protein, 107 aa, Artificial Sequence; identical to SEQ ID NO: 6247
  Description of Artificial Sequence: Synthetic polypeptide
  VL of XENP018562

SEQ ID NO: 6947 - protein, 5 aa, Artificial Sequence
  Description of Artificial Sequence: Synthetic peptide
  XENP018562 vhCDR1
NYWMN

SEQ ID NO: 6948 - protein, 19 aa, Artificial Sequence
  Description of Artificial Sequence: Synthetic peptide
  XENP018562 vhCDR2
EIELKSNNYATHYAEPVKG

SEQ ID NO: 6949 - protein, 11 aa, Artificial Sequence
  Description of Artificial Sequence: Synthetic peptide
  XENP018562 vhCDR3
YYGNYGGYFDV

SEQ ID NO: 6950 - protein, 11 aa, Artificial Sequence
  Description of Artificial Sequence: Synthetic peptide
  XENP018562 vlCDR1
RASQSVSNDVA

SEQ ID NO: 6951 - protein, 7 aa, Artificial Sequence
  Description of Artificial Sequence: Synthetic peptide
  XENP018562 vlCDR2
YASHRYT

SEQ ID NO: 6952 - protein, 9 aa, Artificial Sequence
  Description of Artificial Sequence: Synthetic peptide
  XENP018562 vlCDR3
QQDYSSPRT

SEQ ID NO: 6953 - protein, 249 aa, Artificial Sequence
  Description of Artificial Sequence: Synthetic polypeptide
  XENP018563 1G6_H1.67_L1_scFv(GKPGS)4
EVQLVESGGGLVKPGGSLRLSCAASGFTFSNYWMNWVRQAPGKGLEWVGEIDLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6954 - protein, 122 aa, Artificial Sequence
  Description of Artificial Sequence: Synthetic polypeptide
  VH of XENP018563
EVQLVESGGGLVKPGGSLRLSCAASGFTFSNYWMNWVRQAPGKGLEWVGEIDLKSNNYATHYAEPVKGRFTISRDDSKSTVYLQMNSLKTEDTAVYYCTRYYGNYGGYFDVWGAGTLVTVSS

SEQ ID NO: 6955 - protein, 107 aa, Artificial Sequence; identical to SEQ ID NO: 6247
  Description of Artificial Sequence: Synthetic polypeptide
  VL of XENP018563

SEQ ID NO: 6956 - protein, 5 aa, Artificial Sequence
  Description of Artificial Sequence: Synthetic peptide
  XENP018563 vhCDR1
NYWMN

SEQ ID NO: 6957 - protein, 19 aa, Artificial Sequence
  Description of Artificial Sequence: Synthetic peptide
  XENP018563 vhCDR2
EIDLKSNNYATHYAEPVKG

SEQ ID NO: 6958 - protein, 11 aa, Artificial Sequence
  Description of Artificial Sequence: Synthetic peptide
  XENP018563 vhCDR3
YYGNYGGYFDV

SEQ ID NO: 6959 - protein, 11 aa, Artificial Sequence
  Description of Artificial Sequence: Synthetic peptide
  XENP018563 vlCDR1
RASQSVSNDVA

SEQ ID NO: 6960 - protein, 7 aa, Artificial Sequence
  Description of Artificial Sequence: Synthetic peptide
  XENP018563 vlCDR2
YASHRYT

SEQ ID NO: 6961 - protein, 9 aa, Artificial Sequence
  Description of Artificial Sequence: Synthetic peptide
  XENP018563 vlCDR3
QQDYSSPRT

SEQ ID NO: 6962 - protein, 249 aa, Artificial Sequence
  Description of Artificial Sequence: Synthetic polypeptide
  XENP018564 1G6_H1.68_L1_scFv(GKPGS)4
EVQLVESGGGLVKPGGSLRLSCAASGFTFSNYWMNWVRQAPGKGLEWVGEIHLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6963 - protein, 122 aa, Artificial Sequence
  Description of Artificial Sequence: Synthetic polypeptide
  VH of XENP018564
EVQLVESGGGLVKPGGSLRLSCAASGFTFSNYWMNWVRQAPGKGLEWVGEIHLKSNNYATHYAEPVKGRFTISRDDSKSTVYLQMNSLKTEDTAVYYCTRYYGNYGGYFDVWGAGTLVTVSS

SEQ ID NO: 6964 - protein, 107 aa, Artificial Sequence; identical to SEQ ID NO: 6247
  Description of Artificial Sequence: Synthetic polypeptide
  VL of XENP018564

SEQ ID NO: 6965 - protein, 5 aa, Artificial Sequence
  Description of Artificial Sequence: Synthetic peptide
  XENP018564 vhCDR1
NYWMN

SEQ ID NO: 6966 - protein, 19 aa, Artificial Sequence
  Description of Artificial Sequence: Synthetic peptide
  XENP018564 vhCDR2
EIHLKSNNYATHYAEPVKG

SEQ ID NO: 6967 - protein, 11 aa, Artificial Sequence
  Description of Artificial Sequence: Synthetic peptide
  XENP018564 vhCDR3
YYGNYGGYFDV

SEQ ID NO: 6968 - protein, 11 aa, Artificial Sequence
  Description of Artificial Sequence: Synthetic peptide
  XENP018564 vlCDR1
RASQSVSNDVA

SEQ ID NO: 6969 - protein, 7 aa, Artificial Sequence
  Description of Artificial Sequence: Synthetic peptide
  XENP018564 vlCDR2
YASHRYT

SEQ ID NO: 6970 - protein, 9 aa, Artificial Sequence
  Description of Artificial Sequence: Synthetic peptide
  XENP018564 vlCDR3
QQDYSSPRT

SEQ ID NO: 6971 - protein, 249 aa, Artificial Sequence
  Description of Artificial Sequence: Synthetic polypeptide
  XENP018565 1G6_H1.69_L1_scFv(GKPGS)4
EVQLVESGGGLVKPGGSLRLSCAASGFTFSNYWMNWVRQAPGKGLEWVGEISLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6972 - protein, 122 aa, Artificial Sequence
  Description of Artificial Sequence: Synthetic polypeptide
  VH of XENP018565
EVQLVESGGGLVKPGGSLRLSCAASGFTFSNYWMNWVRQAPGKGLEWVGEISLKSNNYATHYAEPVKGRFTISRDDSKSTVYLQMNSLKTEDTAVYYCTRYYGNYGGYFDVWGAGTLVTVSS

SEQ ID NO: 6973 - protein, 107 aa, Artificial Sequence; identical to SEQ ID NO: 6247
  Description of Artificial Sequence: Synthetic polypeptide
  VL of XENP018565

SEQ ID NO: 6974 - protein, 5 aa, Artificial Sequence
  Description of Artificial Sequence: Synthetic peptide
  XENP018565 vhCDR1
NYWMN

SEQ ID NO: 6975 - protein, 19 aa, Artificial Sequence
  Description of Artificial Sequence: Synthetic peptide
  XENP018565 vhCDR2
EISLKSNNYATHYAEPVKG

SEQ ID NO: 6976 - protein, 11 aa, Artificial Sequence
  Description of Artificial Sequence: Synthetic peptide
  XENP018565 vhCDR3
YYGNYGGYFDV

SEQ ID NO: 6977 - protein, 11 aa, Artificial Sequence
  Description of Artificial Sequence: Synthetic peptide
  XENP018565 vlCDR1
RASQSVSNDVA

SEQ ID NO: 6978 - protein, 7 aa, Artificial Sequence
  Description of Artificial Sequence: Synthetic peptide
  XENP018565 vlCDR2
YASHRYT

SEQ ID NO: 6979 - protein, 9 aa, Artificial Sequence
  Description of Artificial Sequence: Synthetic peptide
  XENP018565 vlCDR3
QQDYSSPRT

SEQ ID NO: 6980 - protein, 249 aa, Artificial Sequence
  Description of Artificial Sequence: Synthetic polypeptide
  XENP018566 1G6_H1.70_L1_scFv(GKPGS)4
EVQLVESGGGLVKPGGSLRLSCAASGFTFSNYWMNWVRQAPGKGLEWVGEIGLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6981 - protein, 122 aa, Artificial Sequence
  Description of Artificial Sequence: Synthetic polypeptide
  VH of XENP018566
EVQLVESGGGLVKPGGSLRLSCAASGFTFSNYWMNWVRQAPGKGLEWVGEIGLKSNNYATHYAEPVKGRFTISRDDSKSTVYLQMNSLKTEDTAVYYCTRYYGNYGGYFDVWGAGTLVTVSS

SEQ ID NO: 6982 - protein, 107 aa, Artificial Sequence; identical to SEQ ID NO: 6247
  Description of Artificial Sequence: Synthetic polypeptide
  VL of XENP018566

SEQ ID NO: 6983 - protein, 5 aa, Artificial Sequence
  Description of Artificial Sequence: Synthetic peptide
  XENP018566 vhCDR1
NYWMN

SEQ ID NO: 6984 - protein, 19 aa, Artificial Sequence
  Description of Artificial Sequence: Synthetic peptide
  XENP018566 vhCDR2
EIGLKSNNYATHYAEPVKG

SEQ ID NO: 6985 - protein, 11 aa, Artificial Sequence
  Description of Artificial Sequence: Synthetic peptide
  XENP018566 vhCDR3
YYGNYGGYFDV

SEQ ID NO: 6986 - protein, 11 aa, Artificial Sequence
  Description of Artificial Sequence: Synthetic peptide
  XENP018566 vlCDR1
RASQSVSNDVA

SEQ ID NO: 6987 - protein, 7 aa, Artificial Sequence
  Description of Artificial Sequence: Synthetic peptide
  XENP018566 vlCDR2
YASHRYT

SEQ ID NO: 6988 - protein, 9 aa, Artificial Sequence
  Description of Artificial Sequence: Synthetic peptide
  XENP018566 vlCDR3
QQDYSSPRT

SEQ ID NO: 6989 - protein, 249 aa, Artificial Sequence
  Description of Artificial Sequence: Synthetic polypeptide
  XENP018567 1G6_H1.71_L1_scFv(GKPGS)4
EVQLVESGGGLVKPGGSLRLSCAASGFTFSNYWMNWVRQAPGKGLEWVGEIYLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6990 - protein, 122 aa, Artificial Sequence
  Description of Artificial Sequence: Synthetic polypeptide
  VH of XENP018567
EVQLVESGGGLVKPGGSLRLSCAASGFTFSNYWMNWVRQAPGKGLEWVGEIYLKSNNYATHYAEPVKGRFTISRDDSKSTVYLQMNSLKTEDTAVYYCTRYYGNYGGYFDVWGAGTLVTVSS

SEQ ID NO: 6991 - protein, 107 aa, Artificial Sequence; identical to SEQ ID NO: 6247
  Description of Artificial Sequence: Synthetic polypeptide
  VL of XENP018567

SEQ ID NO: 6992 - protein, 5 aa, Artificial Sequence
  Description of Artificial Sequence: Synthetic peptide
  XENP018567 vhCDR1
NYWMN

SEQ ID NO: 6993 - protein, 19 aa, Artificial Sequence
  Description of Artificial Sequence: Synthetic peptide
  XENP018567 vhCDR2
EIYLKSNNYATHYAEPVKG

SEQ ID NO: 6994 - protein, 11 aa, Artificial Sequence
  Description of Artificial Sequence: Synthetic peptide
  XENP018567 vhCDR3
YYGNYGGYFDV

SEQ ID NO: 6995 - protein, 11 aa, Artificial Sequence
  Description of Artificial Sequence: Synthetic peptide
  XENP018567 vlCDR1
RASQSVSNDVA

SEQ ID NO: 6996 - protein, 7 aa, Artificial Sequence
  Description of Artificial Sequence: Synthetic peptide
  XENP018567 vlCDR2
YASHRYT

SEQ ID NO: 6997 - protein, 9 aa, Artificial Sequence
  Description of Artificial Sequence: Synthetic peptide
  XENP018567 vlCDR3
QQDYSSPRT

SEQ ID NO: 6998 - protein, 249 aa, Artificial Sequence
  Description of Artificial Sequence: Synthetic polypeptide
  XENP018568 1G6_H1.72_L1_scFv(GKPGS)4
EVQLVESGGGLVKPGGSLRLSCAASGFTFSNYWMNWVRQAPGKGLEWVGEIILKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6999 - protein, 122 aa, Artificial Sequence
  Description of Artificial Sequence: Synthetic polypeptide
  VH of XENP018568
EVQLVESGGGLVKPGGSLRLSCAASGFTFSNYWMNWVRQAPGKGLEWVGEIILKSNNYATHYAEPVKGRFTISRDDSKSTVYLQMNSLKTEDTAVYYCTRYYGNYGGYFDVWGAGTLVTVSS

SEQ ID NO: 7000 - protein, 107 aa, Artificial Sequence; identical to SEQ ID NO: 6247
  Description of Artificial Sequence: Synthetic polypeptide
  VL of XENP018568

SEQ ID NO: 7001 - protein, 5 aa, Artificial Sequence
  Description of Artificial Sequence: Synthetic peptide
  XENP018568 vhCDR1
NYWMN

SEQ ID NO: 7002 - protein, 19 aa, Artificial Sequence
  Description of Artificial Sequence: Synthetic peptide
  XENP018568 vhCDR2
EIILKSNNYATHYAEPVKG

SEQ ID NO: 7003 - protein, 11 aa, Artificial Sequence
  Description of Artificial Sequence: Synthetic peptide
  XENP018568 vhCDR3
YYGNYGGYFDV

SEQ ID NO: 7004 - protein, 11 aa, Artificial Sequence
  Description of Artificial Sequence: Synthetic peptide
  XENP018568 vlCDR1
RASQSVSNDVA

SEQ ID NO: 7005 - protein, 7 aa, Artificial Sequence
  Description of Artificial Sequence: Synthetic peptide
  XENP018568 vlCDR2
YASHRYT

SEQ ID NO: 7006 - protein, 9 aa, Artificial Sequence
  Description of Artificial Sequence: Synthetic peptide
  XENP018568 vlCDR3
QQDYSSPRT

SEQ ID NO: 7007 - protein, 249 aa, Artificial Sequence
  Description of Artificial Sequence: Synthetic polypeptide
  XENP018569 1G6_H1.73_L1_scFv(GKPGS)4
EVQLVESGGGLVKPGGSLRLSCAASGFTFSNYWMNWVRQAPGKGLEWVGEIWLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7008 - protein, 122 aa, Artificial Sequence
  Description of Artificial Sequence: Synthetic polypeptide
  VH of XENP018569
EVQLVESGGGLVKPGGSLRLSCAASGFTFSNYWMNWVRQAPGKGLEWVGEIWLKSNNYATHYAEPVKGRFTISRDDSKSTVYLQMNSLKTEDTAVYYCTRYYGNYGGYFDVWGAGTLVTVSS

SEQ ID NO: 7009 - protein, 107 aa, Artificial Sequence; identical to SEQ ID NO: 6247
  Description of Artificial Sequence: Synthetic polypeptide
  VL of XENP018569

SEQ ID NO: 7010 - protein, 5 aa, Artificial Sequence
  Description of Artificial Sequence: Synthetic peptide
  XENP018569 vhCDR1
NYWMN

SEQ ID NO: 7011 - protein, 19 aa, Artificial Sequence
  Description of Artificial Sequence: Synthetic peptide
  XENP018569 vhCDR2
EIWLKSNNYATHYAEPVKG

SEQ ID NO: 7012 - protein, 11 aa, Artificial Sequence
  Description of Artificial Sequence: Synthetic peptide
  XENP018569 vhCDR3
YYGNYGGYFDV

SEQ ID NO: 7013 - protein, 11 aa, Artificial Sequence
  Description of Artificial Sequence: Synthetic peptide
  XENP018569 vlCDR1
RASQSVSNDVA

SEQ ID NO: 7014 - protein, 7 aa, Artificial Sequence
  Description of Artificial Sequence: Synthetic peptide
  XENP018569 vlCDR2
YASHRYT

SEQ ID NO: 7015 - protein, 9 aa, Artificial Sequence
  Description of Artificial Sequence: Synthetic peptide
  XENP018569 vlCDR3
QQDYSSPRT

SEQ ID NO: 7016 - protein, 249 aa, Artificial Sequence
  Description of Artificial Sequence: Synthetic polypeptide
  XENP018570 1G6_H1.74_L1_scFv(GKPGS)4
EVQLVESGGGLVKPGGSLRLSCAASGFTFSNYWMNWVRQAPGKGLEWVGEIRIKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7017 - protein, 122 aa, Artificial Sequence
  Description of Artificial Sequence: Synthetic polypeptide
  VH of XENP018570
EVQLVESGGGLVKPGGSLRLSCAASGFTFSNYWMNWVRQAPGKGLEWVGEIRIKSNNYATHYAEPVKGRFTISRDDSKSTVYLQMNSLKTEDTAVYYCTRYYGNYGGYFDVWGAGTLVTVSS

SEQ ID NO: 7018 - protein, 107 aa, Artificial Sequence; identical to SEQ ID NO: 6247
  Description of Artificial Sequence: Synthetic polypeptide
  VL of XENP018570

SEQ ID NO: 7019 - protein, 5 aa, Artificial Sequence
  Description of Artificial Sequence: Synthetic peptide
  XENP018570 vhCDR1
NYWMN

SEQ ID NO: 7020 - protein, 19 aa, Artificial Sequence
  Description of Artificial Sequence: Synthetic peptide
  XENP018570 vhCDR2
EIRIKSNNYATHYAEPVKG

SEQ ID NO: 7021 - protein, 11 aa, Artificial Sequence
  Description of Artificial Sequence: Synthetic peptide
  XENP018570 vhCDR3
YYGNYGGYFDV

SEQ ID NO: 7022 - protein, 11 aa, Artificial Sequence
  Description of Artificial Sequence: Synthetic peptide
  XENP018570 vlCDR1
RASQSVSNDVA

SEQ ID NO: 7023 - protein, 7 aa, Artificial Sequence
  Description of Artificial Sequence: Synthetic peptide
  XENP018570 vlCDR2
YASHRYT

SEQ ID NO: 7024 - protein, 9 aa, Artificial Sequence
  Description of Artificial Sequence: Synthetic peptide
  XENP018570 vlCDR3
QQDYSSPRT

SEQ ID NO: 7025 - protein, 249 aa, Artificial Sequence
  Description of Artificial Sequence: Synthetic polypeptide
  XENP018571 1G6_H1.75_L1_scFv(GKPGS)4
EVQLVESGGGLVKPGGSLRLSCAASGFTFSNYWMNWVRQAPGKGLEWVGEIRFKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7026 - protein, 122 aa, Artificial Sequence
  Description of Artificial Sequence: Synthetic polypeptide
  VH of XENP018571
EVQLVESGGGLVKPGGSLRLSCAASGFTFSNYWMNWVRQAPGKGLEWVGEIRFKSNNYATHYAEPVKGRFTISRDDSKSTVYLQMNSLKTEDTAVYYCTRYYGNYGGYFDVWGAGTLVTVSS

SEQ ID NO: 7027 - protein, 107 aa, Artificial Sequence; identical to SEQ ID NO: 6247
  Description of Artificial Sequence: Synthetic polypeptide
  VL of XENP018571

SEQ ID NO: 7028 - protein, 5 aa, Artificial Sequence
  Description of Artificial Sequence: Synthetic peptide
  XENP018571 vhCDR1
NYWMN

SEQ ID NO: 7029 - protein, 19 aa, Artificial Sequence
  Description of Artificial Sequence: Synthetic peptide
  XENP018571 vhCDR2
EIRFKSNNYATHYAEPVKG

SEQ ID NO: 7030 - protein, 11 aa, Artificial Sequence
  Description of Artificial Sequence: Synthetic peptide
  XENP018571 vhCDR3
YYGNYGGYFDV

SEQ ID NO: 7031 - protein, 11 aa, Artificial Sequence
  Description of Artificial Sequence: Synthetic peptide
  XENP018571 vlCDR1
RASQSVSNDVA

SEQ ID NO: 7032 - protein, 7 aa, Artificial Sequence
  Description of Artificial Sequence: Synthetic peptide
  XENP018571 vlCDR2
YASHRYT

SEQ ID NO: 7033 - protein, 9 aa, Artificial Sequence
  Description of Artificial Sequence: Synthetic peptide
  XENP018571 vlCDR3
QQDYSSPRT

SEQ ID NO: 7034 - protein, 249 aa, Artificial Sequence
  Description of Artificial Sequence: Synthetic polypeptide
  XENP018572 1G6_H1.76_L1_scFv(GKPGS)4
EVQLVESGGGLVKPGGSLRLSCAASGFTFSNYWMNWVRQAPGKGLEWVGEIRVKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7035 - protein, 122 aa, Artificial Sequence
  Description of Artificial Sequence: Synthetic polypeptide
  VH of XENP018572
EVQLVESGGGLVKPGGSLRLSCAASGFTFSNYWMNWVRQAPGKGLEWVGEIRVKSNNYATHYAEPVKGRFTISRDDSKSTVYLQMNSLKTEDTAVYYCTRYYGNYGGYFDVWGAGTLVTVSS

SEQ ID NO: 7036 - protein, 107 aa, Artificial Sequence; identical to SEQ ID NO: 6247
  Description of Artificial Sequence: Synthetic polypeptide
  VL of XENP018572

SEQ ID NO: 7037 - protein, 5 aa, Artificial Sequence
  Description of Artificial Sequence: Synthetic peptide
  XENP018572 vhCDR1
NYWMN

SEQ ID NO: 7038 - protein, 19 aa, Artificial Sequence
  Description of Artificial Sequence: Synthetic peptide
  XENP018572 vhCDR2
EIRVKSNNYATHYAEPVKG

SEQ ID NO: 7039 - protein, 11 aa, Artificial Sequence
  Description of Artificial Sequence: Synthetic peptide
  XENP018572 vhCDR3
YYGNYGGYFDV

SEQ ID NO: 7040 - protein, 11 aa, Artificial Sequence
  Description of Artificial Sequence: Synthetic peptide
  XENP018572 vlCDR1
RASQSVSNDVA

SEQ ID NO: 7041 - protein, 7 aa, Artificial Sequence
  Description of Artificial Sequence: Synthetic peptide
  XENP018572 vlCDR2
YASHRYT

SEQ ID NO: 7042 - protein, 9 aa, Artificial Sequence
  Description of Artificial Sequence: Synthetic peptide
  XENP018572 vlCDR3
QQDYSSPRT

SEQ ID NO: 7043 - protein, 249 aa, Artificial Sequence
  Description of Artificial Sequence: Synthetic polypeptide
  XENP018573 1G6_H1.77_L1_scFv(GKPGS)4
EVQLVESGGGLVKPGGSLRLSCAASGFTFSNYWMNWVRQAPGKGLEWVGEIRYKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7044 - protein, 122 aa, Artificial Sequence
  Description of Artificial Sequence: Synthetic polypeptide
  VH of XENP018573
EVQLVESGGGLVKPGGSLRLSCAASGFTFSNYWMNWVRQAPGKGLEWVGEIRYKSNNYATHYAEPVKGRFTISRDDSKSTVYLQMNSLKTEDTAVYYCTRYYGNYGGYFDVWGAGTLVTVSS

SEQ ID NO: 7045 - protein, 107 aa, Artificial Sequence; identical to SEQ ID NO: 6247
  Description of Artificial Sequence: Synthetic polypeptide
  VL of XENP018573

SEQ ID NO: 7046 - protein, 5 aa, Artificial Sequence
  Description of Artificial Sequence: Synthetic peptide
  XENP018573 vhCDR1
NYWMN

SEQ ID NO: 7047 - protein, 19 aa, Artificial Sequence
  Description of Artificial Sequence: Synthetic peptide
  XENP018573 vhCDR2
EIRYKSNNYATHYAEPVKG

SEQ ID NO: 7048 - protein, 11 aa, Artificial Sequence
  Description of Artificial Sequence: Synthetic peptide
  XENP018573 vhCDR3
YYGNYGGYFDV

SEQ ID NO: 7049 - protein, 11 aa, Artificial Sequence
  Description of Artificial Sequence: Synthetic peptide
  XENP018573 vlCDR1
RASQSVSNDVA

SEQ ID NO: 7050 - protein, 7 aa, Artificial Sequence
  Description of Artificial Sequence: Synthetic peptide
  XENP018573 vlCDR2
YASHRYT

SEQ ID NO: 7051 - protein, 9 aa, Artificial Sequence
  Description of Artificial Sequence: Synthetic peptide
  XENP018573 vlCDR3
QQDYSSPRT

SEQ ID NO: 7052 - protein, 249 aa, Artificial Sequence
  Description of Artificial Sequence: Synthetic polypeptide
  XENP018574 1G6_H1.78_L1_scFv(GKPGS)4
EVQLVESGGGLVKPGGSLRLSCAASGFTFSNYWMNWVRQAPGKGLEWVGEIRWKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7053 - protein, 122 aa, Artificial Sequence
  Description of Artificial Sequence: Synthetic polypeptide
  VH of XENP018574
EVQLVESGGGLVKPGGSLRLSCAASGFTFSNYWMNWVRQAPGKGLEWVGEIRWKSNNYATHYAEPVKGRFTISRDDSKSTVYLQMNSLKTEDTAVYYCTRYYGNYGGYFDVWGAGTLVTVSS

SEQ ID NO: 7054 - protein, 107 aa, Artificial Sequence; identical to SEQ ID NO: 6247
  Description of Artificial Sequence: Synthetic polypeptide
  VL of XENP018574

SEQ ID NO: 7055 - protein, 5 aa, Artificial Sequence
  Description of Artificial Sequence: Synthetic peptide
  XENP018574 vhCDR1
NYWMN

SEQ ID NO: 7056 - protein, 19 aa, Artificial Sequence
  Description of Artificial Sequence: Synthetic peptide
  XENP018574 vhCDR2
EIRWKSNNYATHYAEPVKG

SEQ ID NO: 7057 - protein, 11 aa, Artificial Sequence
  Description of Artificial Sequence: Synthetic peptide
  XENP018574 vhCDR3
YYGNYGGYFDV

SEQ ID NO: 7058 - protein, 11 aa, Artificial Sequence
  Description of Artificial Sequence: Synthetic peptide
  XENP018574 vlCDR1
RASQSVSNDVA

SEQ ID NO: 7059 - protein, 7 aa, Artificial Sequence
  Description of Artificial Sequence: Synthetic peptide
  XENP018574 vlCDR2
YASHRYT

SEQ ID NO: 7060 - protein, 9 aa, Artificial Sequence
  Description of Artificial Sequence: Synthetic peptide
  XENP018574 vlCDR3
QQDYSSPRT

SEQ ID NO: 7061 - protein, 249 aa, Artificial Sequence
  Description of Artificial Sequence: Synthetic polypeptide
  XENP018575 1G6_H1.79_L1_scFv(GKPGS)4
EVQLVESGGGLVKPGGSLRLSCAASGFTFSNYWMNWVRQAPGKGLEWVGEIRDKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7062 - protein, 122 aa, Artificial Sequence
  Description of Artificial Sequence: Synthetic polypeptide
  VH of XENP018575
EVQLVESGGGLVKPGGSLRLSCAASGFTFSNYWMNWVRQAPGKGLEWVGEIRDKSNNYATHYAEPVKGRFTISRDDSKSTVYLQMNSLKTEDTAVYYCTRYYGNYGGYFDVWGAGTLVTVSS

SEQ ID NO: 7063 - protein, 107 aa, Artificial Sequence; identical to SEQ ID NO: 6247
  Description of Artificial Sequence: Synthetic polypeptide
  VL of XENP018575

SEQ ID NO: 7064 - protein, 5 aa, Artificial Sequence
  Description of Artificial Sequence: Synthetic peptide
  XENP018575 vhCDR1
NYWMN

SEQ ID NO: 7065 - protein, 19 aa, Artificial Sequence
  Description of Artificial Sequence: Synthetic peptide
  XENP018575 vhCDR2
EIRDKSNNYATHYAEPVKG

SEQ ID NO: 7066 - protein, 11 aa, Artificial Sequence
  Description of Artificial Sequence: Synthetic peptide
  XENP018575 vhCDR3
YYGNYGGYFDV

SEQ ID NO: 7067 - protein, 11 aa, Artificial Sequence
  Description of Artificial Sequence: Synthetic peptide
  XENP018575 vlCDR1
RASQSVSNDVA

SEQ ID NO: 7068 - protein, 7 aa, Artificial Sequence
  Description of Artificial Sequence: Synthetic peptide
  XENP018575 vlCDR2
YASHRYT

SEQ ID NO: 7069 - protein, 9 aa, Artificial Sequence
  Description of Artificial Sequence: Synthetic peptide
  XENP018575 vlCDR3
QQDYSSPRT

SEQ ID NO: 7070 - protein, 249 aa, Artificial Sequence
  Description of Artificial Sequence: Synthetic polypeptide
  XENP018576 1G6_H1.80_L1_scFv(GKPGS)4
EVQLVESGGGLVKPGGSLRLSCAASGFTFSNYWMNWVRQAPGKGLEWVGEIRAKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7071 - protein, 122 aa, Artificial Sequence
  Description of Artificial Sequence: Synthetic polypeptide
  VH of XENP018576
EVQLVESGGGLVKPGGSLRLSCAASGFTFSNYWMNWVRQAPGKGLEWVGEIRAKSNNYATHYAEPVKGRFTISRDDSKSTVYLQMNSLKTEDTAVYYCTRYYGNYGGYFDVWGAGTLVTVSS

SEQ ID NO: 7072 - protein, 107 aa, Artificial Sequence; identical to SEQ ID NO: 6247
  Description of Artificial Sequence: Synthetic polypeptide
  VL of XENP018576

SEQ ID NO: 7073 - protein, 5 aa, Artificial Sequence
  Description of Artificial Sequence: Synthetic peptide
  XENP018576 vhCDR1
NYWMN

SEQ ID NO: 7074 - protein, 19 aa, Artificial Sequence
  Description of Artificial Sequence: Synthetic peptide
  XENP018576 vhCDR2
EIRAKSNNYATHYAEPVKG

SEQ ID NO: 7075 - protein, 11 aa, Artificial Sequence
  Description of Artificial Sequence: Synthetic peptide
  XENP018576 vhCDR3
YYGNYGGYFDV

SEQ ID NO: 7076 - protein, 11 aa, Artificial Sequence
  Description of Artificial Sequence: Synthetic peptide
  XENP018576 vlCDR1
RASQSVSNDVA

SEQ ID NO: 7077 - protein, 7 aa, Artificial Sequence
  Description of Artificial Sequence: Synthetic peptide
  XENP018576 vlCDR2
YASHRYT

SEQ ID NO: 7078 - protein, 9 aa, Artificial Sequence
  Description of Artificial Sequence: Synthetic peptide
  XENP018576 vlCDR3
QQDYSSPRT

SEQ ID NO: 7079 - protein, 249 aa, Artificial Sequence
  Description of Artificial Sequence: Synthetic polypeptide
  XENP018577 1G6_H1.81_L1_scFv(GKPGS)4
EVQLVESGGGLVKPGGSLRLSCAASGFTFSNYWMNWVRQAPGKGLEWVGEIRQKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7080 - protein, 122 aa, Artificial Sequence
  Description of Artificial Sequence: Synthetic polypeptide
  VH of XENP018577
EVQLVESGGGLVKPGGSLRLSCAASGFTFSNYWMNWVRQAPGKGLEWVGEIRQKSNNYATHYAEPVKGRFTISRDDSKSTVYLQMNSLKTEDTAVYYCTRYYGNYGGYFDVWGAGTLVTVSS

SEQ ID NO: 7081 - protein, 107 aa, Artificial Sequence; identical to SEQ ID NO: 6247
  Description of Artificial Sequence: Synthetic polypeptide
  VL of XENP018577

SEQ ID NO: 7082 - protein, 5 aa, Artificial Sequence
  Description of Artificial Sequence: Synthetic peptide
  XENP018577 vhCDR1
NYWMN

SEQ ID NO: 7083 - protein, 19 aa, Artificial Sequence
  Description of Artificial Sequence: Synthetic peptide
  XENP018577 vhCDR2
EIRQKSNNYATHYAEPVKG

SEQ ID NO: 7084 - protein, 11 aa, Artificial Sequence
  Description of Artificial Sequence: Synthetic peptide
  XENP018577 vhCDR3
YYGNYGGYFDV

SEQ ID NO: 7085 - protein, 11 aa, Artificial Sequence
  Description of Artificial Sequence: Synthetic peptide
  XENP018577 vlCDR1
RASQSVSNDVA

SEQ ID NO: 7086 - protein, 7 aa, Artificial Sequence
  Description of Artificial Sequence: Synthetic peptide
  XENP018577 vlCDR2
YASHRYT

SEQ ID NO: 7087 - protein, 9 aa, Artificial Sequence
  Description of Artificial Sequence: Synthetic peptide
  XENP018577 vlCDR3
QQDYSSPRT

SEQ ID NO: 7088 - protein, 249 aa, Artificial Sequence
  Description of Artificial Sequence: Synthetic polypeptide
  XENP018578 1G6_H1.82_L1_scFv(GKPGS)4
EVQLVESGGGLVKPGGSLRLSCAASGFTFSNYWMNWVRQAPGKGLEWVGEIRKKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7089 - protein, 122 aa, Artificial Sequence
  Description of Artificial Sequence: Synthetic polypeptide
  VH of XENP018578
EVQLVESGGGLVKPGGSLRLSCAASGFTFSNYWMNWVRQAPGKGLEWVGEIRKKSNNYATHYAEPVKGRFTISRDDSKSTVYLQMNSLKTEDTAVYYCTRYYGNYGGYFDVWGAGTLVTVSS

SEQ ID NO: 7090 - protein, 107 aa, Artificial Sequence; identical to SEQ ID NO: 6247
  Description of Artificial Sequence: Synthetic polypeptide
  VL of XENP018578

SEQ ID NO: 7091 - protein, 5 aa, Artificial Sequence
  Description of Artificial Sequence: Synthetic peptide
  XENP018578 vhCDR1
NYWMN

SEQ ID NO: 7092 - protein, 19 aa, Artificial Sequence
  Description of Artificial Sequence: Synthetic peptide
  XENP018578 vhCDR2
EIRKKSNNYATHYAEPVKG

SEQ ID NO: 7093 - protein, 11 aa, Artificial Sequence
  Description of Artificial Sequence: Synthetic peptide
  XENP018578 vhCDR3
YYGNYGGYFDV

SEQ ID NO: 7094 - protein, 11 aa, Artificial Sequence
  Description of Artificial Sequence: Synthetic peptide
  XENP018578 vlCDR1
RASQSVSNDVA

SEQ ID NO: 7095 - protein, 7 aa, Artificial Sequence
  Description of Artificial Sequence: Synthetic peptide
  XENP018578 vlCDR2
YASHRYT

SEQ ID NO: 7096 - protein, 9 aa, Artificial Sequence
  Description of Artificial Sequence: Synthetic peptide
  XENP018578 vlCDR3
QQDYSSPRT

SEQ ID NO: 7097 - protein, 249 aa, Artificial Sequence
  Description of Artificial Sequence: Synthetic polypeptide
  XENP018579 1G6_H1.83_L1_scFv(GKPGS)4
EVQLVESGGGLVKPGGSLRLSCAASGFTFSNYWMNWVRQAPGKGLEWVGEIRLRSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7098 - protein, 122 aa, Artificial Sequence
  Description of Artificial Sequence: Synthetic polypeptide
  VH of XENP018579
EVQLVESGGGLVKPGGSLRLSCAASGFTFSNYWMNWVRQAPGKGLEWVGEIRLRSNNYATHYAEPVKGRFTISRDDSKSTVYLQMNSLKTEDTAVYYCTRYYGNYGGYFDVWGAGTLVTVSS

SEQ ID NO: 7099 - protein, 107 aa, Artificial Sequence; identical to SEQ ID NO: 6247
  Description of Artificial Sequence: Synthetic polypeptide
  VL of XENP018579

SEQ ID NO: 7100 - protein, 5 aa, Artificial Sequence
  Description of Artificial Sequence: Synthetic peptide
  XENP018579 vhCDR1
NYWMN

SEQ ID NO: 7101 - protein, 19 aa, Artificial Sequence
  Description of Artificial Sequence: Synthetic peptide
  XENP018579 vhCDR2
EIRLRSNNYATHYAEPVKG

SEQ ID NO: 7102 - protein, 11 aa, Artificial Sequence
  Description of Artificial Sequence: Synthetic peptide
  XENP018579 vhCDR3
YYGNYGGYFDV

SEQ ID NO: 7103 - protein, 11 aa, Artificial Sequence
  Description of Artificial Sequence: Synthetic peptide
  XENP018579 vlCDR1
RASQSVSNDVA

SEQ ID NO: 7104 - protein, 7 aa, Artificial Sequence
  Description of Artificial Sequence: Synthetic peptide
  XENP018579 vlCDR2
YASHRYT

SEQ ID NO: 7105 - protein, 9 aa, Artificial Sequence
  Description of Artificial Sequence: Synthetic peptide
  XENP018579 vlCDR3
QQDYSSPRT

SEQ ID NO: 7106 - protein, 249 aa, Artificial Sequence
  Description of Artificial Sequence: Synthetic polypeptide
  XENP018580 1G6_H1.84_L1_scFv(GKPGS)4
EVQLVESGGGLVKPGGSLRLSCAASGFTFSNYWMNWVRQAPGKGLEWVGEIRLESNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7107 - protein, 122 aa, Artificial Sequence
  Description of Artificial Sequence: Synthetic polypeptide
  VH of XENP018580
EVQLVESGGGLVKPGGSLRLSCAASGFTFSNYWMNWVRQAPGKGLEWVGEIRLESNNYATHYAEPVKGRFTISRDDSKSTVYLQMNSLKTEDTAVYYCTRYYGNYGGYFDVWGAGTLVTVSS

SEQ ID NO: 7108 - protein, 107 aa, Artificial Sequence; identical to SEQ ID NO: 6247
  Description of Artificial Sequence: Synthetic polypeptide
  VL of XENP018580

SEQ ID NO: 7109 - protein, 5 aa, Artificial Sequence
  Description of Artificial Sequence: Synthetic peptide
  XENP018580 vhCDR1
NYWMN

SEQ ID NO: 7110 - protein, 19 aa, Artificial Sequence
  Description of Artificial Sequence: Synthetic peptide
  XENP018580 vhCDR2
EIRLESNNYATHYAEPVKG

SEQ ID NO: 7111 - protein, 11 aa, Artificial Sequence
  Description of Artificial Sequence: Synthetic peptide
  XENP018580 vhCDR3
YYGNYGGYFDV

SEQ ID NO: 7112 - protein, 11 aa, Artificial Sequence
  Description of Artificial Sequence: Synthetic peptide
  XENP018580 vlCDR1
RASQSVSNDVA

SEQ ID NO: 7113 - protein, 7 aa, Artificial Sequence
  Description of Artificial Sequence: Synthetic peptide
  XENP018580 vlCDR2
YASHRYT

SEQ ID NO: 7114 - protein, 9 aa, Artificial Sequence
  Description of Artificial Sequence: Synthetic peptide
  XENP018580 vlCDR3
QQDYSSPRT

SEQ ID NO: 7115 - protein, 249 aa, Artificial Sequence
  Description of Artificial Sequence: Synthetic polypeptide
  XENP018581 1G6_H1.85_L1_scFv(GKPGS)4
EVQLVESGGGLVKPGGSLRLSCAASGFTFSNYWMNWVRQAPGKGLEWVGEIRLHSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7116 - protein, 122 aa, Artificial Sequence
  Description of Artificial Sequence: Synthetic polypeptide
  VH of XENP018581
EVQLVESGGGLVKPGGSLRLSCAASGFTFSNYWMNWVRQAPGKGLEWVGEIRLHSNNYATHYAEPVKGRFTISRDDSKSTVYLQMNSLKTEDTAVYYCTRYYGNYGGYFDVWGAGTLVTVSS

SEQ ID NO: 7117 - protein, 107 aa, Artificial Sequence; identical to SEQ ID NO: 6247
  Description of Artificial Sequence: Synthetic polypeptide
  VL of XENP018581

SEQ ID NO: 7118 - protein, 5 aa, Artificial Sequence
  Description of Artificial Sequence: Synthetic peptide
  XENP018581 vhCDR1
NYWMN

SEQ ID NO: 7119 - protein, 19 aa, Artificial Sequence
  Description of Artificial Sequence: Synthetic peptide
  XENP018581 vhCDR2
EIRLHSNNYATHYAEPVKG

SEQ ID NO: 7120 - protein, 11 aa, Artificial Sequence
  Description of Artificial Sequence: Synthetic peptide
  XENP018581 vhCDR3
YYGNYGGYFDV

SEQ ID NO: 7121 - protein, 11 aa, Artificial Sequence
  Description of Artificial Sequence: Synthetic peptide
  XENP018581 vlCDR1
RASQSVSNDVA

SEQ ID NO: 7122 - protein, 7 aa, Artificial Sequence
  Description of Artificial Sequence: Synthetic peptide
  XENP018581 vlCDR2
YASHRYT

SEQ ID NO: 7123 - protein, 9 aa, Artificial Sequence
  Description of Artificial Sequence: Synthetic peptide
  XENP018581 vlCDR3
QQDYSSPRT

SEQ ID NO: 7124 - protein, 249 aa, Artificial Sequence
  Description of Artificial Sequence: Synthetic polypeptide
  XENP018582 1G6_H1.86_L1_scFv(GKPGS)4
EVQLVESGGGLVKPGGSLRLSCAASGFTFSNYWMNWVRQAPGKGLEWVGEIRLSSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7125 - protein, 122 aa, Artificial Sequence
  Description of Artificial Sequence: Synthetic polypeptide
  VH of XENP018582
EVQLVESGGGLVKPGGSLRLSCAASGFTFSNYWMNWVRQAPGKGLEWVGEIRLSSNNYATHYAEPVKGRFTISRDDSKSTVYLQMNSLKTEDTAVYYCTRYYGNYGGYFDVWGAGTLVTVSS

SEQ ID NO: 7126 - protein, 107 aa, Artificial Sequence; identical to SEQ ID NO: 6247
  Description of Artificial Sequence: Synthetic polypeptide
  VL of XENP018582

SEQ ID NO: 7127 - protein, 5 aa, Artificial Sequence
  Description of Artificial Sequence: Synthetic peptide
  XENP018582 vhCDR1
NYWMN

SEQ ID NO: 7128 - protein, 19 aa, Artificial Sequence
  Description of Artificial Sequence: Synthetic peptide
  XENP018582 vhCDR2
EIRLSSNNYATHYAEPVKG

SEQ ID NO: 7129 - protein, 11 aa, Artificial Sequence
  Description of Artificial Sequence: Synthetic peptide
  XENP018582 vhCDR3
YYGNYGGYFDV

SEQ ID NO: 7130 - protein, 11 aa, Artificial Sequence
  Description of Artificial Sequence: Synthetic peptide
  XENP018582 vlCDR1
RASQSVSNDVA

SEQ ID NO: 7131 - protein, 7 aa, Artificial Sequence
  Description of Artificial Sequence: Synthetic peptide
  XENP018582 vlCDR2
YASHRYT

SEQ ID NO: 7132 - protein, 9 aa, Artificial Sequence
  Description of Artificial Sequence: Synthetic peptide
  XENP018582 vlCDR3
QQDYSSPRT

SEQ ID NO: 7133 - protein, 249 aa, Artificial Sequence
  Description of Artificial Sequence: Synthetic polypeptide
  XENP018583 1G6_H1.87_L1_scFv(GKPGS)4
EVQLVESGGGLVKPGGSLRLSCAASGFTFSNYWMNWVRQAPGKGLEWVGEIRLDSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7134 - protein, 122 aa, Artificial Sequence
  Description of Artificial Sequence: Synthetic polypeptide
  VH of XENP018583
EVQLVESGGGLVKPGGSLRLSCAASGFTFSNYWMNWVRQAPGKGLEWVGEIRLDSNNYATHYAEPVKGRFTISRDDSKSTVYLQMNSLKTEDTAVYYCTRYYGNYGGYFDVWGAGTLVTVSS

SEQ ID NO: 7135 - protein, 107 aa, Artificial Sequence; identical to SEQ ID NO: 6247
  Description of Artificial Sequence: Synthetic polypeptide
  VL of XENP018583

SEQ ID NO: 7136 - protein, 5 aa, Artificial Sequence
  Description of Artificial Sequence: Synthetic peptide
  XENP018583 vhCDR1
NYWMN

SEQ ID NO: 7137 - protein, 19 aa, Artificial Sequence
  Description of Artificial Sequence: Synthetic peptide
  XENP018583 vhCDR2
EIRLDSNNYATHYAEPVKG

SEQ ID NO: 7138 - protein, 11 aa, Artificial Sequence
  Description of Artificial Sequence: Synthetic peptide
  XENP018583 vhCDR3
YYGNYGGYFDV

SEQ ID NO: 7139 - protein, 11 aa, Artificial Sequence
  Description of Artificial Sequence: Synthetic peptide
  XENP018583 vlCDR1
RASQSVSNDVA

SEQ ID NO: 7140 - protein, 7 aa, Artificial Sequence
  Description of Artificial Sequence: Synthetic peptide
  XENP018583 vlCDR2
YASHRYT

SEQ ID NO: 7141 - protein, 9 aa, Artificial Sequence
  Description of Artificial Sequence: Synthetic peptide
  XENP018583 vlCDR3
QQDYSSPRT

SEQ ID NO: 7142 - protein, 249 aa, Artificial Sequence
  Description of Artificial Sequence: Synthetic polypeptide
  XENP018584 1G6_H1.88_L1_scFv(GKPGS)4
EVQLVESGGGLVKPGGSLRLSCAASGFTFSNYWMNWVRQAPGKGLEWVGEIRLASNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7143 - protein, 122 aa, Artificial Sequence
  Description of Artificial Sequence: Synthetic polypeptide
  VH of XENP018584
EVQLVESGGGLVKPGGSLRLSCAASGFTFSNYWMNWVRQAPGKGLEWVGEIRLASNNYATHYAEPVKGRFTISRDDSKSTVYLQMNSLKTEDTAVYYCTRYYGNYGGYFDVWGAGTLVTVSS

SEQ ID NO: 7144 - protein, 107 aa, Artificial Sequence; identical to SEQ ID NO: 6247
  Description of Artificial Sequence: Synthetic polypeptide
  VL of XENP018584

SEQ ID NO: 7145 - protein, 5 aa, Artificial Sequence
  Description of Artificial Sequence: Synthetic peptide
  XENP018584 vhCDR1
NYWMN

SEQ ID NO: 7146 - protein, 19 aa, Artificial Sequence
  Description of Artificial Sequence: Synthetic peptide
  XENP018584 vhCDR2
EIRLASNNYATHYAEPVKG

SEQ ID NO: 7147 - protein, 11 aa, Artificial Sequence
  Description of Artificial Sequence: Synthetic peptide
  XENP018584 vhCDR3
YYGNYGGYFDV

SEQ ID NO: 7148 - protein, 11 aa, Artificial Sequence
  Description of Artificial Sequence: Synthetic peptide
  XENP018584 vlCDR1
RASQSVSNDVA

SEQ ID NO: 7149 - protein, 7 aa, Artificial Sequence
  Description of Artificial Sequence: Synthetic peptide
  XENP018584 vlCDR2
YASHRYT

SEQ ID NO: 7150 - protein, 9 aa, Artificial Sequence
  Description of Artificial Sequence: Synthetic peptide
  XENP018584 vlCDR3
QQDYSSPRT

SEQ ID NO: 7151 - protein, 249 aa, Artificial Sequence
  Description of Artificial Sequence: Synthetic polypeptide
  XENP018585 1G6_H1.89_L1_scFv(GKPGS)4
EVQLVESGGGLVKPGGSLRLSCAASGFTFSNYWMNWVRQAPGKGLEWVGEIRLGSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7152 - protein, 122 aa, Artificial Sequence
  Description of Artificial Sequence: Synthetic polypeptide
  VH of XENP018585
EVQLVESGGGLVKPGGSLRLSCAASGFTFSNYWMNWVRQAPGKGLEWVGEIRLGSNNYATHYAEPVKGRFTISRDDSKSTVYLQMNSLKTEDTAVYYCTRYYGNYGGYFDVWGAGTLVTVSS

SEQ ID NO: 7153 - protein, 107 aa, Artificial Sequence; identical to SEQ ID NO: 6247
  Description of Artificial Sequence: Synthetic polypeptide
  VL of XENP018585

SEQ ID NO: 7154 - protein, 5 aa, Artificial Sequence
  Description of Artificial Sequence: Synthetic peptide
  XENP018585 vhCDR1
NYWMN

SEQ ID NO: 7155 - protein, 19 aa, Artificial Sequence
  Description of Artificial Sequence: Synthetic peptide
  XENP018585 vhCDR2
EIRLGSNNYATHYAEPVKG

SEQ ID NO: 7156 - protein, 11 aa, Artificial Sequence
  Description of Artificial Sequence: Synthetic peptide
  XENP018585 vhCDR3
YYGNYGGYFDV

SEQ ID NO: 7157 - protein, 11 aa, Artificial Sequence
  Description of Artificial Sequence: Synthetic peptide
  XENP018585 vlCDR1
RASQSVSNDVA

SEQ ID NO: 7158 - protein, 7 aa, Artificial Sequence
  Description of Artificial Sequence: Synthetic peptide
  XENP018585 vlCDR2
YASHRYT

SEQ ID NO: 7159 - protein, 9 aa, Artificial Sequence
  Description of Artificial Sequence: Synthetic peptide
  XENP018585 vlCDR3
QQDYSSPRT

SEQ ID NO: 7160 - protein, 249 aa, Artificial Sequence
  Description of Artificial Sequence: Synthetic polypeptide
  XENP018586 1G6_H1.90_L1_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7161 - protein, 122 aa, Artificial Sequence
  Description of Artificial Sequence: Synthetic polypeptide
  VH of XENP018586
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSS

SEQ ID NO: 7162 - protein, 107 aa, Artificial Sequence; identical to SEQ ID NO: 6247
  Description of Artificial Sequence: Synthetic polypeptide
  VL of XENP018586

SEQ ID NO: 7163 - protein, 5 aa, Artificial Sequence
  Description of Artificial Sequence: Synthetic peptide
  XENP018586 vhCDR1
NYWMN

SEQ ID NO: 7164 - protein, 19 aa, Artificial Sequence
  Description of Artificial Sequence: Synthetic peptide
  XENP018586 vhCDR2
EIRLYSNNYATHYAEPVKG

SEQ ID NO: 7165 - protein, 11 aa, Artificial Sequence
  Description of Artificial Sequence: Synthetic peptide
  XENP018586 vhCDR3
YYGNYGGYFDV

SEQ ID NO: 7166 - protein, 11 aa, Artificial Sequence
  Description of Artificial Sequence: Synthetic peptide
  XENP018586 vlCDR1
RASQSVSNDVA

SEQ ID NO: 7167 - protein, 7 aa, Artificial Sequence
  Description of Artificial Sequence: Synthetic peptide
  XENP018586 vlCDR2
YASHRYT

SEQ ID NO: 7168 - protein, 9 aa, Artificial Sequence
  Description of Artificial Sequence: Synthetic peptide
  XENP018586 vlCDR3
QQDYSSPRT

SEQ ID NO: 7169 - protein, 249 aa, Artificial Sequence
  Description of Artificial Sequence: Synthetic polypeptide
  XENP018587 1G6_H1.91_L1_scFv(GKPGS)4
EVQLVESGGGLVKPGGSLRLSCAASGFTFSNYWMNWVRQAPGKGLEWVGEIRLISNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7170 - protein, 122 aa, Artificial Sequence
  Description of Artificial Sequence: Synthetic polypeptide
  VH of XENP018587
EVQLVESGGGLVKPGGSLRLSCAASGFTFSNYWMNWVRQAPGKGLEWVGEIRLISNNYATHYAEPVKGRFTISRDDSKSTVYLQMNSLKTEDTAVYYCTRYYGNYGGYFDVWGAGTLVTVSS

SEQ ID NO: 7171 - protein, 107 aa, Artificial Sequence; identical to SEQ ID NO: 6247
  Description of Artificial Sequence: Synthetic polypeptide
  VL of XENP018587

SEQ ID NO: 7172 - protein, 5 aa, Artificial Sequence
  Description of Artificial Sequence: Synthetic peptide
  XENP018587 vhCDR1
NYWMN

SEQ ID NO: 7173 - protein, 19 aa, Artificial Sequence
  Description of Artificial Sequence: Synthetic peptide
  XENP018587 vhCDR2
EIRLISNNYATHYAEPVKG

SEQ ID NO: 7174 - protein, 11 aa, Artificial Sequence
  Description of Artificial Sequence: Synthetic peptide
  XENP018587 vhCDR3
YYGNYGGYFDV

SEQ ID NO: 7175 - protein, 11 aa, Artificial Sequence
  Description of Artificial Sequence: Synthetic peptide
  XENP018587 vlCDR1
RASQSVSNDVA

SEQ ID NO: 7176 - protein, 7 aa, Artificial Sequence
  Description of Artificial Sequence: Synthetic peptide
  XENP018587 vlCDR2
YASHRYT

SEQ ID NO: 7177 - protein, 9 aa, Artificial Sequence
  Description of Artificial Sequence: Synthetic peptide
  XENP018587 vlCDR3
QQDYSSPRT

SEQ ID NO: 7178 - protein, 249 aa, Artificial Sequence
  Description of Artificial Sequence: Synthetic polypeptide
  XENP018588 1G6_H1.92_L1_scFv(GKPGS)4
EVQLVESGGGLVKPGGSLRLSCAASGFTFSNYWMNWVRQAPGKGLEWVGEIRLKTNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7179 - protein, 122 aa, Artificial Sequence
  Description of Artificial Sequence: Synthetic polypeptide
  VH of XENP018588
EVQLVESGGGLVKPGGSLRLSCAASGFTFSNYWMNWVRQAPGKGLEWVGEIRLKTNNYATHYAEPVKGRFTISRDDSKSTVYLQMNSLKTEDTAVYYCTRYYGNYGGYFDVWGAGTLVTVSS

SEQ ID NO: 7180 - protein, 107 aa, Artificial Sequence; identical to SEQ ID NO: 6247
  Description of Artificial Sequence: Synthetic polypeptide
  VL of XENP018588

SEQ ID NO: 7181 - protein, 5 aa, Artificial Sequence
  Description of Artificial Sequence: Synthetic peptide
  XENP018588 vhCDR1
NYWMN

SEQ ID NO: 7182 - protein, 19 aa, Artificial Sequence
  Description of Artificial Sequence: Synthetic peptide
  XENP018588 vhCDR2
EIRLKTNNYATHYAEPVKG

SEQ ID NO: 7183 - protein, 11 aa, Artificial Sequence
  Description of Artificial Sequence: Synthetic peptide
  XENP018588 vhCDR3
YYGNYGGYFDV

SEQ ID NO: 7184 - protein, 11 aa, Artificial Sequence
  Description of Artificial Sequence: Synthetic peptide
  XENP018588 vlCDR1
RASQSVSNDVA

SEQ ID NO: 7185 - protein, 7 aa, Artificial Sequence
  Description of Artificial Sequence: Synthetic peptide
  XENP018588 vlCDR2
YASHRYT

SEQ ID NO: 7186 - protein, 9 aa, Artificial Sequence
  Description of Artificial Sequence: Synthetic peptide
  XENP018588 vlCDR3
QQDYSSPRT

SEQ ID NO: 7187 - protein, 249 aa, Artificial Sequence
  Description of Artificial Sequence: Synthetic polypeptide
  XENP018589 1G6_H1.93_L1_scFv(GKPGS)4
EVQLVESGGGLVKPGGSLRLSCAASGFTFSNYWMNWVRQAPGKGLEWVGEIRLKANNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7188 - protein, 122 aa, Artificial Sequence
  Description of Artificial Sequence: Synthetic polypeptide
  VH of XENP018589
EVQLVESGGGLVKPGGSLRLSCAASGFTFSNYWMNWVRQAPGKGLEWVGEIRLKANNYATHYAEPVKGRFTISRDDSKSTVYLQMNSLKTEDTAVYYCTRYYGNYGGYFDVWGAGTLVTVSS

SEQ ID NO: 7189 - protein, 107 aa, Artificial Sequence; identical to SEQ ID NO: 6247
  Description of Artificial Sequence: Synthetic polypeptide
  VL of XENP018589

SEQ ID NO: 7190 - protein, 5 aa, Artificial Sequence
  Description of Artificial Sequence: Synthetic peptide
  XENP018589 vhCDR1
NYWMN

SEQ ID NO: 7191 - protein, 19 aa, Artificial Sequence
  Description of Artificial Sequence: Synthetic peptide
  XENP018589 vhCDR2
EIRLKANNYATHYAEPVKG

SEQ ID NO: 7192 - protein, 11 aa, Artificial Sequence
  Description of Artificial Sequence: Synthetic peptide
  XENP018589 vhCDR3
YYGNYGGYFDV

SEQ ID NO: 7193 - protein, 11 aa, Artificial Sequence
  Description of Artificial Sequence: Synthetic peptide
  XENP018589 vlCDR1
RASQSVSNDVA

SEQ ID NO: 7194 - protein, 7 aa, Artificial Sequence
  Description of Artificial Sequence: Synthetic peptide
  XENP018589 vlCDR2
YASHRYT

SEQ ID NO: 7195 - protein, 9 aa, Artificial Sequence
  Description of Artificial Sequence: Synthetic peptide
  XENP018589 vlCDR3
QQDYSSPRT

SEQ ID NO: 7196 - protein, 249 aa, Artificial Sequence
  Description of Artificial Sequence: Synthetic polypeptide
  XENP018590 1G6_H1.94_L1_scFv(GKPGS)4
EVQLVESGGGLVKPGGSLRLSCAASGFTFSNYWMNWVRQAPGKGLEWVGEIRLKQNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7197 - protein, 122 aa, Artificial Sequence
  Description of Artificial Sequence: Synthetic polypeptide
  VH of XENP018590
EVQLVESGGGLVKPGGSLRLSCAASGFTFSNYWMNWVRQAPGKGLEWVGEIRLKQNNYATHYAEPVKGRFTISRDDSKSTVYLQMNSLKTEDTAVYYCTRYYGNYGGYFDVWGAGTLVTVSS

SEQ ID NO: 7198 - protein, 107 aa, Artificial Sequence; identical to SEQ ID NO: 6247
  Description of Artificial Sequence: Synthetic polypeptide
  VL of XENP018590

SEQ ID NO: 7199 - protein, 5 aa, Artificial Sequence
  Description of Artificial Sequence: Synthetic peptide
  XENP018590 vhCDR1
NYWMN

SEQ ID NO: 7200 - protein, 19 aa, Artificial Sequence
  Description of Artificial Sequence: Synthetic peptide
  XENP018590 vhCDR2
EIRLKQNNYATHYAEPVKG

SEQ ID NO: 7201 - protein, 11 aa, Artificial Sequence
  Description of Artificial Sequence: Synthetic peptide
  XENP018590 vhCDR3
YYGNYGGYFDV

SEQ ID NO: 7202 - protein, 11 aa, Artificial Sequence
  Description of Artificial Sequence: Synthetic peptide
  XENP018590 vlCDR1
RASQSVSNDVA

SEQ ID NO: 7203 - protein, 7 aa, Artificial Sequence
  Description of Artificial Sequence: Synthetic peptide
  XENP018590 vlCDR2
YASHRYT

SEQ ID NO: 7204 - protein, 9 aa, Artificial Sequence
  Description of Artificial Sequence: Synthetic peptide
  XENP018590 vlCDR3
QQDYSSPRT

SEQ ID NO: 7205 - protein, 249 aa, Artificial Sequence
  Description of Artificial Sequence: Synthetic polypeptide
  XENP018591 1G6_H1.95_L1_scFv(GKPGS)4
EVQLVESGGGLVKPGGSLRLSCAASGFTFSNYWMNWVRQAPGKGLEWVGEIRLKGNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7206 - protein, 122 aa, Artificial Sequence
  Description of Artificial Sequence: Synthetic polypeptide
  VH of XENP018591
EVQLVESGGGLVKPGGSLRLSCAASGFTFSNYWMNWVRQAPGKGLEWVGEIRLKGNNYATHYAEPVKGRFTISRDDSKSTVYLQMNSLKTEDTAVYYCTRYYGNYGGYFDVWGAGTLVTVSS

SEQ ID NO: 7207 - protein, 107 aa, Artificial Sequence; identical to SEQ ID NO: 6247
  Description of Artificial Sequence: Synthetic polypeptide
  VL of XENP018591

SEQ ID NO: 7208 - protein, 5 aa, Artificial Sequence
  Description of Artificial Sequence: Synthetic peptide
  XENP018591 vhCDR1
NYWMN

SEQ ID NO: 7209 - protein, 19 aa, Artificial Sequence
  Description of Artificial Sequence: Synthetic peptide
  XENP018591 vhCDR2
EIRLKGNNYATHYAEPVKG

SEQ ID NO: 7210 - protein, 11 aa, Artificial Sequence
  Description of Artificial Sequence: Synthetic peptide
  XENP018591 vhCDR3
YYGNYGGYFDV

SEQ ID NO: 7211 - protein, 11 aa, Artificial Sequence
  Description of Artificial Sequence: Synthetic peptide
  XENP018591 vlCDR1
RASQSVSNDVA

SEQ ID NO: 7212 - protein, 7 aa, Artificial Sequence
  Description of Artificial Sequence: Synthetic peptide
  XENP018591 vlCDR2
YASHRYT

SEQ ID NO: 7213 - protein, 9 aa, Artificial Sequence
  Description of Artificial Sequence: Synthetic peptide
  XENP018591 vlCDR3
QQDYSSPRT

SEQ ID NO: 7214 - protein, 249 aa, Artificial Sequence
  Description of Artificial Sequence: Synthetic polypeptide
  XENP018592 1G6_H1.96_L1_scFv(GKPGS)4
EVQLVESGGGLVKPGGSLRLSCAASGFTFSNYWMNWVRQAPGKGLEWVGEIRLKVNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7215 - protein, 122 aa, Artificial Sequence
  Description of Artificial Sequence: Synthetic polypeptide
  VH of XENP018592
EVQLVESGGGLVKPGGSLRLSCAASGFTFSNYWMNWVRQAPGKGLEWVGEIRLKVNNYATHYAEPVKGRFTISRDDSKSTVYLQMNSLKTEDTAVYYCTRYYGNYGGYFDVWGAGTLVTVSS

SEQ ID NO: 7216 - protein, 107 aa, Artificial Sequence; identical to SEQ ID NO: 6247
  Description of Artificial Sequence: Synthetic polypeptide
  VL of XENP018592

SEQ ID NO: 7217 - protein, 5 aa, Artificial Sequence
  Description of Artificial Sequence: Synthetic peptide
  XENP018592 vhCDR1
NYWMN

SEQ ID NO: 7218 - protein, 19 aa, Artificial Sequence
  Description of Artificial Sequence: Synthetic peptide
  XENP018592 vhCDR2
EIRLKVNNYATHYAEPVKG

SEQ ID NO: 7219 - protein, 11 aa, Artificial Sequence
  Description of Artificial Sequence: Synthetic peptide
  XENP018592 vhCDR3
YYGNYGGYFDV

SEQ ID NO: 7220 - protein, 11 aa, Artificial Sequence
  Description of Artificial Sequence: Synthetic peptide
  XENP018592 vlCDR1
RASQSVSNDVA

SEQ ID NO: 7221 - protein, 7 aa, Artificial Sequence
  Description of Artificial Sequence: Synthetic peptide
  XENP018592 vlCDR2
YASHRYT

SEQ ID NO: 7222 - protein, 9 aa, Artificial Sequence
  Description of Artificial Sequence: Synthetic peptide
  XENP018592 vlCDR3
QQDYSSPRT

SEQ ID NO: 7223 - protein, 249 aa, Artificial Sequence
  Description of Artificial Sequence: Synthetic polypeptide
  XENP018593 1G6_H1.97_L1_scFv(GKPGS)4
EVQLVESGGGLVKPGGSLRLSCAASGFTFSNYWMNWVRQAPGKGLEWVGEIRLKHNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7224 - protein, 122 aa, Artificial Sequence
  Description of Artificial Sequence: Synthetic polypeptide
  VH of XENP018593
EVQLVESGGGLVKPGGSLRLSCAASGFTFSNYWMNWVRQAPGKGLEWVGEIRLKHNNYATHYAEPVKGRFTISRDDSKSTVYLQMNSLKTEDTAVYYCTRYYGNYGGYFDVWGAGTLVTVSS

SEQ ID NO: 7225 - protein, 107 aa, Artificial Sequence; identical to SEQ ID NO: 6247
  Description of Artificial Sequence: Synthetic polypeptide
  VL of XENP018593

SEQ ID NO: 7226 - protein, 5 aa, Artificial Sequence
  Description of Artificial Sequence: Synthetic peptide
  XENP018593 vhCDR1
NYWMN

SEQ ID NO: 7227 - protein, 19 aa, Artificial Sequence
  Description of Artificial Sequence: Synthetic peptide
  XENP018593 vhCDR2
EIRLKHNNYATHYAEPVKG

SEQ ID NO: 7228 - protein, 11 aa, Artificial Sequence
  Description of Artificial Sequence: Synthetic peptide
  XENP018593 vhCDR3
YYGNYGGYFDV

SEQ ID NO: 7229 - protein, 11 aa, Artificial Sequence
  Description of Artificial Sequence: Synthetic peptide
  XENP018593 vlCDR1
RASQSVSNDVA

SEQ ID NO: 7230 - protein, 7 aa, Artificial Sequence
  Description of Artificial Sequence: Synthetic peptide
  XENP018593 vlCDR2
YASHRYT

SEQ ID NO: 7231 - protein, 9 aa, Artificial Sequence
  Description of Artificial Sequence: Synthetic peptide
  XENP018593 vlCDR3
QQDYSSPRT

SEQ ID NO: 7232 - protein, 249 aa, Artificial Sequence
  Description of Artificial Sequence: Synthetic polypeptide
  XENP018594 1G6_H1.98_L1_scFv(GKPGS)4
EVQLVESGGGLVKPGGSLRLSCAASGFTFSNYWMNWVRQAPGKGLEWVGEIRLKDNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7233 - protein, 122 aa, Artificial Sequence
  Description of Artificial Sequence: Synthetic polypeptide
  VH of XENP018594
EVQLVESGGGLVKPGGSLRLSCAASGFTFSNYWMNWVRQAPGKGLEWVGEIRLKDNNYATHYAEPVKGRFTISRDDSKSTVYLQMNSLKTEDTAVYYCTRYYGNYGGYFDVWGAGTLVTVSS

SEQ ID NO: 7234 - protein, 107 aa, Artificial Sequence; identical to SEQ ID NO: 6247
  Description of Artificial Sequence: Synthetic polypeptide
  VL of XENP018594

SEQ ID NO: 7235 - protein, 5 aa, Artificial Sequence
  Description of Artificial Sequence: Synthetic peptide
  XENP018594 vhCDR1
NYWMN

SEQ ID NO: 7236 - protein, 19 aa, Artificial Sequence
  Description of Artificial Sequence: Synthetic peptide
  XENP018594 vhCDR2
EIRLKDNNYATHYAEPVKG

SEQ ID NO: 7237 - protein, 11 aa, Artificial Sequence
  Description of Artificial Sequence: Synthetic peptide
  XENP018594 vhCDR3
YYGNYGGYFDV

SEQ ID NO: 7238 - protein, 11 aa, Artificial Sequence
  Description of Artificial Sequence: Synthetic peptide
  XENP018594 vlCDR1
RASQSVSNDVA

SEQ ID NO: 7239 - protein, 7 aa, Artificial Sequence
  Description of Artificial Sequence: Synthetic peptide
  XENP018594 vlCDR2
YASHRYT

SEQ ID NO: 7240 - protein, 9 aa, Artificial Sequence
  Description of Artificial Sequence: Synthetic peptide
  XENP018594 vlCDR3
QQDYSSPRT

SEQ ID NO: 7241 - protein, 249 aa, Artificial Sequence
  Description of Artificial Sequence: Synthetic polypeptide
  XENP018595 1G6_H1.99_L1_scFv(GKPGS)4
EVQLVESGGGLVKPGGSLRLSCAASGFTFSNYWMNWVRQAPGKGLEWVGEIRLKKNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7242 - protein, 122 aa, Artificial Sequence
  Description of Artificial Sequence: Synthetic polypeptide
  VH of XENP018595
EVQLVESGGGLVKPGGSLRLSCAASGFTFSNYWMNWVRQAPGKGLEWVGEIRLKKNNYATHYAEPVKGRFTISRDDSKSTVYLQMNSLKTEDTAVYYCTRYYGNYGGYFDVWGAGTLVTVSS

SEQ ID NO: 7243 - protein, 107 aa, Artificial Sequence; identical to SEQ ID NO: 6247
  Description of Artificial Sequence: Synthetic polypeptide
  VL of XENP018595

SEQ ID NO: 7244 - protein, 5 aa, Artificial Sequence
  Description of Artificial Sequence: Synthetic peptide
  XENP018595 vhCDR1
NYWMN

SEQ ID NO: 7245 - protein, 19 aa, Artificial Sequence
  Description of Artificial Sequence: Synthetic peptide
  XENP018595 vhCDR2
EIRLKKNNYATHYAEPVKG

SEQ ID NO: 7246 - protein, 11 aa, Artificial Sequence
  Description of Artificial Sequence: Synthetic peptide
  XENP018595 vhCDR3
YYGNYGGYFDV

SEQ ID NO: 7247 - protein, 11 aa, Artificial Sequence
  Description of Artificial Sequence: Synthetic peptide
  XENP018595 vlCDR1
RASQSVSNDVA

SEQ ID NO: 7248 - protein, 7 aa, Artificial Sequence
  Description of Artificial Sequence: Synthetic peptide
  XENP018595 vlCDR2
YASHRYT

SEQ ID NO: 7249 - protein, 9 aa, Artificial Sequence
  Description of Artificial Sequence: Synthetic peptide
  XENP018595 vlCDR3
QQDYSSPRT

SEQ ID NO: 7250 - protein, 249 aa, Artificial Sequence
  Description of Artificial Sequence: Synthetic polypeptide
  XENP018596 1G6_H1.100_L1_scFv(GKPGS)4
EVQLVESGGGLVKPGGSLRLSCAASGFTFSNYWMNWVRQAPGKGLEWVGEIRLKYNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7251 - protein, 122 aa, Artificial Sequence
  Description of Artificial Sequence: Synthetic polypeptide
  VH of XENP018596
EVQLVESGGGLVKPGGSLRLSCAASGFTFSNYWMNWVRQAPGKGLEWVGEIRLKYNNYATHYAEPVKGRFTISRDDSKSTVYLQMNSLKTEDTAVYYCTRYYGNYGGYFDVWGAGTLVTVSS

SEQ ID NO: 7252 - protein, 107 aa, Artificial Sequence; identical to SEQ ID NO: 6247
  Description of Artificial Sequence: Synthetic polypeptide
  VL of XENP018596

SEQ ID NO: 7253 - protein, 5 aa, Artificial Sequence
  Description of Artificial Sequence: Synthetic peptide
  XENP018596 vhCDR1
NYWMN

SEQ ID NO: 7254 - protein, 19 aa, Artificial Sequence
  Description of Artificial Sequence: Synthetic peptide
  XENP018596 vhCDR2
EIRLKYNNYATHYAEPVKG

SEQ ID NO: 7255 - protein, 11 aa, Artificial Sequence
  Description of Artificial Sequence: Synthetic peptide
  XENP018596 vhCDR3
YYGNYGGYFDV

SEQ ID NO: 7256 - protein, 11 aa, Artificial Sequence
  Description of Artificial Sequence: Synthetic peptide
  XENP018596 vlCDR1
RASQSVSNDVA

SEQ ID NO: 7257 - protein, 7 aa, Artificial Sequence
  Description of Artificial Sequence: Synthetic peptide
  XENP018596 vlCDR2
YASHRYT

SEQ ID NO: 7258 - protein, 9 aa, Artificial Sequence
  Description of Artificial Sequence: Synthetic peptide
  XENP018596 vlCDR3
QQDYSSPRT

SEQ ID NO: 7259 - protein, 249 aa, Artificial Sequence
  Description of Artificial Sequence: Synthetic polypeptide
  XENP018601 1G6_H1.101_L1_scFv(GKPGS)4
EVQLVESGGGLVKPGGSLRLSCAASGFTFSNYWMNWVRQAPGKGLEWVGEIRLKSDNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7260 - protein, 122 aa, Artificial Sequence
  Description of Artificial Sequence: Synthetic polypeptide
  VH of XENP018601
EVQLVESGGGLVKPGGSLRLSCAASGFTFSNYWMNWVRQAPGKGLEWVGEIRLKSDNYATHYAEPVKGRFTISRDDSKSTVYLQMNSLKTEDTAVYYCTRYYGNYGGYFDVWGAGTLVTVSS

SEQ ID NO: 7261 - protein, 107 aa, Artificial Sequence; identical to SEQ ID NO: 6247
  Description of Artificial Sequence: Synthetic polypeptide
  VL of XENP018601

SEQ ID NO: 7262 - protein, 5 aa, Artificial Sequence
  Description of Artificial Sequence: Synthetic peptide
  XENP018601 vhCDR1
NYWMN

SEQ ID NO: 7263 - protein, 19 aa, Artificial Sequence
  Description of Artificial Sequence: Synthetic peptide
  XENP018601 vhCDR2
EIRLKSDNYATHYAEPVKG

SEQ ID NO: 7264 - protein, 11 aa, Artificial Sequence
  Description of Artificial Sequence: Synthetic peptide
  XENP018601 vhCDR3
YYGNYGGYFDV

SEQ ID NO: 7265 - protein, 11 aa, Artificial Sequence
  Description of Artificial Sequence: Synthetic peptide
  XENP018601 vlCDR1
RASQSVSNDVA

SEQ ID NO: 7266 - protein, 7 aa, Artificial Sequence
  Description of Artificial Sequence: Synthetic peptide
  XENP018601 vlCDR2
YASHRYT

SEQ ID NO: 7267 - protein, 9 aa, Artificial Sequence
  Description of Artificial Sequence: Synthetic peptide
  XENP018601 vlCDR3
QQDYSSPRT

SEQ ID NO: 7268 - protein, 249 aa, Artificial Sequence
  Description of Artificial Sequence: Synthetic polypeptide
  XENP018602 1G6_H1.102_L1_scFv(GKPGS)4
EVQLVESGGGLVKPGGSLRLSCAASGFTFSNYWMNWVRQAPGKGLEWVGEIRLKSHNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7269 - protein, 122 aa, Artificial Sequence
  Description of Artificial Sequence: Synthetic polypeptide
  VH of XENP018602
EVQLVESGGGLVKPGGSLRLSCAASGFTFSNYWMNWVRQAPGKGLEWVGEIRLKSHNYATHYAEPVKGRFTISRDDSKSTVYLQMNSLKTEDTAVYYCTRYYGNYGGYFDVWGAGTLVTVSS

SEQ ID NO: 7270 - protein, 107 aa, Artificial Sequence; identical to SEQ ID NO: 6247
  Description of Artificial Sequence: Synthetic polypeptide
  VL of XENP018602

SEQ ID NO: 7271 - protein, 5 aa, Artificial Sequence
  Description of Artificial Sequence: Synthetic peptide
  XENP018602 vhCDR1
NYWMN

SEQ ID NO: 7272 - protein, 19 aa, Artificial Sequence
  Description of Artificial Sequence: Synthetic peptide
  XENP018602 vhCDR2
EIRLKSHNYATHYAEPVKG

SEQ ID NO: 7273 - protein, 11 aa, Artificial Sequence
  Description of Artificial Sequence: Synthetic peptide
  XENP018602 vhCDR3
YYGNYGGYFDV

SEQ ID NO: 7274 - protein, 11 aa, Artificial Sequence
  Description of Artificial Sequence: Synthetic peptide
  XENP018602 vlCDR1
RASQSVSNDVA

SEQ ID NO: 7275 - protein, 7 aa, Artificial Sequence
  Description of Artificial Sequence: Synthetic peptide
  XENP018602 vlCDR2
YASHRYT

SEQ ID NO: 7276 - protein, 9 aa, Artificial Sequence
  Description of Artificial Sequence: Synthetic peptide
  XENP018602 vlCDR3
QQDYSSPRT

SEQ ID NO: 7277 - protein, 249 aa, Artificial Sequence
  Description of Artificial Sequence: Synthetic polypeptide
  XENP018603 1G6_H1.103_L1_scFv(GKPGS)4
EVQLVESGGGLVKPGGSLRLSCAASGFTFSNYWMNWVRQAPGKGLEWVGEIRLKSENYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7278 - protein, 122 aa, Artificial Sequence
  Description of Artificial Sequence: Synthetic polypeptide
  VH of XENP018603
EVQLVESGGGLVKPGGSLRLSCAASGFTFSNYWMNWVRQAPGKGLEWVGEIRLKSENYATHYAEPVKGRFTISRDDSKSTVYLQMNSLKTEDTAVYYCTRYYGNYGGYFDVWGAGTLVTVSS

SEQ ID NO: 7279 - protein, 107 aa, Artificial Sequence; identical to SEQ ID NO: 6247
  Description of Artificial Sequence: Synthetic polypeptide
  VL of XENP018603

SEQ ID NO: 7280 - protein, 5 aa, Artificial Sequence
  Description of Artificial Sequence: Synthetic peptide
  XENP018603 vhCDR1
NYWMN

SEQ ID NO: 7281 - protein, 19 aa, Artificial Sequence
  Description of Artificial Sequence: Synthetic peptide
  XENP018603 vhCDR2
EIRLKSENYATHYAEPVKG

SEQ ID NO: 7282 - protein, 11 aa, Artificial Sequence
  Description of Artificial Sequence: Synthetic peptide
  XENP018603 vhCDR3
YYGNYGGYFDV

SEQ ID NO: 7283 - protein, 11 aa, Artificial Sequence
  Description of Artificial Sequence: Synthetic peptide
  XENP018603 vlCDR1
RASQSVSNDVA

SEQ ID NO: 7284 - protein, 7 aa, Artificial Sequence
  Description of Artificial Sequence: Synthetic peptide
  XENP018603 vlCDR2
YASHRYT

SEQ ID NO: 7285 - protein, 9 aa, Artificial Sequence
  Description of Artificial Sequence: Synthetic peptide
  XENP018603 vlCDR3
QQDYSSPRT

SEQ ID NO: 7286 - protein, 249 aa, Artificial Sequence
  Description of Artificial Sequence: Synthetic polypeptide
  XENP018604 1G6_H1.104_L1_scFv(GKPGS)4
EVQLVESGGGLVKPGGSLRLSCAASGFTFSNYWMNWVRQAPGKGLEWVGEIRLKSSNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7287 - protein, 122 aa, Artificial Sequence
  Description of Artificial Sequence: Synthetic polypeptide
  VH of XENP018604
EVQLVESGGGLVKPGGSLRLSCAASGFTFSNYWMNWVRQAPGKGLEWVGEIRLKSSNYATHYAEPVKGRFTISRDDSKSTVYLQMNSLKTEDTAVYYCTRYYGNYGGYFDVWGAGTLVTVSS

SEQ ID NO: 7288 - protein, 107 aa, Artificial Sequence; identical to SEQ ID NO: 6247
  Description of Artificial Sequence: Synthetic polypeptide
  VL of XENP018604

SEQ ID NO: 7289 - protein, 5 aa, Artificial Sequence
  Description of Artificial Sequence: Synthetic peptide
  XENP018604 vhCDR1
NYWMN

SEQ ID NO: 7290 - protein, 19 aa, Artificial Sequence
  Description of Artificial Sequence: Synthetic peptide
  XENP018604 vhCDR2
EIRLKSSNYATHYAEPVKG

SEQ ID NO: 7291 - protein, 11 aa, Artificial Sequence
  Description of Artificial Sequence: Synthetic peptide
  XENP018604 vhCDR3
YYGNYGGYFDV

SEQ ID NO: 7292 - protein, 11 aa, Artificial Sequence
  Description of Artificial Sequence: Synthetic peptide
  XENP018604 vlCDR1
RASQSVSNDVA

SEQ ID NO: 7293 - protein, 7 aa, Artificial Sequence
  Description of Artificial Sequence: Synthetic peptide
  XENP018604 vlCDR2
YASHRYT

SEQ ID NO: 7294 - protein, 9 aa, Artificial Sequence
  Description of Artificial Sequence: Synthetic peptide
  XENP018604 vlCDR3
QQDYSSPRT

SEQ ID NO: 7295 - protein, 249 aa, Artificial Sequence
  Description of Artificial Sequence: Synthetic polypeptide
  XENP018605 1G6_H1.105_L1_scFv(GKPGS)4
EVQLVESGGGLVKPGGSLRLSCAASGFTFSNYWMNWVRQAPGKGLEWVGEIRLKSRNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7296 - protein, 122 aa, Artificial Sequence
  Description of Artificial Sequence: Synthetic polypeptide
  VH of XENP018605
EVQLVESGGGLVKPGGSLRLSCAASGFTFSNYWMNWVRQAPGKGLEWVGEIRLKSRNYATHYAEPVKGRFTISRDDSKSTVYLQMNSLKTEDTAVYYCTRYYGNYGGYFDVWGAGTLVTVSS

SEQ ID NO: 7297 - protein, 107 aa, Artificial Sequence; identical to SEQ ID NO: 6247
  Description of Artificial Sequence: Synthetic polypeptide
  VL of XENP018605

SEQ ID NO: 7298 - protein, 5 aa, Artificial Sequence
  Description of Artificial Sequence: Synthetic peptide
  XENP018605 vhCDR1
NYWMN

SEQ ID NO: 7299 - protein, 19 aa, Artificial Sequence
  Description of Artificial Sequence: Synthetic peptide
  XENP018605 vhCDR2
EIRLKSRNYATHYAEPVKG

SEQ ID NO: 7300 - protein, 11 aa, Artificial Sequence
  Description of Artificial Sequence: Synthetic peptide
  XENP018605 vhCDR3
YYGNYGGYFDV

SEQ ID NO: 7301 - protein, 11 aa, Artificial Sequence
  Description of Artificial Sequence: Synthetic peptide
  XENP018605 vlCDR1
RASQSVSNDVA

SEQ ID NO: 7302 - protein, 7 aa, Artificial Sequence
  Description of Artificial Sequence: Synthetic peptide
  XENP018605 vlCDR2
YASHRYT

SEQ ID NO: 7303 - protein, 9 aa, Artificial Sequence
  Description of Artificial Sequence: Synthetic peptide
  XENP018605 vlCDR3
QQDYSSPRT

SEQ ID NO: 7304 - protein, 249 aa, Artificial Sequence
  Description of Artificial Sequence: Synthetic polypeptide
  XENP018606 1G6_H1.106_L1_scFv(GKPGS)4
EVQLVESGGGLVKPGGSLRLSCAASGFTFSNYWMNWVRQAPGKGLEWVGEIRLKSLNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7305 - protein, 122 aa, Artificial Sequence
  Description of Artificial Sequence: Synthetic polypeptide
  VH of XENP018606
EVQLVESGGGLVKPGGSLRLSCAASGFTFSNYWMNWVRQAPGKGLEWVGEIRLKSLNYATHYAEPVKGRFTISRDDSKSTVYLQMNSLKTEDTAVYYCTRYYGNYGGYFDVWGAGTLVTVSS

SEQ ID NO: 7306 - protein, 107 aa, Artificial Sequence; identical to SEQ ID NO: 6247
  Description of Artificial Sequence: Synthetic polypeptide
  VL of XENP018606

SEQ ID NO: 7307 - protein, 5 aa, Artificial Sequence
  Description of Artificial Sequence: Synthetic peptide
  XENP018606 vhCDR1
NYWMN

SEQ ID NO: 7308 - protein, 19 aa, Artificial Sequence
  Description of Artificial Sequence: Synthetic peptide
  XENP018606 vhCDR2
EIRLKSLNYATHYAEPVKG

SEQ ID NO: 7309 - protein, 11 aa, Artificial Sequence
  Description of Artificial Sequence: Synthetic peptide
  XENP018606 vhCDR3
YYGNYGGYFDV

SEQ ID NO: 7310 - protein, 11 aa, Artificial Sequence
  Description of Artificial Sequence: Synthetic peptide
  XENP018606 vlCDR1
RASQSVSNDVA

SEQ ID NO: 7311 - protein, 7 aa, Artificial Sequence
  Description of Artificial Sequence: Synthetic peptide
  XENP018606 vlCDR2
YASHRYT

SEQ ID NO: 7312 - protein, 9 aa, Artificial Sequence
  Description of Artificial Sequence: Synthetic peptide
  XENP018606 vlCDR3
QQDYSSPRT

SEQ ID NO: 7313 - protein, 249 aa, Artificial Sequence
  Description of Artificial Sequence: Synthetic polypeptide
  XENP018607 1G6_H1.107_L1_scFv(GKPGS)4
EVQLVESGGGLVKPGGSLRLSCAASGFTFSNYWMNWVRQAPGKGLEWVGEIRLKSTNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7314 - protein, 122 aa, Artificial Sequence
  Description of Artificial Sequence: Synthetic polypeptide
  VH of XENP018607
EVQLVESGGGLVKPGGSLRLSCAASGFTFSNYWMNWVRQAPGKGLEWVGEIRLKSTNYATHYAEPVKGRFTISRDDSKSTVYLQMNSLKTEDTAVYYCTRYYGNYGGYFDVWGAGTLVTVSS

SEQ ID NO: 7315 - protein, 107 aa, Artificial Sequence; identical to SEQ ID NO: 6247
  Description of Artificial Sequence: Synthetic polypeptide
  VL of XENP018607

SEQ ID NO: 7316 - protein, 5 aa, Artificial Sequence
  Description of Artificial Sequence: Synthetic peptide
  XENP018607 vhCDR1
NYWMN

SEQ ID NO: 7317 - protein, 19 aa, Artificial Sequence
  Description of Artificial Sequence: Synthetic peptide
  XENP018607 vhCDR2
EIRLKSTNYATHYAEPVKG

SEQ ID NO: 7318 - protein, 11 aa, Artificial Sequence
  Description of Artificial Sequence: Synthetic peptide
  XENP018607 vhCDR3
YYGNYGGYFDV

SEQ ID NO: 7319 - protein, 11 aa, Artificial Sequence
  Description of Artificial Sequence: Synthetic peptide
  XENP018607 vlCDR1
RASQSVSNDVA

SEQ ID NO: 7320 - protein, 7 aa, Artificial Sequence
  Description of Artificial Sequence: Synthetic peptide
  XENP018607 vlCDR2
YASHRYT

SEQ ID NO: 7321 - protein, 9 aa, Artificial Sequence
  Description of Artificial Sequence: Synthetic peptide
  XENP018607 vlCDR3
QQDYSSPRT

SEQ ID NO: 7322 - protein, 249 aa, Artificial Sequence
  Description of Artificial Sequence: Synthetic polypeptide
  XENP018608 1G6_H1.108_L1_scFv(GKPGS)4
EVQLVESGGGLVKPGGSLRLSCAASGFTFSNYWMNWVRQAPGKGLEWVGEIRLKSGNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7323 - protein, 122 aa, Artificial Sequence
  Description of Artificial Sequence: Synthetic polypeptide
  VH of XENP018608
EVQLVESGGGLVKPGGSLRLSCAASGFTFSNYWMNWVRQAPGKGLEWVGEIRLKSGNYATHYAEPVKGRFTISRDDSKSTVYLQMNSLKTEDTAVYYCTRYYGNYGGYFDVWGAGTLVTVSS

SEQ ID NO: 7324 - protein, 107 aa, Artificial Sequence; identical to SEQ ID NO: 6247
  Description of Artificial Sequence: Synthetic polypeptide
  VL of XENP018608

SEQ ID NO: 7325 - protein, 5 aa, Artificial Sequence
  Description of Artificial Sequence: Synthetic peptide
  XENP018608 vhCDR1
NYWMN

SEQ ID NO: 7326 - protein, 19 aa, Artificial Sequence
  Description of Artificial Sequence: Synthetic peptide
  XENP018608 vhCDR2
EIRLKSGNYATHYAEPVKG

SEQ ID NO: 7327 - protein, 11 aa, Artificial Sequence
  Description of Artificial Sequence: Synthetic peptide
  XENP018608 vhCDR3
YYGNYGGYFDV

SEQ ID NO: 7328 - protein, 11 aa, Artificial Sequence
  Description of Artificial Sequence: Synthetic peptide
  XENP018608 vlCDR1
RASQSVSNDVA

SEQ ID NO: 7329 - protein, 7 aa, Artificial Sequence
  Description of Artificial Sequence: Synthetic peptide
  XENP018608 vlCDR2
YASHRYT

SEQ ID NO: 7330 - protein, 9 aa, Artificial Sequence
  Description of Artificial Sequence: Synthetic peptide
  XENP018608 vlCDR3
QQDYSSPRT

SEQ ID NO: 7331 - protein, 249 aa, Artificial Sequence
  Description of Artificial Sequence: Synthetic polypeptide
  XENP018609 1G6_H1.109_L1_scFv(GKPGS)4
EVQLVESGGGLVKPGGSLRLSCAASGFTFSNYWMNWVRQAPGKGLEWVGEIRLKSYNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7332 - protein, 122 aa, Artificial Sequence
  Description of Artificial Sequence: Synthetic polypeptide
  VH of XENP018609
EVQLVESGGGLVKPGGSLRLSCAASGFTFSNYWMNWVRQAPGKGLEWVGEIRLKSYNYATHYAEPVKGRFTISRDDSKSTVYLQMNSLKTEDTAVYYCTRYYGNYGGYFDVWGAGTLVTVSS

SEQ ID NO: 7333 - protein, 107 aa, Artificial Sequence; identical to SEQ ID NO: 6247
  Description of Artificial Sequence: Synthetic polypeptide
  VL of XENP018609

SEQ ID NO: 7334 - protein, 5 aa, Artificial Sequence
  Description of Artificial Sequence: Synthetic peptide
  XENP018609 vhCDR1
NYWMN

SEQ ID NO: 7335 - protein, 19 aa, Artificial Sequence
  Description of Artificial Sequence: Synthetic peptide
  XENP018609 vhCDR2
EIRLKSYNYATHYAEPVKG

SEQ ID NO: 7336 - protein, 11 aa, Artificial Sequence
  Description of Artificial Sequence: Synthetic peptide
  XENP018609 vhCDR3
YYGNYGGYFDV

SEQ ID NO: 7337 - protein, 11 aa, Artificial Sequence
  Description of Artificial Sequence: Synthetic peptide
  XENP018609 vlCDR1
RASQSVSNDVA

SEQ ID NO: 7338 - protein, 7 aa, Artificial Sequence
  Description of Artificial Sequence: Synthetic peptide
  XENP018609 vlCDR2
YASHRYT

SEQ ID NO: 7339 - protein, 9 aa, Artificial Sequence
  Description of Artificial Sequence: Synthetic peptide
  XENP018609 vlCDR3
QQDYSSPRT

SEQ ID NO: 7340 - protein, 249 aa, Artificial Sequence
  Description of Artificial Sequence: Synthetic polypeptide
  XENP018610 1G6_H1.110_L1_scFv(GKPGS)4
EVQLVESGGGLVKPGGSLRLSCAASGFTFSNYWMNWVRQAPGKGLEWVGEIRLKSNDYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7341 - protein, 122 aa, Artificial Sequence
  Description of Artificial Sequence: Synthetic polypeptide
  VH of XENP018610
EVQLVESGGGLVKPGGSLRLSCAASGFTFSNYWMNWVRQAPGKGLEWVGEIRLKSNDYATHYAEPVKGRFTISRDDSKSTVYLQMNSLKTEDTAVYYCTRYYGNYGGYFDVWGAGTLVTVSS

SEQ ID NO: 7342 - protein, 107 aa, Artificial Sequence; identical to SEQ ID NO: 6247
  Description of Artificial Sequence: Synthetic polypeptide
  VL of XENP018610

SEQ ID NO: 7343 - protein, 5 aa, Artificial Sequence
  Description of Artificial Sequence: Synthetic peptide
  XENP018610 vhCDR1
NYWMN

SEQ ID NO: 7344 - protein, 19 aa, Artificial Sequence
  Description of Artificial Sequence: Synthetic peptide
  XENP018610 vhCDR2
EIRLKSNDYATHYAEPVKG

SEQ ID NO: 7345 - protein, 11 aa, Artificial Sequence
  Description of Artificial Sequence: Synthetic peptide
  XENP018610 vhCDR3
YYGNYGGYFDV

SEQ ID NO: 7346 - protein, 11 aa, Artificial Sequence
  Description of Artificial Sequence: Synthetic peptide
  XENP018610 vlCDR1
RASQSVSNDVA

SEQ ID NO: 7347 - protein, 7 aa, Artificial Sequence
  Description of Artificial Sequence: Synthetic peptide
  XENP018610 vlCDR2
YASHRYT

SEQ ID NO: 7348 - protein, 9 aa, Artificial Sequence
  Description of Artificial Sequence: Synthetic peptide
  XENP018610 vlCDR3
QQDYSSPRT

SEQ ID NO: 7349 - protein, 249 aa, Artificial Sequence
  Description of Artificial Sequence: Synthetic polypeptide
  XENP018611 1G6_H1.111_L1_scFv(GKPGS)4
EVQLVESGGGLVKPGGSLRLSCAASGFTFSNYWMNWVRQAPGKGLEWVGEIRLKSNHYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7350 - protein, 122 aa, Artificial Sequence
  Description of Artificial Sequence: Synthetic polypeptide
  VH of XENP018611
EVQLVESGGGLVKPGGSLRLSCAASGFTFSNYWMNWVRQAPGKGLEWVGEIRLKSNHYATHYAEPVKGRFTISRDDSKSTVYLQMNSLKTEDTAVYYCTRYYGNYGGYFDVWGAGTLVTVSS

SEQ ID NO: 7351 - protein, 107 aa, Artificial Sequence; identical to SEQ ID NO: 6247
  Description of Artificial Sequence: Synthetic polypeptide
  VL of XENP018611

SEQ ID NO: 7352 - protein, 5 aa, Artificial Sequence
  Description of Artificial Sequence: Synthetic peptide
  XENP018611 vhCDR1
NYWMN

SEQ ID NO: 7353 - protein, 19 aa, Artificial Sequence
  Description of Artificial Sequence: Synthetic peptide
  XENP018611 vhCDR2
EIRLKSNHYATHYAEPVKG

SEQ ID NO: 7354 - protein, 11 aa, Artificial Sequence
  Description of Artificial Sequence: Synthetic peptide
  XENP018611 vhCDR3
YYGNYGGYFDV

SEQ ID NO: 7355 - protein, 11 aa, Artificial Sequence
  Description of Artificial Sequence: Synthetic peptide
  XENP018611 vlCDR1
RASQSVSNDVA

SEQ ID NO: 7356 - protein, 7 aa, Artificial Sequence
  Description of Artificial Sequence: Synthetic peptide
  XENP018611 vlCDR2
YASHRYT

SEQ ID NO: 7357 - protein, 9 aa, Artificial Sequence
  Description of Artificial Sequence: Synthetic peptide
  XENP018611 vlCDR3
QQDYSSPRT

SEQ ID NO: 7358 - protein, 249 aa, Artificial Sequence
  Description of Artificial Sequence: Synthetic polypeptide
  XENP018612 1G6_H1.112_L1_scFv(GKPGS)4
EVQLVESGGGLVKPGGSLRLSCAASGFTFSNYWMNWVRQAPGKGLEWVGEIRLKSNEYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7359 - protein, 122 aa, Artificial Sequence
  Description of Artificial Sequence: Synthetic polypeptide
  VH of XENP018612
EVQLVESGGGLVKPGGSLRLSCAASGFTFSNYWMNWVRQAPGKGLEWVGEIRLKSNEYATHYAEPVKGRFTISRDDSKSTVYLQMNSLKTEDTAVYYCTRYYGNYGGYFDVWGAGTLVTVSS

SEQ ID NO: 7360 - protein, 107 aa, Artificial Sequence; identical to SEQ ID NO: 6247
  Description of Artificial Sequence: Synthetic polypeptide
  VL of XENP018612

SEQ ID NO: 7361 - protein, 5 aa, Artificial Sequence
  Description of Artificial Sequence: Synthetic peptide
  XENP018612 vhCDR1
NYWMN

SEQ ID NO: 7362 - protein, 19 aa, Artificial Sequence
  Description of Artificial Sequence: Synthetic peptide
  XENP018612 vhCDR2
EIRLKSNEYATHYAEPVKG

SEQ ID NO: 7363 - protein, 11 aa, Artificial Sequence
  Description of Artificial Sequence: Synthetic peptide
  XENP018612 vhCDR3
YYGNYGGYFDV

SEQ ID NO: 7364 - protein, 11 aa, Artificial Sequence
  Description of Artificial Sequence: Synthetic peptide
  XENP018612 vlCDR1
RASQSVSNDVA

SEQ ID NO: 7365 - protein, 7 aa, Artificial Sequence
  Description of Artificial Sequence: Synthetic peptide
  XENP018612 vlCDR2
YASHRYT

SEQ ID NO: 7366 - protein, 9 aa, Artificial Sequence
  Description of Artificial Sequence: Synthetic peptide
  XENP018612 vlCDR3
QQDYSSPRT

SEQ ID NO: 7367 - protein, 249 aa, Artificial Sequence
  Description of Artificial Sequence: Synthetic polypeptide
  XENP018613 1G6_H1.113_L1_scFv(GKPGS)4
EVQLVESGGGLVKPGGSLRLSCAASGFTFSNYWMNWVRQAPGKGLEWVGEIRLKSNSYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7368 - protein, 122 aa, Artificial Sequence
  Description of Artificial Sequence: Synthetic polypeptide
  VH of XENP018613
EVQLVESGGGLVKPGGSLRLSCAASGFTFSNYWMNWVRQAPGKGLEWVGEIRLKSNSYATHYAEPVKGRFTISRDDSKSTVYLQMNSLKTEDTAVYYCTRYYGNYGGYFDVWGAGTLVTVSS

SEQ ID NO: 7369 - protein, 107 aa, Artificial Sequence; identical to SEQ ID NO: 6247
  Description of Artificial Sequence: Synthetic polypeptide
  VL of XENP018613

SEQ ID NO: 7370 - protein, 5 aa, Artificial Sequence
  Description of Artificial Sequence: Synthetic peptide
  XENP018613 vhCDR1
NYWMN

SEQ ID NO: 7371 - protein, 19 aa, Artificial Sequence
  Description of Artificial Sequence: Synthetic peptide
  XENP018613 vhCDR2
EIRLKSNSYATHYAEPVKG

SEQ ID NO: 7372 - protein, 11 aa, Artificial Sequence
  Description of Artificial Sequence: Synthetic peptide
  XENP018613 vhCDR3
YYGNYGGYFDV

SEQ ID NO: 7373 - protein, 11 aa, Artificial Sequence
  Description of Artificial Sequence: Synthetic peptide
  XENP018613 vlCDR1
RASQSVSNDVA

SEQ ID NO: 7374 - protein, 7 aa, Artificial Sequence
  Description of Artificial Sequence: Synthetic peptide
  XENP018613 vlCDR2
YASHRYT

SEQ ID NO: 7375 - protein, 9 aa, Artificial Sequence
  Description of Artificial Sequence: Synthetic peptide
  XENP018613 vlCDR3
QQDYSSPRT

SEQ ID NO: 7376 - protein, 249 aa, Artificial Sequence
  Description of Artificial Sequence: Synthetic polypeptide
  XENP018614 1G6_H1.114_L1_scFv(GKPGS)4
EVQLVESGGGLVKPGGSLRLSCAASGFTFSNYWMNWVRQAPGKGLEWVGEIRLKSNRYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7377 - protein, 122 aa, Artificial Sequence
  Description of Artificial Sequence: Synthetic polypeptide
  VH of XENP018614
EVQLVESGGGLVKPGGSLRLSCAASGFTFSNYWMNWVRQAPGKGLEWVGEIRLKSNRYATHYAEPVKGRFTISRDDSKSTVYLQMNSLKTEDTAVYYCTRYYGNYGGYFDVWGAGTLVTVSS

SEQ ID NO: 7378 - protein, 107 aa, Artificial Sequence; identical to SEQ ID NO: 6247
  Description of Artificial Sequence: Synthetic polypeptide
  VL of XENP018614

SEQ ID NO: 7379 - protein, 5 aa, Artificial Sequence
  Description of Artificial Sequence: Synthetic peptide
  XENP018614 vhCDR1
NYWMN

SEQ ID NO: 7380 - protein, 19 aa, Artificial Sequence
  Description of Artificial Sequence: Synthetic peptide
  XENP018614 vhCDR2
EIRLKSNRYATHYAEPVKG

SEQ ID NO: 7381 - protein, 11 aa, Artificial Sequence
  Description of Artificial Sequence: Synthetic peptide
  XENP018614 vhCDR3
YYGNYGGYFDV

SEQ ID NO: 7382 - protein, 11 aa, Artificial Sequence
  Description of Artificial Sequence: Synthetic peptide
  XENP018614 vlCDR1
RASQSVSNDVA

SEQ ID NO: 7383 - protein, 7 aa, Artificial Sequence
  Description of Artificial Sequence: Synthetic peptide
  XENP018614 vlCDR2
YASHRYT

SEQ ID NO: 7384 - protein, 9 aa, Artificial Sequence
  Description of Artificial Sequence: Synthetic peptide
  XENP018614 vlCDR3
QQDYSSPRT

SEQ ID NO: 7385 - protein, 249 aa, Artificial Sequence
  Description of Artificial Sequence: Synthetic polypeptide
  XENP018615 1G6_H1.115_L1_scFv(GKPGS)4
EVQLVESGGGLVKPGGSLRLSCAASGFTFSNYWMNWVRQAPGKGLEWVGEIRLKSNLYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7386 - protein, 122 aa, Artificial Sequence
  Description of Artificial Sequence: Synthetic polypeptide
  VH of XENP018615
EVQLVESGGGLVKPGGSLRLSCAASGFTFSNYWMNWVRQAPGKGLEWVGEIRLKSNLYATHYAEPVKGRFTISRDDSKSTVYLQMNSLKTEDTAVYYCTRYYGNYGGYFDVWGAGTLVTVSS

SEQ ID NO: 7387 - protein, 107 aa, Artificial Sequence; identical to SEQ ID NO: 6247
  Description of Artificial Sequence: Synthetic polypeptide
  VL of XENP018615

SEQ ID NO: 7388 - protein, 5 aa, Artificial Sequence
  Description of Artificial Sequence: Synthetic peptide
  XENP018615 vhCDR1
NYWMN

SEQ ID NO: 7389 - protein, 19 aa, Artificial Sequence
  Description of Artificial Sequence: Synthetic peptide
  XENP018615 vhCDR2
EIRLKSNLYATHYAEPVKG

SEQ ID NO: 7390 - protein, 11 aa, Artificial Sequence
  Description of Artificial Sequence: Synthetic peptide
  XENP018615 vhCDR3
YYGNYGGYFDV

SEQ ID NO: 7391 - protein, 11 aa, Artificial Sequence
  Description of Artificial Sequence: Synthetic peptide
  XENP018615 vlCDR1
RASQSVSNDVA

SEQ ID NO: 7392 - protein, 7 aa, Artificial Sequence
  Description of Artificial Sequence: Synthetic peptide
  XENP018615 vlCDR2
YASHRYT

SEQ ID NO: 7393 - protein, 9 aa, Artificial Sequence
  Description of Artificial Sequence: Synthetic peptide
  XENP018615 vlCDR3
QQDYSSPRT

SEQ ID NO: 7394 - protein, 249 aa, Artificial Sequence
  Description of Artificial Sequence: Synthetic polypeptide
  XENP018616 1G6_H1.116_L1_scFv(GKPGS)4
EVQLVESGGGLVKPGGSLRLSCAASGFTFSNYWMNWVRQAPGKGLEWVGEIRLKSNTYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7395 - protein, 122 aa, Artificial Sequence
  Description of Artificial Sequence: Synthetic polypeptide
  VH of XENP018616
EVQLVESGGGLVKPGGSLRLSCAASGFTFSNYWMNWVRQAPGKGLEWVGEIRLKSNTYATHYAEPVKGRFTISRDDSKSTVYLQMNSLKTEDTAVYYCTRYYGNYGGYFDVWGAGTLVTVSS

SEQ ID NO: 7396 - protein, 107 aa, Artificial Sequence; identical to SEQ ID NO: 6247
  Description of Artificial Sequence: Synthetic polypeptide
  VL of XENP018616

SEQ ID NO: 7397 - protein, 5 aa, Artificial Sequence
  Description of Artificial Sequence: Synthetic peptide
  XENP018616 vhCDR1
NYWMN

SEQ ID NO: 7398 - protein, 19 aa, Artificial Sequence
  Description of Artificial Sequence: Synthetic peptide
  XENP018616 vhCDR2
EIRLKSNTYATHYAEPVKG

SEQ ID NO: 7399 - protein, 11 aa, Artificial Sequence
  Description of Artificial Sequence: Synthetic peptide
  XENP018616 vhCDR3
YYGNYGGYFDV

SEQ ID NO: 7400 - protein, 11 aa, Artificial Sequence
  Description of Artificial Sequence: Synthetic peptide
  XENP018616 vlCDR1
RASQSVSNDVA

SEQ ID NO: 7401 - protein, 7 aa, Artificial Sequence
  Description of Artificial Sequence: Synthetic peptide
  XENP018616 vlCDR2
YASHRYT

SEQ ID NO: 7402 - protein, 9 aa, Artificial Sequence
  Description of Artificial Sequence: Synthetic peptide
  XENP018616 vlCDR3
QQDYSSPRT

SEQ ID NO: 7403 - protein, 249 aa, Artificial Sequence
  Description of Artificial Sequence: Synthetic polypeptide
  XENP018617 1G6_H1.117_L1_scFv(GKPGS)4
EVQLVESGGGLVKPGGSLRLSCAASGFTFSNYWMNWVRQAPGKGLEWVGEIRLKSNGYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7404 - protein, 122 aa, Artificial Sequence
  Description of Artificial Sequence: Synthetic polypeptide
  VH of XENP018617
EVQLVESGGGLVKPGGSLRLSCAASGFTFSNYWMNWVRQAPGKGLEWVGEIRLKSNGYATHYAEPVKGRFTISRDDSKSTVYLQMNSLKTEDTAVYYCTRYYGNYGGYFDVWGAGTLVTVSS

SEQ ID NO: 7405 - protein, 107 aa, Artificial Sequence; identical to SEQ ID NO: 6247
  Description of Artificial Sequence: Synthetic polypeptide
  VL of XENP018617

SEQ ID NO: 7406 - protein, 5 aa, Artificial Sequence
  Description of Artificial Sequence: Synthetic peptide
  XENP018617 vhCDR1
NYWMN

SEQ ID NO: 7407 - protein, 19 aa, Artificial Sequence
  Description of Artificial Sequence: Synthetic peptide
  XENP018617 vhCDR2
EIRLKSNGYATHYAEPVKG

SEQ ID NO: 7408 - protein, 11 aa, Artificial Sequence
  Description of Artificial Sequence: Synthetic peptide
  XENP018617 vhCDR3
YYGNYGGYFDV

SEQ ID NO: 7409 - protein, 11 aa, Artificial Sequence
  Description of Artificial Sequence: Synthetic peptide
  XENP018617 vlCDR1
RASQSVSNDVA

SEQ ID NO: 7410 - protein, 7 aa, Artificial Sequence
  Description of Artificial Sequence: Synthetic peptide
  XENP018617 vlCDR2
YASHRYT

SEQ ID NO: 7411 - protein, 9 aa, Artificial Sequence
  Description of Artificial Sequence: Synthetic peptide
  XENP018617 vlCDR3
QQDYSSPRT

SEQ ID NO: 7412 - protein, 249 aa, Artificial Sequence
  Description of Artificial Sequence: Synthetic polypeptide
  XENP018618 1G6_H1.118_L1_scFv(GKPGS)4
EVQLVESGGGLVKPGGSLRLSCAASGFTFSNYWMNWVRQAPGKGLEWVGEIRLKSNYYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7413 - protein, 122 aa, Artificial Sequence
  Description of Artificial Sequence: Synthetic polypeptide
  VH of XENP018618
EVQLVESGGGLVKPGGSLRLSCAASGFTFSNYWMNWVRQAPGKGLEWVGEIRLKSNYYATHYAEPVKGRFTISRDDSKSTVYLQMNSLKTEDTAVYYCTRYYGNYGGYFDVWGAGTLVTVSS

SEQ ID NO: 7414 - protein, 107 aa, Artificial Sequence; identical to SEQ ID NO: 6247
  Description of Artificial Sequence: Synthetic polypeptide
  VL of XENP018618

SEQ ID NO: 7415 - protein, 5 aa, Artificial Sequence
  Description of Artificial Sequence: Synthetic peptide
  XENP018618 vhCDR1
NYWMN

SEQ ID NO: 7416 - protein, 19 aa, Artificial Sequence
  Description of Artificial Sequence: Synthetic peptide
  XENP018618 vhCDR2
EIRLKSNYYATHYAEPVKG

SEQ ID NO: 7417 - protein, 11 aa, Artificial Sequence
  Description of Artificial Sequence: Synthetic peptide
  XENP018618 vhCDR3
YYGNYGGYFDV

SEQ ID NO: 7418 - protein, 11 aa, Artificial Sequence
  Description of Artificial Sequence: Synthetic peptide
  XENP018618 vlCDR1
RASQSVSNDVA

SEQ ID NO: 7419 - protein, 7 aa, Artificial Sequence
  Description of Artificial Sequence: Synthetic peptide
  XENP018618 vlCDR2
YASHRYT

SEQ ID NO: 7420 - protein, 9 aa, Artificial Sequence
  Description of Artificial Sequence: Synthetic peptide
  XENP018618 vlCDR3
QQDYSSPRT

SEQ ID NO: 7421 - protein, 249 aa, Artificial Sequence
  Description of Artificial Sequence: Synthetic polypeptide
  XENP018619 1G6_H1.119_L1_scFv(GKPGS)4
EVQLVESGGGLVKPGGSLRLSCAASGFTFSNYWMNWVRQAPGKGLEWVGEIRLKSNNFATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7422 - protein, 122 aa, Artificial Sequence
  Description of Artificial Sequence: Synthetic polypeptide
  VH of XENP018619
EVQLVESGGGLVKPGGSLRLSCAASGFTFSNYWMNWVRQAPGKGLEWVGEIRLKSNNFATHYAEPVKGRFTISRDDSKSTVYLQMNSLKTEDTAVYYCTRYYGNYGGYFDVWGAGTLVTVSS

SEQ ID NO: 7423 - protein, 107 aa, Artificial Sequence; identical to SEQ ID NO: 6247
  Description of Artificial Sequence: Synthetic polypeptide
  VL of XENP018619

SEQ ID NO: 7424 - protein, 5 aa, Artificial Sequence
  Description of Artificial Sequence: Synthetic peptide
  XENP018619 vhCDR1
NYWMN

SEQ ID NO: 7425 - protein, 19 aa, Artificial Sequence
  Description of Artificial Sequence: Synthetic peptide
  XENP018619 vhCDR2
EIRLKSNNFATHYAEPVKG

SEQ ID NO: 7426 - protein, 11 aa, Artificial Sequence
  Description of Artificial Sequence: Synthetic peptide
  XENP018619 vhCDR3
YYGNYGGYFDV

SEQ ID NO: 7427 - protein, 11 aa, Artificial Sequence
  Description of Artificial Sequence: Synthetic peptide
  XENP018619 vlCDR1
RASQSVSNDVA

SEQ ID NO: 7428 - protein, 7 aa, Artificial Sequence
  Description of Artificial Sequence: Synthetic peptide
  XENP018619 vlCDR2
YASHRYT

SEQ ID NO: 7429 - protein, 9 aa, Artificial Sequence
  Description of Artificial Sequence: Synthetic peptide
  XENP018619 vlCDR3
QQDYSSPRT

SEQ ID NO: 7430 - protein, 249 aa, Artificial Sequence
  Description of Artificial Sequence: Synthetic polypeptide
  XENP018620 1G6_H1.120_L1_scFv(GKPGS)4
EVQLVESGGGLVKPGGSLRLSCAASGFTFSNYWMNWVRQAPGKGLEWVGEIRLKSNNHATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7431 - protein, 122 aa, Artificial Sequence
  Description of Artificial Sequence: Synthetic polypeptide
  VH of XENP018620
EVQLVESGGGLVKPGGSLRLSCAASGFTFSNYWMNWVRQAPGKGLEWVGEIRLKSNNHATHYAEPVKGRFTISRDDSKSTVYLQMNSLKTEDTAVYYCTRYYGNYGGYFDVWGAGTLVTVSS

SEQ ID NO: 7432 - protein, 107 aa, Artificial Sequence; identical to SEQ ID NO: 6247
  Description of Artificial Sequence: Synthetic polypeptide
  VL of XENP018620

SEQ ID NO: 7433 - protein, 5 aa, Artificial Sequence
  Description of Artificial Sequence: Synthetic peptide
  XENP018620 vhCDR1
NYWMN

SEQ ID NO: 7434 - protein, 19 aa, Artificial Sequence
  Description of Artificial Sequence: Synthetic peptide
  XENP018620 vhCDR2
EIRLKSNNHATHYAEPVKG

SEQ ID NO: 7435 - protein, 11 aa, Artificial Sequence
  Description of Artificial Sequence: Synthetic peptide
  XENP018620 vhCDR3
YYGNYGGYFDV

SEQ ID NO: 7436 - protein, 11 aa, Artificial Sequence
  Description of Artificial Sequence: Synthetic peptide
  XENP018620 vlCDR1
RASQSVSNDVA

SEQ ID NO: 7437 - protein, 7 aa, Artificial Sequence
  Description of Artificial Sequence: Synthetic peptide
  XENP018620 vlCDR2
YASHRYT

SEQ ID NO: 7438 - protein, 9 aa, Artificial Sequence
  Description of Artificial Sequence: Synthetic peptide
  XENP018620 vlCDR3
QQDYSSPRT

SEQ ID NO: 7439 - protein, 249 aa, Artificial Sequence
  Description of Artificial Sequence: Synthetic polypeptide
  XENP018621 1G6_H1.121_L1_scFv(GKPGS)4
EVQLVESGGGLVKPGGSLRLSCAASGFTFSNYWMNWVRQAPGKGLEWVGEIRLKSNNLATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7440 - protein, 122 aa, Artificial Sequence
  Description of Artificial Sequence: Synthetic polypeptide
  VH of XENP018621
EVQLVESGGGLVKPGGSLRLSCAASGFTFSNYWMNWVRQAPGKGLEWVGEIRLKSNNLATHYAEPVKGRFTISRDDSKSTVYLQMNSLKTEDTAVYYCTRYYGNYGGYFDVWGAGTLVTVSS

SEQ ID NO: 7441 - protein, 107 aa, Artificial Sequence; identical to SEQ ID NO: 6247
  Description of Artificial Sequence: Synthetic polypeptide
  VL of XENP018621

SEQ ID NO: 7442 - protein, 5 aa, Artificial Sequence
  Description of Artificial Sequence: Synthetic peptide
  XENP018621 vhCDR1
NYWMN

SEQ ID NO: 7443 - protein, 19 aa, Artificial Sequence
  Description of Artificial Sequence: Synthetic peptide
  XENP018621 vhCDR2
EIRLKSNNLATHYAEPVKG

SEQ ID NO: 7444 - protein, 11 aa, Artificial Sequence
  Description of Artificial Sequence: Synthetic peptide
  XENP018621 vhCDR3
YYGNYGGYFDV

SEQ ID NO: 7445 - protein, 11 aa, Artificial Sequence
  Description of Artificial Sequence: Synthetic peptide
  XENP018621 vlCDR1
RASQSVSNDVA

SEQ ID NO: 7446 - protein, 7 aa, Artificial Sequence
  Description of Artificial Sequence: Synthetic peptide
  XENP018621 vlCDR2
YASHRYT

SEQ ID NO: 7447 - protein, 9 aa, Artificial Sequence
  Description of Artificial Sequence: Synthetic peptide
  XENP018621 vlCDR3
QQDYSSPRT

SEQ ID NO: 7448 - protein, 249 aa, Artificial Sequence
  Description of Artificial Sequence: Synthetic polypeptide
  XENP018622 1G6_H1.122_L1_scFv(GKPGS)4
EVQLVESGGGLVKPGGSLRLSCAASGFTFSNYWMNWVRQAPGKGLEWVGEIRLKSNNWATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7449 - protein, 122 aa, Artificial Sequence
  Description of Artificial Sequence: Synthetic polypeptide
  VH of XENP018622
EVQLVESGGGLVKPGGSLRLSCAASGFTFSNYWMNWVRQAPGKGLEWVGEIRLKSNNWATHYAEPVKGRFTISRDDSKSTVYLQMNSLKTEDTAVYYCTRYYGNYGGYFDVWGAGTLVTVSS

SEQ ID NO: 7450 - protein, 107 aa, Artificial Sequence; identical to SEQ ID NO: 6247
  Description of Artificial Sequence: Synthetic polypeptide
  VL of XENP018622

SEQ ID NO: 7451 - protein, 5 aa, Artificial Sequence
  Description of Artificial Sequence: Synthetic peptide
  XENP018622 vhCDR1
NYWMN

SEQ ID NO: 7452 - protein, 19 aa, Artificial Sequence
  Description of Artificial Sequence: Synthetic peptide
  XENP018622 vhCDR2
EIRLKSNNWATHYAEPVKG

SEQ ID NO: 7453 - protein, 11 aa, Artificial Sequence
  Description of Artificial Sequence: Synthetic peptide
  XENP018622 vhCDR3
YYGNYGGYFDV

SEQ ID NO: 7454 - protein, 11 aa, Artificial Sequence
  Description of Artificial Sequence: Synthetic peptide
  XENP018622 vlCDR1
RASQSVSNDVA

SEQ ID NO: 7455 - protein, 7 aa, Artificial Sequence
  Description of Artificial Sequence: Synthetic peptide
  XENP018622 vlCDR2
YASHRYT

SEQ ID NO: 7456 - protein, 9 aa, Artificial Sequence
  Description of Artificial Sequence: Synthetic peptide
  XENP018622 vlCDR3
QQDYSSPRT

SEQ ID NO: 7457 - protein, 249 aa, Artificial Sequence
  Description of Artificial Sequence: Synthetic polypeptide
  XENP018623 1G6_H1.123_L1_scFv(GKPGS)4
EVQLVESGGGLVKPGGSLRLSCAASGFTFSNYWMNWVRQAPGKGLEWVGEIRLKSNNVATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7458 - protein, 122 aa, Artificial Sequence
  Description of Artificial Sequence: Synthetic polypeptide
  VH of XENP018623
EVQLVESGGGLVKPGGSLRLSCAASGFTFSNYWMNWVRQAPGKGLEWVGEIRLKSNNVATHYAEPVKGRFTISRDDSKSTVYLQMNSLKTEDTAVYYCTRYYGNYGGYFDVWGAGTLVTVSS

SEQ ID NO: 7459 - protein, 107 aa, Artificial Sequence; identical to SEQ ID NO: 6247
  Description of Artificial Sequence: Synthetic polypeptide
  VL of XENP018623

SEQ ID NO: 7460 - protein, 5 aa, Artificial Sequence
  Description of Artificial Sequence: Synthetic peptide
  XENP018623 vhCDR1
NYWMN

SEQ ID NO: 7461 - protein, 19 aa, Artificial Sequence
  Description of Artificial Sequence: Synthetic peptide
  XENP018623 vhCDR2
EIRLKSNNVATHYAEPVKG

SEQ ID NO: 7462 - protein, 11 aa, Artificial Sequence
  Description of Artificial Sequence: Synthetic peptide
  XENP018623 vhCDR3
YYGNYGGYFDV

SEQ ID NO: 7463 - protein, 11 aa, Artificial Sequence
  Description of Artificial Sequence: Synthetic peptide
  XENP018623 vlCDR1
RASQSVSNDVA

SEQ ID NO: 7464 - protein, 7 aa, Artificial Sequence
  Description of Artificial Sequence: Synthetic peptide
  XENP018623 vlCDR2
YASHRYT

SEQ ID NO: 7465 - protein, 9 aa, Artificial Sequence
  Description of Artificial Sequence: Synthetic peptide
  XENP018623 vlCDR3
QQDYSSPRT

SEQ ID NO: 7466 - protein, 249 aa, Artificial Sequence
  Description of Artificial Sequence: Synthetic polypeptide
  XENP018624 1G6_H1.124_L1_scFv(GKPGS)4
EVQLVESGGGLVKPGGSLRLSCAASGFTFSNYWMNWVRQAPGKGLEWVGEIRLKSNNAATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7467 - protein, 122 aa, Artificial Sequence
  Description of Artificial Sequence: Synthetic polypeptide
  VH of XENP018624
EVQLVESGGGLVKPGGSLRLSCAASGFTFSNYWMNWVRQAPGKGLEWVGEIRLKSNNAATHYAEPVKGRFTISRDDSKSTVYLQMNSLKTEDTAVYYCTRYYGNYGGYFDVWGAGTLVTVSS

SEQ ID NO: 7468 - protein, 107 aa, Artificial Sequence; identical to SEQ ID NO: 6247
  Description of Artificial Sequence: Synthetic polypeptide
  VL of XENP018624

SEQ ID NO: 7469 - protein, 5 aa, Artificial Sequence
  Description of Artificial Sequence: Synthetic peptide
  XENP018624 vhCDR1
NYWMN

SEQ ID NO: 7470 - protein, 19 aa, Artificial Sequence
  Description of Artificial Sequence: Synthetic peptide
  XENP018624 vhCDR2
EIRLKSNNAATHYAEPVKG

SEQ ID NO: 7471 - protein, 11 aa, Artificial Sequence
  Description of Artificial Sequence: Synthetic peptide
  XENP018624 vhCDR3
YYGNYGGYFDV

SEQ ID NO: 7472 - protein, 11 aa, Artificial Sequence
  Description of Artificial Sequence: Synthetic peptide
  XENP018624 vlCDR1
RASQSVSNDVA

SEQ ID NO: 7473 - protein, 7 aa, Artificial Sequence
  Description of Artificial Sequence: Synthetic peptide
  XENP018624 vlCDR2
YASHRYT

SEQ ID NO: 7474 - protein, 9 aa, Artificial Sequence
  Description of Artificial Sequence: Synthetic peptide
  XENP018624 vlCDR3
QQDYSSPRT

SEQ ID NO: 7475 - protein, 249 aa, Artificial Sequence
  Description of Artificial Sequence: Synthetic polypeptide
  XENP018625 1G6_H1.125_L1_scFv(GKPGS)4
EVQLVESGGGLVKPGGSLRLSCAASGFTFSNYWMNWVRQAPGKGLEWVGEIRLKSNNQATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7476 - protein, 122 aa, Artificial Sequence
  Description of Artificial Sequence: Synthetic polypeptide
  VH of XENP018625
EVQLVESGGGLVKPGGSLRLSCAASGFTFSNYWMNWVRQAPGKGLEWVGEIRLKSNNQATHYAEPVKGRFTISRDDSKSTVYLQMNSLKTEDTAVYYCTRYYGNYGGYFDVWGAGTLVTVSS

SEQ ID NO: 7477 - protein, 107 aa, Artificial Sequence; identical to SEQ ID NO: 6247
  Description of Artificial Sequence: Synthetic polypeptide
  VL of XENP018625

SEQ ID NO: 7478 - protein, 5 aa, Artificial Sequence
  Description of Artificial Sequence: Synthetic peptide
  XENP018625 vhCDR1
NYWMN

SEQ ID NO: 7479 - protein, 19 aa, Artificial Sequence
  Description of Artificial Sequence: Synthetic peptide
  XENP018625 vhCDR2
EIRLKSNNQATHYAEPVKG

SEQ ID NO: 7480 - protein, 11 aa, Artificial Sequence
  Description of Artificial Sequence: Synthetic peptide
  XENP018625 vhCDR3
YYGNYGGYFDV

SEQ ID NO: 7481 - protein, 11 aa, Artificial Sequence
  Description of Artificial Sequence: Synthetic peptide
  XENP018625 vlCDR1
RASQSVSNDVA

SEQ ID NO: 7482 - protein, 7 aa, Artificial Sequence
  Description of Artificial Sequence: Synthetic peptide
  XENP018625 vlCDR2
YASHRYT

SEQ ID NO: 7483 - protein, 9 aa, Artificial Sequence
  Description of Artificial Sequence: Synthetic peptide
  XENP018625 vlCDR3
QQDYSSPRT

SEQ ID NO: 7484 - protein, 249 aa, Artificial Sequence
  Description of Artificial Sequence: Synthetic polypeptide
  XENP018626 1G6_H1.126_L1_scFv(GKPGS)4
EVQLVESGGGLVKPGGSLRLSCAASGFTFSNYWMNWVRQAPGKGLEWVGEIRLKSNNDATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7485 - protein, 122 aa, Artificial Sequence
  Description of Artificial Sequence: Synthetic polypeptide
  VH of XENP018626
EVQLVESGGGLVKPGGSLRLSCAASGFTFSNYWMNWVRQAPGKGLEWVGEIRLKSNNDATHYAEPVKGRFTISRDDSKSTVYLQMNSLKTEDTAVYYCTRYYGNYGGYFDVWGAGTLVTVSS

SEQ ID NO: 7486 - protein, 107 aa, Artificial Sequence; identical to SEQ ID NO: 6247
  Description of Artificial Sequence: Synthetic polypeptide
  VL of XENP018626

SEQ ID NO: 7487 - protein, 5 aa, Artificial Sequence
  Description of Artificial Sequence: Synthetic peptide
  XENP018626 vhCDR1
NYWMN

SEQ ID NO: 7488 - protein, 19 aa, Artificial Sequence
  Description of Artificial Sequence: Synthetic peptide
  XENP018626 vhCDR2
EIRLKSNNDATHYAEPVKG

SEQ ID NO: 7489 - protein, 11 aa, Artificial Sequence
  Description of Artificial Sequence: Synthetic peptide
  XENP018626 vhCDR3
YYGNYGGYFDV

SEQ ID NO: 7490 - protein, 11 aa, Artificial Sequence
  Description of Artificial Sequence: Synthetic peptide
  XENP018626 vlCDR1
RASQSVSNDVA

SEQ ID NO: 7491 - protein, 7 aa, Artificial Sequence
  Description of Artificial Sequence: Synthetic peptide
  XENP018626 vlCDR2
YASHRYT

SEQ ID NO: 7492 - protein, 9 aa, Artificial Sequence
  Description of Artificial Sequence: Synthetic peptide
  XENP018626 vlCDR3
QQDYSSPRT

SEQ ID NO: 7493 - protein, 249 aa, Artificial Sequence
  Description of Artificial Sequence: Synthetic polypeptide
  XENP018627 1G6_H1.127_L1_scFv(GKPGS)4
EVQLVESGGGLVKPGGSLRLSCAASGFTFSNYWMNWVRQAPGKGLEWVGEIRLKSNNKATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7494 - protein, 122 aa, Artificial Sequence
  Description of Artificial Sequence: Synthetic polypeptide
  VH of XENP018627
EVQLVESGGGLVKPGGSLRLSCAASGFTFSNYWMNWVRQAPGKGLEWVGEIRLKSNNKATHYAEPVKGRFTISRDDSKSTVYLQMNSLKTEDTAVYYCTRYYGNYGGYFDVWGAGTLVTVSS

SEQ ID NO: 7495 - protein, 107 aa, Artificial Sequence; identical to SEQ ID NO: 6247
  Description of Artificial Sequence: Synthetic polypeptide
  VL of XENP018627

SEQ ID NO: 7496 - protein, 5 aa, Artificial Sequence
  Description of Artificial Sequence: Synthetic peptide
  XENP018627 vhCDR1
NYWMN

SEQ ID NO: 7497 - protein, 19 aa, Artificial Sequence
  Description of Artificial Sequence: Synthetic peptide
  XENP018627 vhCDR2
EIRLKSNNKATHYAEPVKG

SEQ ID NO: 7498 - protein, 11 aa, Artificial Sequence
  Description of Artificial Sequence: Synthetic peptide
  XENP018627 vhCDR3
YYGNYGGYFDV

SEQ ID NO: 7499 - protein, 11 aa, Artificial Sequence
  Description of Artificial Sequence: Synthetic peptide
  XENP018627 vlCDR1
RASQSVSNDVA

SEQ ID NO: 7500 - protein, 7 aa, Artificial Sequence
  Description of Artificial Sequence: Synthetic peptide
  XENP018627 vlCDR2
YASHRYT

SEQ ID NO: 7501 - protein, 9 aa, Artificial Sequence
  Description of Artificial Sequence: Synthetic peptide
  XENP018627 vlCDR3
QQDYSSPRT

SEQ ID NO: 7502 - protein, 249 aa, Artificial Sequence
  Description of Artificial Sequence: Synthetic polypeptide
  XENP018628 1G6_H1.128_L1_scFv(GKPGS)4
EVQLVESGGGLVKPGGSLRLSCAASGFTFSNYWMNWVRQAPGKGLEWVGEIRLKSNNYGTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7503 - protein, 122 aa, Artificial Sequence
  Description of Artificial Sequence: Synthetic polypeptide
  VH of XENP018628
EVQLVESGGGLVKPGGSLRLSCAASGFTFSNYWMNWVRQAPGKGLEWVGEIRLKSNNYGTHYAEPVKGRFTISRDDSKSTVYLQMNSLKTEDTAVYYCTRYYGNYGGYFDVWGAGTLVTVSS

SEQ ID NO: 7504 - protein, 107 aa, Artificial Sequence; identical to SEQ ID NO: 6247
  Description of Artificial Sequence: Synthetic polypeptide
  VL of XENP018628

SEQ ID NO: 7505 - protein, 5 aa, Artificial Sequence
  Description of Artificial Sequence: Synthetic peptide
  XENP018628 vhCDR1
NYWMN

SEQ ID NO: 7506 - protein, 19 aa, Artificial Sequence
  Description of Artificial Sequence: Synthetic peptide
  XENP018628 vhCDR2
EIRLKSNNYGTHYAEPVKG

SEQ ID NO: 7507 - protein, 11 aa, Artificial Sequence
  Description of Artificial Sequence: Synthetic peptide
  XENP018628 vhCDR3
YYGNYGGYFDV

SEQ ID NO: 7508 - protein, 11 aa, Artificial Sequence
  Description of Artificial Sequence: Synthetic peptide
  XENP018628 vlCDR1
RASQSVSNDVA

SEQ ID NO: 7509 - protein, 7 aa, Artificial Sequence
  Description of Artificial Sequence: Synthetic peptide
  XENP018628 vlCDR2
YASHRYT

SEQ ID NO: 7510 - protein, 9 aa, Artificial Sequence
  Description of Artificial Sequence: Synthetic peptide
  XENP018628 vlCDR3
QQDYSSPRT

SEQ ID NO: 7511 - protein, 249 aa, Artificial Sequence
  Description of Artificial Sequence: Synthetic polypeptide
  XENP018629 1G6_H1.129_L1_scFv(GKPGS)4
EVQLVESGGGLVKPGGSLRLSCAASGFTFSNYWMNWVRQAPGKGLEWVGEIRLKSNNYHTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7512 - protein, 122 aa, Artificial Sequence
  Description of Artificial Sequence: Synthetic polypeptide
  VH of XENP018629
EVQLVESGGGLVKPGGSLRLSCAASGFTFSNYWMNWVRQAPGKGLEWVGEIRLKSNNYHTHYAEPVKGRFTISRDDSKSTVYLQMNSLKTEDTAVYYCTRYYGNYGGYFDVWGAGTLVTVSS

SEQ ID NO: 7513 - protein, 107 aa, Artificial Sequence; identical to SEQ ID NO: 6247
  Description of Artificial Sequence: Synthetic polypeptide
  VL of XENP018629

SEQ ID NO: 7514 - protein, 5 aa, Artificial Sequence
  Description of Artificial Sequence: Synthetic peptide
  XENP018629 vhCDR1
NYWMN

SEQ ID NO: 7515 - protein, 19 aa, Artificial Sequence
  Description of Artificial Sequence: Synthetic peptide
  XENP018629 vhCDR2
EIRLKSNNYHTHYAEPVKG

SEQ ID NO: 7516 - protein, 11 aa, Artificial Sequence
  Description of Artificial Sequence: Synthetic peptide
  XENP018629 vhCDR3
YYGNYGGYFDV

SEQ ID NO: 7517 - protein, 11 aa, Artificial Sequence
  Description of Artificial Sequence: Synthetic peptide
  XENP018629 vlCDR1
RASQSVSNDVA

SEQ ID NO: 7518 - protein, 7 aa, Artificial Sequence
  Description of Artificial Sequence: Synthetic peptide
  XENP018629 vlCDR2
YASHRYT

SEQ ID NO: 7519 - protein, 9 aa, Artificial Sequence
  Description of Artificial Sequence: Synthetic peptide
  XENP018629 vlCDR3
QQDYSSPRT

SEQ ID NO: 7520 - protein, 249 aa, Artificial Sequence
  Description of Artificial Sequence: Synthetic polypeptide
  XENP018630 1G6_H1.130_L1_scFv(GKPGS)4
EVQLVESGGGLVKPGGSLRLSCAASGFTFSNYWMNWVRQAPGKGLEWVGEIRLKSNNYQTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7521 - protein, 122 aa, Artificial Sequence
  Description of Artificial Sequence: Synthetic polypeptide
  VH of XENP018630
EVQLVESGGGLVKPGGSLRLSCAASGFTFSNYWMNWVRQAPGKGLEWVGEIRLKSNNYQTHYAEPVKGRFTISRDDSKSTVYLQMNSLKTEDTAVYYCTRYYGNYGGYFDVWGAGTLVTVSS

SEQ ID NO: 7522 - protein, 107 aa, Artificial Sequence; identical to SEQ ID NO: 6247
  Description of Artificial Sequence: Synthetic polypeptide
  VL of XENP018630

SEQ ID NO: 7523 - protein, 5 aa, Artificial Sequence
  Description of Artificial Sequence: Synthetic peptide
  XENP018630 vhCDR1
NYWMN

SEQ ID NO: 7524 - protein, 19 aa, Artificial Sequence
  Description of Artificial Sequence: Synthetic peptide
  XENP018630 vhCDR2
EIRLKSNNYQTHYAEPVKG

SEQ ID NO: 7525 - protein, 11 aa, Artificial Sequence
  Description of Artificial Sequence: Synthetic peptide
  XENP018630 vhCDR3
YYGNYGGYFDV

SEQ ID NO: 7526 - protein, 11 aa, Artificial Sequence
  Description of Artificial Sequence: Synthetic peptide
  XENP018630 vlCDR1
RASQSVSNDVA

SEQ ID NO: 7527 - protein, 7 aa, Artificial Sequence
  Description of Artificial Sequence: Synthetic peptide
  XENP018630 vlCDR2
YASHRYT

SEQ ID NO: 7528 - protein, 9 aa, Artificial Sequence
  Description of Artificial Sequence: Synthetic peptide
  XENP018630 vlCDR3
QQDYSSPRT

SEQ ID NO: 7529 - protein, 249 aa, Artificial Sequence
  Description of Artificial Sequence: Synthetic polypeptide
  XENP018631 1G6_H1.131_L1_scFv(GKPGS)4
EVQLVESGGGLVKPGGSLRLSCAASGFTFSNYWMNWVRQAPGKGLEWVGEIRLKSNNYDTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7530 - protein, 122 aa, Artificial Sequence
  Description of Artificial Sequence: Synthetic polypeptide
  VH of XENP018631
EVQLVESGGGLVKPGGSLRLSCAASGFTFSNYWMNWVRQAPGKGLEWVGEIRLKSNNYDTHYAEPVKGRFTISRDDSKSTVYLQMNSLKTEDTAVYYCTRYYGNYGGYFDVWGAGTLVTVSS

SEQ ID NO: 7531 - protein, 107 aa, Artificial Sequence; identical to SEQ ID NO: 6247
  Description of Artificial Sequence: Synthetic polypeptide
  VL of XENP018631

SEQ ID NO: 7532 - protein, 5 aa, Artificial Sequence
  Description of Artificial Sequence: Synthetic peptide
  XENP018631 vhCDR1
NYWMN

SEQ ID NO: 7533 - protein, 19 aa, Artificial Sequence
  Description of Artificial Sequence: Synthetic peptide
  XENP018631 vhCDR2
EIRLKSNNYDTHYAEPVKG

SEQ ID NO: 7534 - protein, 11 aa, Artificial Sequence
  Description of Artificial Sequence: Synthetic peptide
  XENP018631 vhCDR3
YYGNYGGYFDV

SEQ ID NO: 7535 - protein, 11 aa, Artificial Sequence
  Description of Artificial Sequence: Synthetic peptide
  XENP018631 vlCDR1
RASQSVSNDVA

SEQ ID NO: 7536 - protein, 7 aa, Artificial Sequence
  Description of Artificial Sequence: Synthetic peptide
  XENP018631 vlCDR2
YASHRYT

SEQ ID NO: 7537 - protein, 9 aa, Artificial Sequence
  Description of Artificial Sequence: Synthetic peptide
  XENP018631 vlCDR3
QQDYSSPRT

SEQ ID NO: 7538 - protein, 249 aa, Artificial Sequence
  Description of Artificial Sequence: Synthetic polypeptide
  XENP018632 1G6_H1.132_L1_scFv(GKPGS)4
EVQLVESGGGLVKPGGSLRLSCAASGFTFSNYWMNWVRQAPGKGLEWVGEIRLKSNNYLTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7539 - protein, 122 aa, Artificial Sequence
  Description of Artificial Sequence: Synthetic polypeptide
  VH of XENP018632
EVQLVESGGGLVKPGGSLRLSCAASGFTFSNYWMNWVRQAPGKGLEWVGEIRLKSNNYLTHYAEPVKGRFTISRDDSKSTVYLQMNSLKTEDTAVYYCTRYYGNYGGYFDVWGAGTLVTVSS

SEQ ID NO: 7540 - protein, 107 aa, Artificial Sequence; identical to SEQ ID NO: 6247
  Description of Artificial Sequence: Synthetic polypeptide
  VL of XENP018632

SEQ ID NO: 7541 - protein, 5 aa, Artificial Sequence
  Description of Artificial Sequence: Synthetic peptide
  XENP018632 vhCDR1
NYWMN

SEQ ID NO: 7542 - protein, 19 aa, Artificial Sequence
  Description of Artificial Sequence: Synthetic peptide
  XENP018632 vhCDR2
EIRLKSNNYLTHYAEPVKG

SEQ ID NO: 7543 - protein, 11 aa, Artificial Sequence
  Description of Artificial Sequence: Synthetic peptide
  XENP018632 vhCDR3
YYGNYGGYFDV

SEQ ID NO: 7544 - protein, 11 aa, Artificial Sequence
  Description of Artificial Sequence: Synthetic peptide
  XENP018632 vlCDR1
RASQSVSNDVA

SEQ ID NO: 7545 - protein, 7 aa, Artificial Sequence
  Description of Artificial Sequence: Synthetic peptide
  XENP018632 vlCDR2
YASHRYT

SEQ ID NO: 7546 - protein, 9 aa, Artificial Sequence
  Description of Artificial Sequence: Synthetic peptide
  XENP018632 vlCDR3
QQDYSSPRT

SEQ ID NO: 7547 - protein, 249 aa, Artificial Sequence
  Description of Artificial Sequence: Synthetic polypeptide
  XENP018633 1G6_H1.133_L1_scFv(GKPGS)4
EVQLVESGGGLVKPGGSLRLSCAASGFTFSNYWMNWVRQAPGKGLEWVGEIRLKSNNYKTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7548 - protein, 122 aa, Artificial Sequence
  Description of Artificial Sequence: Synthetic polypeptide
  VH of XENP018633
EVQLVESGGGLVKPGGSLRLSCAASGFTFSNYWMNWVRQAPGKGLEWVGEIRLKSNNYKTHYAEPVKGRFTISRDDSKSTVYLQMNSLKTEDTAVYYCTRYYGNYGGYFDVWGAGTLVTVSS

SEQ ID NO: 7549 - protein, 107 aa, Artificial Sequence; identical to SEQ ID NO: 6247
  Description of Artificial Sequence: Synthetic polypeptide
  VL of XENP018633

SEQ ID NO: 7550 - protein, 5 aa, Artificial Sequence
  Description of Artificial Sequence: Synthetic peptide
  XENP018633 vhCDR1
NYWMN

SEQ ID NO: 7551 - protein, 19 aa, Artificial Sequence
  Description of Artificial Sequence: Synthetic peptide
  XENP018633 vhCDR2
EIRLKSNNYKTHYAEPVKG

SEQ ID NO: 7552 - protein, 11 aa, Artificial Sequence
  Description of Artificial Sequence: Synthetic peptide
  XENP018633 vhCDR3
YYGNYGGYFDV

SEQ ID NO: 7553 - protein, 11 aa, Artificial Sequence
  Description of Artificial Sequence: Synthetic peptide
  XENP018633 vlCDR1
RASQSVSNDVA

SEQ ID NO: 7554 - protein, 7 aa, Artificial Sequence
  Description of Artificial Sequence: Synthetic peptide
  XENP018633 vlCDR2
YASHRYT

SEQ ID NO: 7555 - protein, 9 aa, Artificial Sequence
  Description of Artificial Sequence: Synthetic peptide
  XENP018633 vlCDR3
QQDYSSPRT

SEQ ID NO: 7556 - protein, 249 aa, Artificial Sequence
  Description of Artificial Sequence: Synthetic polypeptide
  XENP018634 1G6_H1.134_L1_scFv(GKPGS)4
EVQLVESGGGLVKPGGSLRLSCAASGFTFSNYWMNWVRQAPGKGLEWVGEIRLKSNNYYTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7557 - protein, 122 aa, Artificial Sequence
  Description of Artificial Sequence: Synthetic polypeptide
  VH of XENP018634
EVQLVESGGGLVKPGGSLRLSCAASGFTFSNYWMNWVRQAPGKGLEWVGEIRLKSNNYYTHYAEPVKGRFTISRDDSKSTVYLQMNSLKTEDTAVYYCTRYYGNYGGYFDVWGAGTLVTVSS

SEQ ID NO: 7558 - protein, 107 aa, Artificial Sequence; identical to SEQ ID NO: 6247
  Description of Artificial Sequence: Synthetic polypeptide
  VL of XENP018634

SEQ ID NO: 7559 - protein, 5 aa, Artificial Sequence
  Description of Artificial Sequence: Synthetic peptide
  XENP018634 vhCDR1
NYWMN

SEQ ID NO: 7560 - protein, 19 aa, Artificial Sequence
  Description of Artificial Sequence: Synthetic peptide
  XENP018634 vhCDR2
EIRLKSNNYYTHYAEPVKG

SEQ ID NO: 7561 - protein, 11 aa, Artificial Sequence
  Description of Artificial Sequence: Synthetic peptide
  XENP018634 vhCDR3
YYGNYGGYFDV

SEQ ID NO: 7562 - protein, 11 aa, Artificial Sequence
  Description of Artificial Sequence: Synthetic peptide
  XENP018634 vlCDR1
RASQSVSNDVA

SEQ ID NO: 7563 - protein, 7 aa, Artificial Sequence
  Description of Artificial Sequence: Synthetic peptide
  XENP018634 vlCDR2
YASHRYT

SEQ ID NO: 7564 - protein, 9 aa, Artificial Sequence
  Description of Artificial Sequence: Synthetic peptide
  XENP018634 vlCDR3
QQDYSSPRT

SEQ ID NO: 7565 - protein, 249 aa, Artificial Sequence
  Description of Artificial Sequence: Synthetic polypeptide
  XENP018635 1G6_H1.135_L1_scFv(GKPGS)4
EVQLVESGGGLVKPGGSLRLSCAASGFTFSNYWMNWVRQAPGKGLEWVGEIRLKSNNYAKHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7566 - protein, 122 aa, Artificial Sequence
  Description of Artificial Sequence: Synthetic polypeptide
  VH of XENP018635
EVQLVESGGGLVKPGGSLRLSCAASGFTFSNYWMNWVRQAPGKGLEWVGEIRLKSNNYAKHYAEPVKGRFTISRDDSKSTVYLQMNSLKTEDTAVYYCTRYYGNYGGYFDVWGAGTLVTVSS

SEQ ID NO: 7567 - protein, 107 aa, Artificial Sequence; identical to SEQ ID NO: 6247
  Description of Artificial Sequence: Synthetic polypeptide
  VL of XENP018635

SEQ ID NO: 7568 - protein, 5 aa, Artificial Sequence
  Description of Artificial Sequence: Synthetic peptide
  XENP018635 vhCDR1
NYWMN

SEQ ID NO: 7569 - protein, 19 aa, Artificial Sequence
  Description of Artificial Sequence: Synthetic peptide
  XENP018635 vhCDR2
EIRLKSNNYAKHYAEPVKG

SEQ ID NO: 7570 - protein, 11 aa, Artificial Sequence
  Description of Artificial Sequence: Synthetic peptide
  XENP018635 vhCDR3
YYGNYGGYFDV

SEQ ID NO: 7571 - protein, 11 aa, Artificial Sequence
  Description of Artificial Sequence: Synthetic peptide
  XENP018635 vlCDR1
RASQSVSNDVA

SEQ ID NO: 7572 - protein, 7 aa, Artificial Sequence
  Description of Artificial Sequence: Synthetic peptide
  XENP018635 vlCDR2
YASHRYT

SEQ ID NO: 7573 - protein, 9 aa, Artificial Sequence
  Description of Artificial Sequence: Synthetic peptide
  XENP018635 vlCDR3
QQDYSSPRT

SEQ ID NO: 7574 - protein, 249 aa, Artificial Sequence
  Description of Artificial Sequence: Synthetic polypeptide
  XENP018636 1G6_H1.136_L1_scFv(GKPGS)4
EVQLVESGGGLVKPGGSLRLSCAASGFTFSNYWMNWVRQAPGKGLEWVGEIRLKSNNYAIHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7575 - protein, 122 aa, Artificial Sequence
  Description of Artificial Sequence: Synthetic polypeptide
  VH of XENP018636
EVQLVESGGGLVKPGGSLRLSCAASGFTFSNYWMNWVRQAPGKGLEWVGEIRLKSNNYAIHYAEPVKGRFTISRDDSKSTVYLQMNSLKTEDTAVYYCTRYYGNYGGYFDVWGAGTLVTVSS

SEQ ID NO: 7576 - protein, 107 aa, Artificial Sequence; identical to SEQ ID NO: 6247
  Description of Artificial Sequence: Synthetic polypeptide
  VL of XENP018636

SEQ ID NO: 7577 - protein, 5 aa, Artificial Sequence
  Description of Artificial Sequence: Synthetic peptide
  XENP018636 vhCDR1
NYWMN

SEQ ID NO: 7578 - protein, 19 aa, Artificial Sequence
  Description of Artificial Sequence: Synthetic peptide
  XENP018636 vhCDR2
EIRLKSNNYAIHYAEPVKG

SEQ ID NO: 7579 - protein, 11 aa, Artificial Sequence
  Description of Artificial Sequence: Synthetic peptide
  XENP018636 vhCDR3
YYGNYGGYFDV

SEQ ID NO: 7580 - protein, 11 aa, Artificial Sequence
  Description of Artificial Sequence: Synthetic peptide
  XENP018636 vlCDR1
RASQSVSNDVA

SEQ ID NO: 7581 - protein, 7 aa, Artificial Sequence
  Description of Artificial Sequence: Synthetic peptide
  XENP018636 vlCDR2
YASHRYT

SEQ ID NO: 7582 - protein, 9 aa, Artificial Sequence
  Description of Artificial Sequence: Synthetic peptide
  XENP018636 vlCDR3
QQDYSSPRT

SEQ ID NO: 7583 - protein, 249 aa, Artificial Sequence
  Description of Artificial Sequence: Synthetic polypeptide
  XENP018637 1G6_H1.137_L1_scFv(GKPGS)4
EVQLVESGGGLVKPGGSLRLSCAASGFTFSNYWMNWVRQAPGKGLEWVGEIRLKSNNYATYYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7584 - protein, 122 aa, Artificial Sequence
  Description of Artificial Sequence: Synthetic polypeptide
  VH of XENP018637
EVQLVESGGGLVKPGGSLRLSCAASGFTFSNYWMNWVRQAPGKGLEWVGEIRLKSNNYATYYAEPVKGRFTISRDDSKSTVYLQMNSLKTEDTAVYYCTRYYGNYGGYFDVWGAGTLVTVSS

SEQ ID NO: 7585 - protein, 107 aa, Artificial Sequence; identical to SEQ ID NO: 6247
  Description of Artificial Sequence: Synthetic polypeptide
  VL of XENP018637

SEQ ID NO: 7586 - protein, 5 aa, Artificial Sequence
  Description of Artificial Sequence: Synthetic peptide
  XENP018637 vhCDR1
NYWMN

SEQ ID NO: 7587 - protein, 19 aa, Artificial Sequence
  Description of Artificial Sequence: Synthetic peptide
  XENP018637 vhCDR2
EIRLKSNNYATYYAEPVKG

SEQ ID NO: 7588 - protein, 11 aa, Artificial Sequence
  Description of Artificial Sequence: Synthetic peptide
  XENP018637 vhCDR3
YYGNYGGYFDV

SEQ ID NO: 7589 - protein, 11 aa, Artificial Sequence
  Description of Artificial Sequence: Synthetic peptide
  XENP018637 vlCDR1
RASQSVSNDVA

SEQ ID NO: 7590 - protein, 7 aa, Artificial Sequence
  Description of Artificial Sequence: Synthetic peptide
  XENP018637 vlCDR2
YASHRYT

SEQ ID NO: 7591 - protein, 9 aa, Artificial Sequence
  Description of Artificial Sequence: Synthetic peptide
  XENP018637 vlCDR3
QQDYSSPRT

SEQ ID NO: 7592 - protein, 249 aa, Artificial Sequence
  Description of Artificial Sequence: Synthetic polypeptide
  XENP018638 1G6_H1.138_L1_scFv(GKPGS)4
EVQLVESGGGLVKPGGSLRLSCAASGFTFSNYWMNWVRQAPGKGLEWVGEIRLKSNNYATQYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7593 - protein, 122 aa, Artificial Sequence
  Description of Artificial Sequence: Synthetic polypeptide
  VH of XENP018638
EVQLVESGGGLVKPGGSLRLSCAASGFTFSNYWMNWVRQAPGKGLEWVGEIRLKSNNYATQYAEPVKGRFTISRDDSKSTVYLQMNSLKTEDTAVYYCTRYYGNYGGYFDVWGAGTLVTVSS

SEQ ID NO: 7594 - protein, 107 aa, Artificial Sequence; identical to SEQ ID NO: 6247
  Description of Artificial Sequence: Synthetic polypeptide
  VL of XENP018638

SEQ ID NO: 7595 - protein, 5 aa, Artificial Sequence
  Description of Artificial Sequence: Synthetic peptide
  XENP018638 vhCDR1
NYWMN

SEQ ID NO: 7596 - protein, 19 aa, Artificial Sequence
  Description of Artificial Sequence: Synthetic peptide
  XENP018638 vhCDR2
EIRLKSNNYATQYAEPVKG

SEQ ID NO: 7597 - protein, 11 aa, Artificial Sequence
  Description of Artificial Sequence: Synthetic peptide
  XENP018638 vhCDR3
YYGNYGGYFDV

SEQ ID NO: 7598 - protein, 11 aa, Artificial Sequence
  Description of Artificial Sequence: Synthetic peptide
  XENP018638 vlCDR1
RASQSVSNDVA

SEQ ID NO: 7599 - protein, 7 aa, Artificial Sequence
  Description of Artificial Sequence: Synthetic peptide
  XENP018638 vlCDR2
YASHRYT

SEQ ID NO: 7600 - protein, 9 aa, Artificial Sequence
  Description of Artificial Sequence: Synthetic peptide
  XENP018638 vlCDR3
QQDYSSPRT

SEQ ID NO: 7601 - protein, 249 aa, Artificial Sequence
  Description of Artificial Sequence: Synthetic polypeptide
  XENP018639 1G6_H1.139_L1_scFv(GKPGS)4
EVQLVESGGGLVKPGGSLRLSCAASGFTFSNYWMNWVRQAPGKGLEWVGEIRLKSNNYATDYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7602 - protein, 122 aa, Artificial Sequence
  Description of Artificial Sequence: Synthetic polypeptide
  VH of XENP018639
EVQLVESGGGLVKPGGSLRLSCAASGFTFSNYWMNWVRQAPGKGLEWVGEIRLKSNNYATDYAEPVKGRFTISRDDSKSTVYLQMNSLKTEDTAVYYCTRYYGNYGGYFDVWGAGTLVTVSS

SEQ ID NO: 7603 - protein, 107 aa, Artificial Sequence; identical to SEQ ID NO: 6247
  Description of Artificial Sequence: Synthetic polypeptide
  VL of XENP018639

SEQ ID NO: 7604 - protein, 5 aa, Artificial Sequence
  Description of Artificial Sequence: Synthetic peptide
  XENP018639 vhCDR1
NYWMN

SEQ ID NO: 7605 - protein, 19 aa, Artificial Sequence
  Description of Artificial Sequence: Synthetic peptide
  XENP018639 vhCDR2
EIRLKSNNYATDYAEPVKG

SEQ ID NO: 7606 - protein, 11 aa, Artificial Sequence
  Description of Artificial Sequence: Synthetic peptide
  XENP018639 vhCDR3
YYGNYGGYFDV

SEQ ID NO: 7607 - protein, 11 aa, Artificial Sequence
  Description of Artificial Sequence: Synthetic peptide
  XENP018639 vlCDR1
RASQSVSNDVA

SEQ ID NO: 7608 - protein, 7 aa, Artificial Sequence
  Description of Artificial Sequence: Synthetic peptide
  XENP018639 vlCDR2
YASHRYT

SEQ ID NO: 7609 - protein, 9 aa, Artificial Sequence
  Description of Artificial Sequence: Synthetic peptide
  XENP018639 vlCDR3
QQDYSSPRT

SEQ ID NO: 7610 - protein, 249 aa, Artificial Sequence
  Description of Artificial Sequence: Synthetic polypeptide
  XENP018640 1G6_H1.140_L1_scFv(GKPGS)4
EVQLVESGGGLVKPGGSLRLSCAASGFTFSNYWMNWVRQAPGKGLEWVGEIRLKSNNYATFYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7611 - protein, 122 aa, Artificial Sequence
  Description of Artificial Sequence: Synthetic polypeptide
  VH of XENP018640
EVQLVESGGGLVKPGGSLRLSCAASGFTFSNYWMNWVRQAPGKGLEWVGEIRLKSNNYATFYAEPVKGRFTISRDDSKSTVYLQMNSLKTEDTAVYYCTRYYGNYGGYFDVWGAGTLVTVSS

SEQ ID NO: 7612 - protein, 107 aa, Artificial Sequence; identical to SEQ ID NO: 6247
  Description of Artificial Sequence: Synthetic polypeptide
  VL of XENP018640

SEQ ID NO: 7613 - protein, 5 aa, Artificial Sequence
  Description of Artificial Sequence: Synthetic peptide
  XENP018640 vhCDR1
NYWMN

SEQ ID NO: 7614 - protein, 19 aa, Artificial Sequence
  Description of Artificial Sequence: Synthetic peptide
  XENP018640 vhCDR2
EIRLKSNNYATFYAEPVKG

SEQ ID NO: 7615 - protein, 11 aa, Artificial Sequence
  Description of Artificial Sequence: Synthetic peptide
  XENP018640 vhCDR3
YYGNYGGYFDV

SEQ ID NO: 7616 - protein, 11 aa, Artificial Sequence
  Description of Artificial Sequence: Synthetic peptide
  XENP018640 vlCDR1
RASQSVSNDVA

SEQ ID NO: 7617 - protein, 7 aa, Artificial Sequence
  Description of Artificial Sequence: Synthetic peptide
  XENP018640 vlCDR2
YASHRYT

SEQ ID NO: 7618 - protein, 9 aa, Artificial Sequence
  Description of Artificial Sequence: Synthetic peptide
  XENP018640 vlCDR3
QQDYSSPRT

SEQ ID NO: 7619 - protein, 249 aa, Artificial Sequence
  Description of Artificial Sequence: Synthetic polypeptide
  XENP018641 1G6_H1.141_L1_scFv(GKPGS)4
EVQLVESGGGLVKPGGSLRLSCAASGFTFSNYWMNWVRQAPGKGLEWVGEIRLKSNNYATAYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7620 - protein, 122 aa, Artificial Sequence
  Description of Artificial Sequence: Synthetic polypeptide
  VH of XENP018641
EVQLVESGGGLVKPGGSLRLSCAASGFTFSNYWMNWVRQAPGKGLEWVGEIRLKSNNYATAYAEPVKGRFTISRDDSKSTVYLQMNSLKTEDTAVYYCTRYYGNYGGYFDVWGAGTLVTVSS

SEQ ID NO: 7621 - protein, 107 aa, Artificial Sequence; identical to SEQ ID NO: 6247
  Description of Artificial Sequence: Synthetic polypeptide
  VL of XENP018641

SEQ ID NO: 7622 - protein, 5 aa, Artificial Sequence
  Description of Artificial Sequence: Synthetic peptide
  XENP018641 vhCDR1
NYWMN

SEQ ID NO: 7623 - protein, 19 aa, Artificial Sequence
  Description of Artificial Sequence: Synthetic peptide
  XENP018641 vhCDR2
EIRLKSNNYATAYAEPVKG

SEQ ID NO: 7624 - protein, 11 aa, Artificial Sequence
  Description of Artificial Sequence: Synthetic peptide
  XENP018641 vhCDR3
YYGNYGGYFDV

SEQ ID NO: 7625 - protein, 11 aa, Artificial Sequence
  Description of Artificial Sequence: Synthetic peptide
  XENP018641 vlCDR1
RASQSVSNDVA

SEQ ID NO: 7626 - protein, 7 aa, Artificial Sequence
  Description of Artificial Sequence: Synthetic peptide
  XENP018641 vlCDR2
YASHRYT

SEQ ID NO: 7627 - protein, 9 aa, Artificial Sequence
  Description of Artificial Sequence: Synthetic peptide
  XENP018641 vlCDR3
QQDYSSPRT

SEQ ID NO: 7628 - protein, 249 aa, Artificial Sequence
  Description of Artificial Sequence: Synthetic polypeptide
  XENP018642 1G6_H1.142_L1_scFv(GKPGS)4
EVQLVESGGGLVKPGGSLRLSCAASGFTFSNYWMNWVRQAPGKGLEWVGEIRLKSNNYATTYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7629 - protein, 122 aa, Artificial Sequence
  Description of Artificial Sequence: Synthetic polypeptide
  VH of XENP018642
EVQLVESGGGLVKPGGSLRLSCAASGFTFSNYWMNWVRQAPGKGLEWVGEIRLKSNNYATTYAEPVKGRFTISRDDSKSTVYLQMNSLKTEDTAVYYCTRYYGNYGGYFDVWGAGTLVTVSS

SEQ ID NO: 7630 - protein, 107 aa, Artificial Sequence; identical to SEQ ID NO: 6247
  Description of Artificial Sequence: Synthetic polypeptide
  VL of XENP018642

SEQ ID NO: 7631 - protein, 5 aa, Artificial Sequence
  Description of Artificial Sequence: Synthetic peptide
  XENP018642 vhCDR1
NYWMN

SEQ ID NO: 7632 - protein, 19 aa, Artificial Sequence
  Description of Artificial Sequence: Synthetic peptide
  XENP018642 vhCDR2
EIRLKSNNYATTYAEPVKG

SEQ ID NO: 7633 - protein, 11 aa, Artificial Sequence
  Description of Artificial Sequence: Synthetic peptide
  XENP018642 vhCDR3
YYGNYGGYFDV

SEQ ID NO: 7634 - protein, 11 aa, Artificial Sequence
  Description of Artificial Sequence: Synthetic peptide
  XENP018642 vlCDR1
RASQSVSNDVA

SEQ ID NO: 7635 - protein, 7 aa, Artificial Sequence
  Description of Artificial Sequence: Synthetic peptide
  XENP018642 vlCDR2
YASHRYT

SEQ ID NO: 7636 - protein, 9 aa, Artificial Sequence
  Description of Artificial Sequence: Synthetic peptide
  XENP018642 vlCDR3
QQDYSSPRT

SEQ ID NO: 7637 - protein, 249 aa, Artificial Sequence
  Description of Artificial Sequence: Synthetic polypeptide
  XENP018643 1G6_H1.143_L1_scFv(GKPGS)4
EVQLVESGGGLVKPGGSLRLSCAASGFTFSNYWMNWVRQAPGKGLEWVGEIRLKSNNYATKYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7638 - protein, 122 aa, Artificial Sequence
  Description of Artificial Sequence: Synthetic polypeptide
  VH of XENP018643
EVQLVESGGGLVKPGGSLRLSCAASGFTFSNYWMNWVRQAPGKGLEWVGEIRLKSNNYATKYAEPVKGRFTISRDDSKSTVYLQMNSLKTEDTAVYYCTRYYGNYGGYFDVWGAGTLVTVSS

SEQ ID NO: 7639 - protein, 107 aa, Artificial Sequence; identical to SEQ ID NO: 6247
  Description of Artificial Sequence: Synthetic polypeptide
  VL of XENP018643

SEQ ID NO: 7640 - protein, 5 aa, Artificial Sequence
  Description of Artificial Sequence: Synthetic peptide
  XENP018643 vhCDR1
NYWMN

SEQ ID NO: 7641 - protein, 19 aa, Artificial Sequence
  Description of Artificial Sequence: Synthetic peptide
  XENP018643 vhCDR2
EIRLKSNNYATKYAEPVKG

SEQ ID NO: 7642 - protein, 11 aa, Artificial Sequence
  Description of Artificial Sequence: Synthetic peptide
  XENP018643 vhCDR3
YYGNYGGYFDV

SEQ ID NO: 7643 - protein, 11 aa, Artificial Sequence
  Description of Artificial Sequence: Synthetic peptide
  XENP018643 vlCDR1
RASQSVSNDVA

SEQ ID NO: 7644 - protein, 7 aa, Artificial Sequence
  Description of Artificial Sequence: Synthetic peptide
  XENP018643 vlCDR2
YASHRYT

SEQ ID NO: 7645 - protein, 9 aa, Artificial Sequence
  Description of Artificial Sequence: Synthetic peptide
  XENP018643 vlCDR3
QQDYSSPRT

SEQ ID NO: 7646 - protein, 249 aa, Artificial Sequence
  Description of Artificial Sequence: Synthetic polypeptide
  XENP018644 1G6_H1.144_L1_scFv(GKPGS)4
EVQLVESGGGLVKPGGSLRLSCAASGFTFSNYWMNWVRQAPGKGLEWVGEIRLKSNNYATGYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7647 - protein, 122 aa, Artificial Sequence
  Description of Artificial Sequence: Synthetic polypeptide
  VH of XENP018644
EVQLVESGGGLVKPGGSLRLSCAASGFTFSNYWMNWVRQAPGKGLEWVGEIRLKSNNYATGYAEPVKGRFTISRDDSKSTVYLQMNSLKTEDTAVYYCTRYYGNYGGYFDVWGAGTLVTVSS

SEQ ID NO: 7648 - protein, 107 aa, Artificial Sequence; identical to SEQ ID NO: 6247
  Description of Artificial Sequence: Synthetic polypeptide
  VL of XENP018644

SEQ ID NO: 7649 - protein, 5 aa, Artificial Sequence
  Description of Artificial Sequence: Synthetic peptide
  XENP018644 vhCDR1
NYWMN

SEQ ID NO: 7650 - protein, 19 aa, Artificial Sequence
  Description of Artificial Sequence: Synthetic peptide
  XENP018644 vhCDR2
EIRLKSNNYATGYAEPVKG

SEQ ID NO: 7651 - protein, 11 aa, Artificial Sequence
  Description of Artificial Sequence: Synthetic peptide
  XENP018644 vhCDR3
YYGNYGGYFDV

SEQ ID NO: 7652 - protein, 11 aa, Artificial Sequence
  Description of Artificial Sequence: Synthetic peptide
  XENP018644 vlCDR1
RASQSVSNDVA

SEQ ID NO: 7653 - protein, 7 aa, Artificial Sequence
  Description of Artificial Sequence: Synthetic peptide
  XENP018644 vlCDR2
YASHRYT

SEQ ID NO: 7654 - protein, 9 aa, Artificial Sequence
  Description of Artificial Sequence: Synthetic peptide
  XENP018644 vlCDR3
QQDYSSPRT

SEQ ID NO: 7655 - protein, 249 aa, Artificial Sequence
  Description of Artificial Sequence: Synthetic polypeptide
  XENP018645 1G6_H1.145_L1_scFv(GKPGS)4
EVQLVESGGGLVKPGGSLRLSCAASGFTFSNYWMNWVRQAPGKGLEWVGEIRLKSNNYATLYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7656 - protein, 122 aa, Artificial Sequence
  Description of Artificial Sequence: Synthetic polypeptide
  VH of XENP018645
EVQLVESGGGLVKPGGSLRLSCAASGFTFSNYWMNWVRQAPGKGLEWVGEIRLKSNNYATLYAEPVKGRFTISRDDSKSTVYLQMNSLKTEDTAVYYCTRYYGNYGGYFDVWGAGTLVTVSS

SEQ ID NO: 7657 - protein, 107 aa, Artificial Sequence; identical to SEQ ID NO: 6247
  Description of Artificial Sequence: Synthetic polypeptide
  VL of XENP018645

SEQ ID NO: 7658 - protein, 5 aa, Artificial Sequence
  Description of Artificial Sequence: Synthetic peptide
  XENP018645 vhCDR1
NYWMN

SEQ ID NO: 7659 - protein, 19 aa, Artificial Sequence
  Description of Artificial Sequence: Synthetic peptide
  XENP018645 vhCDR2
EIRLKSNNYATLYAEPVKG

SEQ ID NO: 7660 - protein, 11 aa, Artificial Sequence
  Description of Artificial Sequence: Synthetic peptide
  XENP018645 vhCDR3
YYGNYGGYFDV

SEQ ID NO: 7661 - protein, 11 aa, Artificial Sequence
  Description of Artificial Sequence: Synthetic peptide
  XENP018645 vlCDR1
RASQSVSNDVA

SEQ ID NO: 7662 - protein, 7 aa, Artificial Sequence
  Description of Artificial Sequence: Synthetic peptide
  XENP018645 vlCDR2
YASHRYT

SEQ ID NO: 7663 - protein, 9 aa, Artificial Sequence
  Description of Artificial Sequence: Synthetic peptide
  XENP018645 vlCDR3
QQDYSSPRT

SEQ ID NO: 7664 - protein, 249 aa, Artificial Sequence
  Description of Artificial Sequence: Synthetic polypeptide
  XENP018646 1G6_H1.146_L1_scFv(GKPGS)4
EVQLVESGGGLVKPGGSLRLSCAASGFTFSNYWMNWVRQAPGKGLEWVGEIRLKSNNYATHYPEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7665 - protein, 122 aa, Artificial Sequence
  Description of Artificial Sequence: Synthetic polypeptide
  VH of XENP018646
EVQLVESGGGLVKPGGSLRLSCAASGFTFSNYWMNWVRQAPGKGLEWVGEIRLKSNNYATHYPEPVKGRFTISRDDSKSTVYLQMNSLKTEDTAVYYCTRYYGNYGGYFDVWGAGTLVTVSS

SEQ ID NO: 7666 - protein, 107 aa, Artificial Sequence; identical to SEQ ID NO: 6247
  Description of Artificial Sequence: Synthetic polypeptide
  VL of XENP018646

SEQ ID NO: 7667 - protein, 5 aa, Artificial Sequence
  Description of Artificial Sequence: Synthetic peptide
  XENP018646 vhCDR1
NYWMN

SEQ ID NO: 7668 - protein, 19 aa, Artificial Sequence
  Description of Artificial Sequence: Synthetic peptide
  XENP018646 vhCDR2
EIRLKSNNYATHYPEPVKG

SEQ ID NO: 7669 - protein, 11 aa, Artificial Sequence
  Description of Artificial Sequence: Synthetic peptide
  XENP018646 vhCDR3
YYGNYGGYFDV

SEQ ID NO: 7670 - protein, 11 aa, Artificial Sequence
  Description of Artificial Sequence: Synthetic peptide
  XENP018646 vlCDR1
RASQSVSNDVA

SEQ ID NO: 7671 - protein, 7 aa, Artificial Sequence
  Description of Artificial Sequence: Synthetic peptide
  XENP018646 vlCDR2
YASHRYT

SEQ ID NO: 7672 - protein, 9 aa, Artificial Sequence
  Description of Artificial Sequence: Synthetic peptide
  XENP018646 vlCDR3
QQDYSSPRT

SEQ ID NO: 7673 - protein, 249 aa, Artificial Sequence
  Description of Artificial Sequence: Synthetic polypeptide
  XENP018647 1G6_H1.147_L1_scFv(GKPGS)4
EVQLVESGGGLVKPGGSLRLSCAASGFTFSNYWMNWVRQAPGKGLEWVGEIRLKSNNYATHYVEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7674 - protein, 122 aa, Artificial Sequence
  Description of Artificial Sequence: Synthetic polypeptide
  VH of XENP018647
EVQLVESGGGLVKPGGSLRLSCAASGFTFSNYWMNWVRQAPGKGLEWVGEIRLKSNNYATHYVEPVKGRFTISRDDSKSTVYLQMNSLKTEDTAVYYCTRYYGNYGGYFDVWGAGTLVTVSS

SEQ ID NO: 7675 - protein, 107 aa, Artificial Sequence; identical to SEQ ID NO: 6247
  Description of Artificial Sequence: Synthetic polypeptide
  VL of XENP018647

SEQ ID NO: 7676 - protein, 5 aa, Artificial Sequence
  Description of Artificial Sequence: Synthetic peptide
  XENP018647 vhCDR1
NYWMN

SEQ ID NO: 7677 - protein, 19 aa, Artificial Sequence
  Description of Artificial Sequence: Synthetic peptide
  XENP018647 vhCDR2
EIRLKSNNYATHYVEPVKG

SEQ ID NO: 7678 - protein, 11 aa, Artificial Sequence
  Description of Artificial Sequence: Synthetic peptide
  XENP018647 vhCDR3
YYGNYGGYFDV

SEQ ID NO: 7679 - protein, 11 aa, Artificial Sequence
  Description of Artificial Sequence: Synthetic peptide
  XENP018647 vlCDR1
RASQSVSNDVA

SEQ ID NO: 7680 - protein, 7 aa, Artificial Sequence
  Description of Artificial Sequence: Synthetic peptide
  XENP018647 vlCDR2
YASHRYT

SEQ ID NO: 7681 - protein, 9 aa, Artificial Sequence
  Description of Artificial Sequence: Synthetic peptide
  XENP018647 vlCDR3
QQDYSSPRT

SEQ ID NO: 7682 - protein, 249 aa, Artificial Sequence
  Description of Artificial Sequence: Synthetic polypeptide
  XENP018648 1G6_H1.148_L1_scFv(GKPGS)4
EVQLVESGGGLVKPGGSLRLSCAASGFTFSNYWMNWVRQAPGKGLEWVGEIRLKSNNYATHYADPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7683 - protein, 122 aa, Artificial Sequence
  Description of Artificial Sequence: Synthetic polypeptide
  VH of XENP018648
EVQLVESGGGLVKPGGSLRLSCAASGFTFSNYWMNWVRQAPGKGLEWVGEIRLKSNNYATHYADPVKGRFTISRDDSKSTVYLQMNSLKTEDTAVYYCTRYYGNYGGYFDVWGAGTLVTVSS

SEQ ID NO: 7684 - protein, 107 aa, Artificial Sequence; identical to SEQ ID NO: 6247
  Description of Artificial Sequence: Synthetic polypeptide
  VL of XENP018648

SEQ ID NO: 7685 - protein, 5 aa, Artificial Sequence
  Description of Artificial Sequence: Synthetic peptide
  XENP018648 vhCDR1
NYWMN

SEQ ID NO: 7686 - protein, 19 aa, Artificial Sequence
  Description of Artificial Sequence: Synthetic peptide
  XENP018648 vhCDR2
EIRLKSNNYATHYADPVKG

SEQ ID NO: 7687 - protein, 11 aa, Artificial Sequence
  Description of Artificial Sequence: Synthetic peptide
  XENP018648 vhCDR3
YYGNYGGYFDV

SEQ ID NO: 7688 - protein, 11 aa, Artificial Sequence
  Description of Artificial Sequence: Synthetic peptide
  XENP018648 vlCDR1
RASQSVSNDVA

SEQ ID NO: 7689 - protein, 7 aa, Artificial Sequence
  Description of Artificial Sequence: Synthetic peptide
  XENP018648 vlCDR2
YASHRYT

SEQ ID NO: 7690 - protein, 9 aa, Artificial Sequence
  Description of Artificial Sequence: Synthetic peptide
  XENP018648 vlCDR3
QQDYSSPRT

SEQ ID NO: 7691 - protein, 249 aa, Artificial Sequence
  Description of Artificial Sequence: Synthetic polypeptide
  XENP018649 1G6_H1.149_L1_scFv(GKPGS)4
EVQLVESGGGLVKPGGSLRLSCAASGFTFSNYWMNWVRQAPGKGLEWVGEIRLKSNNYATHYAGPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7692 - protein, 122 aa, Artificial Sequence
  Description of Artificial Sequence: Synthetic polypeptide
  VH of XENP018649
EVQLVESGGGLVKPGGSLRLSCAASGFTFSNYWMNWVRQAPGKGLEWVGEIRLKSNNYATHYAGPVKGRFTISRDDSKSTVYLQMNSLKTEDTAVYYCTRYYGNYGGYFDVWGAGTLVTVSS

SEQ ID NO: 7693 - protein, 107 aa, Artificial Sequence; identical to SEQ ID NO: 6247
  Description of Artificial Sequence: Synthetic polypeptide
  VL of XENP018649

SEQ ID NO: 7694 - protein, 5 aa, Artificial Sequence
  Description of Artificial Sequence: Synthetic peptide
  XENP018649 vhCDR1
NYWMN

SEQ ID NO: 7695 - protein, 19 aa, Artificial Sequence
  Description of Artificial Sequence: Synthetic peptide
  XENP018649 vhCDR2
EIRLKSNNYATHYAGPVKG

SEQ ID NO: 7696 - protein, 11 aa, Artificial Sequence
  Description of Artificial Sequence: Synthetic peptide
  XENP018649 vhCDR3
YYGNYGGYFDV

SEQ ID NO: 7697 - protein, 11 aa, Artificial Sequence
  Description of Artificial Sequence: Synthetic peptide
  XENP018649 vlCDR1
RASQSVSNDVA

SEQ ID NO: 7698 - protein, 7 aa, Artificial Sequence
  Description of Artificial Sequence: Synthetic peptide
  XENP018649 vlCDR2
YASHRYT

SEQ ID NO: 7699 - protein, 9 aa, Artificial Sequence
  Description of Artificial Sequence: Synthetic peptide
  XENP018649 vlCDR3
QQDYSSPRT

SEQ ID NO: 7700 - protein, 249 aa, Artificial Sequence
  Description of Artificial Sequence: Synthetic polypeptide
  XENP018650 1G6_H1.150_L1_scFv(GKPGS)4
EVQLVESGGGLVKPGGSLRLSCAASGFTFSNYWMNWVRQAPGKGLEWVGEIRLKSNNYATHYAAPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7701 - protein, 122 aa, Artificial Sequence
  Description of Artificial Sequence: Synthetic polypeptide
  VH of XENP018650
EVQLVESGGGLVKPGGSLRLSCAASGFTFSNYWMNWVRQAPGKGLEWVGEIRLKSNNYATHYAAPVKGRFTISRDDSKSTVYLQMNSLKTEDTAVYYCTRYYGNYGGYFDVWGAGTLVTVSS

SEQ ID NO: 7702 - protein, 107 aa, Artificial Sequence; identical to SEQ ID NO: 6247
  Description of Artificial Sequence: Synthetic polypeptide
  VL of XENP018650

SEQ ID NO: 7703 - protein, 5 aa, Artificial Sequence
  Description of Artificial Sequence: Synthetic peptide
  XENP018650 vhCDR1
NYWMN

SEQ ID NO: 7704 - protein, 19 aa, Artificial Sequence
  Description of Artificial Sequence: Synthetic peptide
  XENP018650 vhCDR2
EIRLKSNNYATHYAAPVKG

SEQ ID NO: 7705 - protein, 11 aa, Artificial Sequence
  Description of Artificial Sequence: Synthetic peptide
  XENP018650 vhCDR3
YYGNYGGYFDV

SEQ ID NO: 7706 - protein, 11 aa, Artificial Sequence
  Description of Artificial Sequence: Synthetic peptide
  XENP018650 vlCDR1
RASQSVSNDVA

SEQ ID NO: 7707 - protein, 7 aa, Artificial Sequence
  Description of Artificial Sequence: Synthetic peptide
  XENP018650 vlCDR2
YASHRYT

SEQ ID NO: 7708 - protein, 9 aa, Artificial Sequence
  Description of Artificial Sequence: Synthetic peptide
  XENP018650 vlCDR3
QQDYSSPRT

SEQ ID NO: 7709 - protein, 249 aa, Artificial Sequence
  Description of Artificial Sequence: Synthetic polypeptide
  XENP018651 1G6_H1.151_L1_scFv(GKPGS)4
EVQLVESGGGLVKPGGSLRLSCAASGFTFSNYWMNWVRQAPGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7710 - protein, 122 aa, Artificial Sequence
  Description of Artificial Sequence: Synthetic polypeptide
  VH of XENP018651
EVQLVESGGGLVKPGGSLRLSCAASGFTFSNYWMNWVRQAPGKGLEWVGEIRLKSNNYATHYAESVKGRFTISRDDSKSTVYLQMNSLKTEDTAVYYCTRYYGNYGGYFDVWGAGTLVTVSS

SEQ ID NO: 7711 - protein, 107 aa, Artificial Sequence; identical to SEQ ID NO: 6247
  Description of Artificial Sequence: Synthetic polypeptide
  VL of XENP018651

SEQ ID NO: 7712 - protein, 5 aa, Artificial Sequence
  Description of Artificial Sequence: Synthetic peptide
  XENP018651 vhCDR1
NYWMN

SEQ ID NO: 7713 - protein, 19 aa, Artificial Sequence
  Description of Artificial Sequence: Synthetic peptide
  XENP018651 vhCDR2
EIRLKSNNYATHYAESVKG

SEQ ID NO: 7714 - protein, 11 aa, Artificial Sequence
  Description of Artificial Sequence: Synthetic peptide
  XENP018651 vhCDR3
YYGNYGGYFDV

SEQ ID NO: 7715 - protein, 11 aa, Artificial Sequence
  Description of Artificial Sequence: Synthetic peptide
  XENP018651 vlCDR1
RASQSVSNDVA

SEQ ID NO: 7716 - protein, 7 aa, Artificial Sequence
  Description of Artificial Sequence: Synthetic peptide
  XENP018651 vlCDR2
YASHRYT

SEQ ID NO: 7717 - protein, 9 aa, Artificial Sequence
  Description of Artificial Sequence: Synthetic peptide
  XENP018651 vlCDR3
QQDYSSPRT

SEQ ID NO: 7718 - protein, 249 aa, Artificial Sequence
  Description of Artificial Sequence: Synthetic polypeptide
  XENP018652 1G6_H1.152_L1_scFv(GKPGS)4
EVQLVESGGGLVKPGGSLRLSCAASGFTFSNYWMNWVRQAPGKGLEWVGEIRLKSNNYATHYAEPVKGRFTISRDNSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7719 - protein, 122 aa, Artificial Sequence
  Description of Artificial Sequence: Synthetic polypeptide
  VH of XENP018652
EVQLVESGGGLVKPGGSLRLSCAASGFTFSNYWMNWVRQAPGKGLEWVGEIRLKSNNYATHYAEPVKGRFTISRDNSKSTVYLQMNSLKTEDTAVYYCTRYYGNYGGYFDVWGAGTLVTVSS

SEQ ID NO: 7720 - protein, 107 aa, Artificial Sequence; identical to SEQ ID NO: 6247
  Description of Artificial Sequence: Synthetic polypeptide
  VL of XENP018652

SEQ ID NO: 7721 - protein, 5 aa, Artificial Sequence
  Description of Artificial Sequence: Synthetic peptide
  XENP018652 vhCDR1
NYWMN

SEQ ID NO: 7722 - protein, 19 aa, Artificial Sequence
  Description of Artificial Sequence: Synthetic peptide
  XENP018652 vhCDR2
EIRLKSNNYATHYAEPVKG

SEQ ID NO: 7723 - protein, 11 aa, Artificial Sequence
  Description of Artificial Sequence: Synthetic peptide
  XENP018652 vhCDR3
YYGNYGGYFDV

SEQ ID NO: 7724 - protein, 11 aa, Artificial Sequence
  Description of Artificial Sequence: Synthetic peptide
  XENP018652 vlCDR1
RASQSVSNDVA

SEQ ID NO: 7725 - protein, 7 aa, Artificial Sequence
  Description of Artificial Sequence: Synthetic peptide
  XENP018652 vlCDR2
YASHRYT

SEQ ID NO: 7726 - protein, 9 aa, Artificial Sequence
  Description of Artificial Sequence: Synthetic peptide
  XENP018652 vlCDR3
QQDYSSPRT

SEQ ID NO: 7727 - protein, 249 aa, Artificial Sequence
  Description of Artificial Sequence: Synthetic polypeptide
  XENP018653 1G6_H1.153_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKNTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7728 - protein, 122 aa, Artificial Sequence
  Description of Artificial Sequence: Synthetic polypeptide
  VH of XENP018653
EVQLVESGGGLVKPGGSLRLSCAASGFTFSNYWMNWVRQAPGKGLEWVGEIRLKSNNYATHYAEPVKGRFTISRDDSKNTVYLQMNSLKTEDTAVYYCTRYYGNYGGYFDVWGAGTLVTVSS

SEQ ID NO: 7729 - protein, 107 aa, Artificial Sequence; identical to SEQ ID NO: 6247
  Description of Artificial Sequence: Synthetic polypeptide
  VL of XENP018653

SEQ ID NO: 7730 - protein, 5 aa, Artificial Sequence
  Description of Artificial Sequence: Synthetic peptide
  XENP018653 vhCDR1
NYWMN

SEQ ID NO: 7731 - protein, 19 aa, Artificial Sequence
  Description of Artificial Sequence: Synthetic peptide
  XENP018653 vhCDR2
EIRLKSNNYATHYAEPVKG

SEQ ID NO: 7732 - protein, 11 aa, Artificial Sequence
  Description of Artificial Sequence: Synthetic peptide
  XENP018653 vhCDR3
YYGNYGGYFDV

SEQ ID NO: 7733 - protein, 11 aa, Artificial Sequence
  Description of Artificial Sequence: Synthetic peptide
  XENP018653 vlCDR1
RASQSVSNDVA

SEQ ID NO: 7734 - protein, 7 aa, Artificial Sequence
  Description of Artificial Sequence: Synthetic peptide
  XENP018653 vlCDR2
YASHRYT

SEQ ID NO: 7735 - protein, 9 aa, Artificial Sequence
  Description of Artificial Sequence: Synthetic peptide
  XENP018653 vlCDR3
QQDYSSPRT

SEQ ID NO: 7736 - protein, 249 aa, Artificial Sequence
  Description of Artificial Sequence: Synthetic polypeptide
  XENP018654 1G6_H1.154_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSSVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7737 - protein, 122 aa, Artificial Sequence
  Description of Artificial Sequence: Synthetic polypeptide
  VH of XENP018654
EVQLVESGGGLVKPGGSLRLSCAASGFTFSNYWMNWVRQAPGKGLEWVGEIRLKSNNYATHYAEPVKGRFTISRDDSKSSVYLQMNSLKTEDTAVYYCTRYYGNYGGYFDVWGAGTLVTVSS

SEQ ID NO: 7738 - protein, 107 aa, Artificial Sequence; identical to SEQ ID NO: 6247
  Description of Artificial Sequence: Synthetic polypeptide
  VL of XENP018654

SEQ ID NO: 7739 - protein, 5 aa, Artificial Sequence
  Description of Artificial Sequence: Synthetic peptide
  XENP018654 vhCDR1
NYWMN

SEQ ID NO: 7740 - protein, 19 aa, Artificial Sequence
  Description of Artificial Sequence: Synthetic peptide
  XENP018654 vhCDR2
EIRLKSNNYATHYAEPVKG

SEQ ID NO: 7741 - protein, 11 aa, Artificial Sequence
  Description of Artificial Sequence: Synthetic peptide
  XENP018654 vhCDR3
YYGNYGGYFDV

SEQ ID NO: 7742 - protein, 11 aa, Artificial Sequence
  Description of Artificial Sequence: Synthetic peptide
  XENP018654 vlCDR1
RASQSVSNDVA

SEQ ID NO: 7743 - protein, 7 aa, Artificial Sequence
  Description of Artificial Sequence: Synthetic peptide
  XENP018654 vlCDR2
YASHRYT

SEQ ID NO: 7744 - protein, 9 aa, Artificial Sequence
  Description of Artificial Sequence: Synthetic peptide
  XENP018654 vlCDR3
QQDYSSPRT

SEQ ID NO: 7745 - protein, 249 aa, Artificial Sequence
  Description of Artificial Sequence: Synthetic polypeptide
  XENP018655 1G6_H1.155_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7746 - protein, 122 aa, Artificial Sequence
  Description of Artificial Sequence: Synthetic polypeptide
  VH of XENP018655
EVQLVESGGGLVKPGGSLRLSCAASGFTFSNYWMNWVRQAPGKGLEWVGEIRLKSNNYATHYAEPVKGRFTISRDDSKSTLYLQMNSLKTEDTAVYYCTRYYGNYGGYFDVWGAGTLVTVSS

SEQ ID NO: 7747 - protein, 107 aa, Artificial Sequence; identical to SEQ ID NO: 6247
  Description of Artificial Sequence: Synthetic polypeptide
  VL of XENP018655

SEQ ID NO: 7748 - protein, 5 aa, Artificial Sequence
  Description of Artificial Sequence: Synthetic peptide
  XENP018655 vhCDR1
NYWMN

SEQ ID NO: 7749 - protein, 19 aa, Artificial Sequence
  Description of Artificial Sequence: Synthetic peptide
  XENP018655 vhCDR2
EIRLKSNNYATHYAEPVKG

SEQ ID NO: 7750 - protein, 11 aa, Artificial Sequence
  Description of Artificial Sequence: Synthetic peptide
  XENP018655 vhCDR3
YYGNYGGYFDV

SEQ ID NO: 7751 - protein, 11 aa, Artificial Sequence
  Description of Artificial Sequence: Synthetic peptide
  XENP018655 vlCDR1
RASQSVSNDVA

SEQ ID NO: 7752 - protein, 7 aa, Artificial Sequence
  Description of Artificial Sequence: Synthetic peptide
  XENP018655 vlCDR2
YASHRYT

SEQ ID NO: 7753 - protein, 9 aa, Artificial Sequence
  Description of Artificial Sequence: Synthetic peptide
  XENP018655 vlCDR3
QQDYSSPRT

SEQ ID NO: 7754 - protein, 249 aa, Artificial Sequence
  Description of Artificial Sequence: Synthetic polypeptide
  XENP018656 1G6_H1.156_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTAYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7755 - protein, 122 aa, Artificial Sequence
  Description of Artificial Sequence: Synthetic polypeptide
  VH of XENP018656
EVQLVESGGGLVKPGGSLRLSCAASGFTFSNYWMNWVRQAPGKGLEWVGEIRLKSNNYATHYAEPVKGRFTISRDDSKSTAYLQMNSLKTEDTAVYYCTRYYGNYGGYFDVWGAGTLVTVSS

SEQ ID NO: 7756 - protein, 107 aa, Artificial Sequence; identical to SEQ ID NO: 6247
  Description of Artificial Sequence: Synthetic polypeptide
  VL of XENP018656

SEQ ID NO: 7757 - protein, 5 aa, Artificial Sequence
  Description of Artificial Sequence: Synthetic peptide
  XENP018656 vhCDR1
NYWMN

SEQ ID NO: 7758 - protein, 19 aa, Artificial Sequence
  Description of Artificial Sequence: Synthetic peptide
  XENP018656 vhCDR2
EIRLKSNNYATHYAEPVKG

SEQ ID NO: 7759 - protein, 11 aa, Artificial Sequence
  Description of Artificial Sequence: Synthetic peptide
  XENP018656 vhCDR3
YYGNYGGYFDV

SEQ ID NO: 7760 - protein, 11 aa, Artificial Sequence
  Description of Artificial Sequence: Synthetic peptide
  XENP018656 vlCDR1
RASQSVSNDVA

SEQ ID NO: 7761 - protein, 7 aa, Artificial Sequence
  Description of Artificial Sequence: Synthetic peptide
  XENP018656 vlCDR2
YASHRYT

SEQ ID NO: 7762 - protein, 9 aa, Artificial Sequence
  Description of Artificial Sequence: Synthetic peptide
  XENP018656 vlCDR3
QQDYSSPRT

SEQ ID NO: 7763 - protein, 249 aa, Artificial Sequence
  Description of Artificial Sequence: Synthetic polypeptide
  XENP018657 1G6_H1.157_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNNLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7764 - protein, 122 aa, Artificial Sequence
  Description of Artificial Sequence: Synthetic polypeptide
  VH of XENP018657
EVQLVESGGGLVKPGGSLRLSCAASGFTFSNYWMNWVRQAPGKGLEWVGEIRLKSNNYATHYAEPVKGRFTISRDDSKSTVYLQMNNLKTEDTAVYYCTRYYGNYGGYFDVWGAGTLVTVSS

SEQ ID NO: 7765 - protein, 107 aa, Artificial Sequence; identical to SEQ ID NO: 6247
  Description of Artificial Sequence: Synthetic polypeptide
  VL of XENP018657

SEQ ID NO: 7766 - protein, 5 aa, Artificial Sequence
  Description of Artificial Sequence: Synthetic peptide
  XENP018657 vhCDR1
NYWMN

SEQ ID NO: 7767 - protein, 19 aa, Artificial Sequence
  Description of Artificial Sequence: Synthetic peptide
  XENP018657 vhCDR2
EIRLKSNNYATHYAEPVKG

SEQ ID NO: 7768 - protein, 11 aa, Artificial Sequence
  Description of Artificial Sequence: Synthetic peptide
  XENP018657 vhCDR3
YYGNYGGYFDV

SEQ ID NO: 7769 - protein, 11 aa, Artificial Sequence
  Description of Artificial Sequence: Synthetic peptide
  XENP018657 vlCDR1
RASQSVSNDVA

SEQ ID NO: 7770 - protein, 7 aa, Artificial Sequence
  Description of Artificial Sequence: Synthetic peptide
  XENP018657 vlCDR2
YASHRYT

SEQ ID NO: 7771 - protein, 9 aa, Artificial Sequence
  Description of Artificial Sequence: Synthetic peptide
  XENP018657 vlCDR3
QQDYSSPRT

SEQ ID NO: 7772 - protein, 249 aa, Artificial Sequence
  Description of Artificial Sequence: Synthetic polypeptide
  XENP018658 1G6_H1.158_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLRTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7773 - protein, 122 aa, Artificial Sequence
  Description of Artificial Sequence: Synthetic polypeptide
  VH of XENP018658
EVQLVESGGGLVKPGGSLRLSCAASGFTFSNYWMNWVRQAPGKGLEWVGEIRLKSNNYATHYAEPVKGRFTISRDDSKSTVYLQMNSLRTEDTAVYYCTRYYGNYGGYFDVWGAGTLVTVSS

SEQ ID NO: 7774 - protein, 107 aa, Artificial Sequence; identical to SEQ ID NO: 6247
  Description of Artificial Sequence: Synthetic polypeptide
  VL of XENP018658

SEQ ID NO: 7775 - protein, 5 aa, Artificial Sequence
  Description of Artificial Sequence: Synthetic peptide
  XENP018658 vhCDR1
NYWMN

SEQ ID NO: 7776 - protein, 19 aa, Artificial Sequence
  Description of Artificial Sequence: Synthetic peptide
  XENP018658 vhCDR2
EIRLKSNNYATHYAEPVKG

SEQ ID NO: 7777 - protein, 11 aa, Artificial Sequence
  Description of Artificial Sequence: Synthetic peptide
  XENP018658 vhCDR3
YYGNYGGYFDV

SEQ ID NO: 7778 - protein, 11 aa, Artificial Sequence
  Description of Artificial Sequence: Synthetic peptide
  XENP018658 vlCDR1
RASQSVSNDVA

SEQ ID NO: 7779 - protein, 7 aa, Artificial Sequence
  Description of Artificial Sequence: Synthetic peptide
  XENP018658 vlCDR2
YASHRYT

SEQ ID NO: 7780 - protein, 9 aa, Artificial Sequence
  Description of Artificial Sequence: Synthetic peptide
  XENP018658 vlCDR3
QQDYSSPRT

SEQ ID NO: 7781 - protein, 249 aa, Artificial Sequence
  Description of Artificial Sequence: Synthetic polypeptide
  XENP018659 1G6_H1.159_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKAEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7782 - protein, 122 aa, Artificial Sequence
  Description of Artificial Sequence: Synthetic polypeptide
  VH of XENP018659
EVQLVESGGGLVKPGGSLRLSCAASGFTFSNYWMNWVRQAPGKGLEWVGEIRLKSNNYATHYAEPVKGRFTISRDDSKSTVYLQMNSLKAEDTAVYYCTRYYGNYGGYFDVWGAGTLVTVSS

SEQ ID NO: 7783 - protein, 107 aa, Artificial Sequence; identical to SEQ ID NO: 6247
  Description of Artificial Sequence: Synthetic polypeptide
  VL of XENP018659

SEQ ID NO: 7784 - protein, 5 aa, Artificial Sequence
  Description of Artificial Sequence: Synthetic peptide
  XENP018659 vhCDR1
NYWMN

SEQ ID NO: 7785 - protein, 19 aa, Artificial Sequence
  Description of Artificial Sequence: Synthetic peptide
  XENP018659 vhCDR2
EIRLKSNNYATHYAEPVKG

SEQ ID NO: 7786 - protein, 11 aa, Artificial Sequence
  Description of Artificial Sequence: Synthetic peptide
  XENP018659 vhCDR3
YYGNYGGYFDV

SEQ ID NO: 7787 - protein, 11 aa, Artificial Sequence
  Description of Artificial Sequence: Synthetic peptide
  XENP018659 vlCDR1
RASQSVSNDVA

SEQ ID NO: 7788 - protein, 7 aa, Artificial Sequence
  Description of Artificial Sequence: Synthetic peptide
  XENP018659 vlCDR2
YASHRYT

SEQ ID NO: 7789 - protein, 9 aa, Artificial Sequence
  Description of Artificial Sequence: Synthetic peptide
  XENP018659 vlCDR3
QQDYSSPRT

SEQ ID NO: 7790 - protein, 249 aa, Artificial Sequence
  Description of Artificial Sequence: Synthetic polypeptide
  XENP018660 1G6_H1.160_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTGVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7791 - protein, 122 aa, Artificial Sequence
  Description of Artificial Sequence: Synthetic polypeptide
  VH of XENP018660
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTGVYYCTRYYGNYGGYFDVWGAGTLVTVSS

SEQ ID NO: 7792 - protein, 107 aa, Artificial Sequence; identical to SEQ ID NO: 6247
  Description of Artificial Sequence: Synthetic polypeptide
  VL of XENP018660

SEQ ID NO: 7793 - protein, 5 aa, Artificial Sequence
  Description of Artificial Sequence: Synthetic peptide
  XENP018660 vhCDR1
NYWMN

SEQ ID NO: 7794 - protein, 19 aa, Artificial Sequence
  Description of Artificial Sequence: Synthetic peptide
  XENP018660 vhCDR2
EIRLKSNNYATHYAEPVKG

SEQ ID NO: 7795 - protein, 11 aa, Artificial Sequence
  Description of Artificial Sequence: Synthetic peptide
  XENP018660 vhCDR3
YYGNYGGYFDV

SEQ ID NO: 7796 - protein, 11 aa, Artificial Sequence
  Description of Artificial Sequence: Synthetic peptide
  XENP018660 vlCDR1
RASQSVSNDVA

SEQ ID NO: 7797 - protein, 7 aa, Artificial Sequence
  Description of Artificial Sequence: Synthetic peptide
  XENP018660 vlCDR2
YASHRYT

SEQ ID NO: 7798 - protein, 9 aa, Artificial Sequence
  Description of Artificial Sequence: Synthetic peptide
  XENP018660 vlCDR3
QQDYSSPRT

SEQ ID NO: 7799 - protein, 249 aa, Artificial Sequence
  Description of Artificial Sequence: Synthetic polypeptide
  XENP018661 1G6_H1.161_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAIYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7800 - protein, 122 aa, Artificial Sequence
  Description of Artificial Sequence: Synthetic polypeptide
  VH of XENP018661
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAIYYCTRYYGNYGGYFDVWGAGTLVTVSS

SEQ ID NO: 7801 - protein, 107 aa, Artificial Sequence; identical to SEQ ID NO: 6247
  Description of Artificial Sequence: Synthetic polypeptide
  VL of XENP018661

SEQ ID NO: 7802 - protein, 5 aa, Artificial Sequence
  Description of Artificial Sequence: Synthetic peptide
  XENP018661 vhCDR1
NYWMN

SEQ ID NO: 7803 - protein, 19 aa, Artificial Sequence
  Description of Artificial Sequence: Synthetic peptide
  XENP018661 vhCDR2
EIRLKSNNYATHYAEPVKG

SEQ ID NO: 7804 - protein, 11 aa, Artificial Sequence
  Description of Artificial Sequence: Synthetic peptide
  XENP018661 vhCDR3
YYGNYGGYFDV

SEQ ID NO: 7805 - protein, 11 aa, Artificial Sequence
  Description of Artificial Sequence: Synthetic peptide
  XENP018661 vlCDR1
RASQSVSNDVA

SEQ ID NO: 7806 - protein, 7 aa, Artificial Sequence
  Description of Artificial Sequence: Synthetic peptide
  XENP018661 vlCDR2
YASHRYT

SEQ ID NO: 7807 - protein, 9 aa, Artificial Sequence
  Description of Artificial Sequence: Synthetic peptide
  XENP018661 vlCDR3
QQDYSSPRT

SEQ ID NO: 7808 - protein, 249 aa, Artificial Sequence
  Description of Artificial Sequence: Synthetic polypeptide
  XENP018662 1G6_H1.162_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYHCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7809 - protein, 122 aa, Artificial Sequence
  Description of Artificial Sequence: Synthetic polypeptide
  VH of XENP018662
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYHCTRYYGNYGGYFDVWGAGTLVTVSS

SEQ ID NO: 7810 - protein, 107 aa, Artificial Sequence; identical to SEQ ID NO: 6247
  Description of Artificial Sequence: Synthetic polypeptide
  VL of XENP018662

SEQ ID NO: 7811 - protein, 5 aa, Artificial Sequence
  Description of Artificial Sequence: Synthetic peptide
  XENP018662 vhCDR1
NYWMN

SEQ ID NO: 7812 - protein, 19 aa, Artificial Sequence
  Description of Artificial Sequence: Synthetic peptide
  XENP018662 vhCDR2
EIRLKSNNYATHYAEPVKG

SEQ ID NO: 7813 - protein, 11 aa, Artificial Sequence
  Description of Artificial Sequence: Synthetic peptide
  XENP018662 vhCDR3
YYGNYGGYFDV

SEQ ID NO: 7814 - protein, 11 aa, Artificial Sequence
  Description of Artificial Sequence: Synthetic peptide
  XENP018662 vlCDR1
RASQSVSNDVA

SEQ ID NO: 7815 - protein, 7 aa, Artificial Sequence
  Description of Artificial Sequence: Synthetic peptide
  XENP018662 vlCDR2
YASHRYT

SEQ ID NO: 7816 - protein, 9 aa, Artificial Sequence
  Description of Artificial Sequence: Synthetic peptide
  XENP018662 vlCDR3
QQDYSSPRT

SEQ ID NO: 7817 - protein, 249 aa, Artificial Sequence
  Description of Artificial Sequence: Synthetic polypeptide
  XENP018663 1G6_H1.163_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCARYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7818 - protein, 122 aa, Artificial Sequence
  Description of Artificial Sequence: Synthetic polypeptide
  VH of XENP018663
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCARYYGNYGGYFDVWGAGTLVTVSS

SEQ ID NO: 7819 - protein, 107 aa, Artificial Sequence; identical to SEQ ID NO: 6247
  Description of Artificial Sequence: Synthetic polypeptide
  VL of XENP018663

SEQ ID NO: 7820 - protein, 5 aa, Artificial Sequence
  Description of Artificial Sequence: Synthetic peptide
  XENP018663 vhCDR1
NYWMN

SEQ ID NO: 7821 - protein, 19 aa, Artificial Sequence
  Description of Artificial Sequence: Synthetic peptide
  XENP018663 vhCDR2
EIRLKSNNYATHYAEPVKG

SEQ ID NO: 7822 - protein, 11 aa, Artificial Sequence
  Description of Artificial Sequence: Synthetic peptide
  XENP018663 vhCDR3
YYGNYGGYFDV

SEQ ID NO: 7823 - protein, 11 aa, Artificial Sequence
  Description of Artificial Sequence: Synthetic peptide
  XENP018663 vlCDR1
RASQSVSNDVA

SEQ ID NO: 7824 - protein, 7 aa, Artificial Sequence
  Description of Artificial Sequence: Synthetic peptide
  XENP018663 vlCDR2
YASHRYT

SEQ ID NO: 7825 - protein, 9 aa, Artificial Sequence
  Description of Artificial Sequence: Synthetic peptide
  XENP018663 vlCDR3
QQDYSSPRT

SEQ ID NO: 7826 - protein, 249 aa, Artificial Sequence
  Description of Artificial Sequence: Synthetic polypeptide
  XENP018664 1G6_H1.164_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCVRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7827 - protein, 122 aa, Artificial Sequence
  Description of Artificial Sequence: Synthetic polypeptide
  VH of XENP018664
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCVRYYGNYGGYFDVWGAGTLVTVSS

SEQ ID NO: 7828 - protein, 107 aa, Artificial Sequence; identical to SEQ ID NO: 6247
  Description of Artificial Sequence: Synthetic polypeptide
  VL of XENP018664

SEQ ID NO: 7829 - protein, 5 aa, Artificial Sequence
  Description of Artificial Sequence: Synthetic peptide
  XENP018664 vhCDR1
NYWMN

SEQ ID NO: 7830 - protein, 19 aa, Artificial Sequence
  Description of Artificial Sequence: Synthetic peptide
  XENP018664 vhCDR2
EIRLKSNNYATHYAEPVKG

SEQ ID NO: 7831 - protein, 11 aa, Artificial Sequence
  Description of Artificial Sequence: Synthetic peptide
  XENP018664 vhCDR3
YYGNYGGYFDV

SEQ ID NO: 7832 - protein, 11 aa, Artificial Sequence
  Description of Artificial Sequence: Synthetic peptide
  XENP018664 vlCDR1
RASQSVSNDVA

SEQ ID NO: 7833 - protein, 7 aa, Artificial Sequence
  Description of Artificial Sequence: Synthetic peptide
  XENP018664 vlCDR2
YASHRYT

SEQ ID NO: 7834 - protein, 9 aa, Artificial Sequence
  Description of Artificial Sequence: Synthetic peptide
  XENP018664 vlCDR3
QQDYSSPRT

SEQ ID NO: 7835 - protein, 249 aa, Artificial Sequence
  Description of Artificial Sequence: Synthetic polypeptide
  XENP018665 1G6_H1.165_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTTYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7836 - protein, 122 aa, Artificial Sequence
  Description of Artificial Sequence: Synthetic polypeptide
  VH of XENP018665
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTTYYGNYGGYFDVWGAGTLVTVSS

SEQ ID NO: 7837 - protein, 107 aa, Artificial Sequence; identical to SEQ ID NO: 6247
  Description of Artificial Sequence: Synthetic polypeptide
  VL of XENP018665

SEQ ID NO: 7838 - protein, 5 aa, Artificial Sequence
  Description of Artificial Sequence: Synthetic peptide
  XENP018665 vhCDR1
NYWMN

SEQ ID NO: 7839 - protein, 19 aa, Artificial Sequence
  Description of Artificial Sequence: Synthetic peptide
  XENP018665 vhCDR2
EIRLKSNNYATHYAEPVKG

SEQ ID NO: 7840 - protein, 11 aa, Artificial Sequence
  Description of Artificial Sequence: Synthetic peptide
  XENP018665 vhCDR3
YYGNYGGYFDV

SEQ ID NO: 7841 - protein, 11 aa, Artificial Sequence
  Description of Artificial Sequence: Synthetic peptide
  XENP018665 vlCDR1
RASQSVSNDVA

SEQ ID NO: 7842 - protein, 7 aa, Artificial Sequence
  Description of Artificial Sequence: Synthetic peptide
  XENP018665 vlCDR2
YASHRYT

SEQ ID NO: 7843 - protein, 9 aa, Artificial Sequence
  Description of Artificial Sequence: Synthetic peptide
  XENP018665 vlCDR3
QQDYSSPRT

SEQ ID NO: 7844 - protein, 249 aa, Artificial Sequence
  Description of Artificial Sequence: Synthetic polypeptide
  XENP018666 1G6_H1.166_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTKYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7845 - protein, 122 aa, Artificial Sequence
  Description of Artificial Sequence: Synthetic polypeptide
  VH of XENP018666
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTKYYGNYGGYFDVWGAGTLVTVSS

SEQ ID NO: 7846 - protein, 107 aa, Artificial Sequence; identical to SEQ ID NO: 6247
  Description of Artificial Sequence: Synthetic polypeptide
  VL of XENP018666

SEQ ID NO: 7847 - protein, 5 aa, Artificial Sequence
  Description of Artificial Sequence: Synthetic peptide
  XENP018666 vhCDR1
NYWMN

SEQ ID NO: 7848 - protein, 19 aa, Artificial Sequence
  Description of Artificial Sequence: Synthetic peptide
  XENP018666 vhCDR2
EIRLKSNNYATHYAEPVKG

SEQ ID NO: 7849 - protein, 11 aa, Artificial Sequence
  Description of Artificial Sequence: Synthetic peptide
  XENP018666 vhCDR3
YYGNYGGYFDV

SEQ ID NO: 7850 - protein, 11 aa, Artificial Sequence
  Description of Artificial Sequence: Synthetic peptide
  XENP018666 vlCDR1
RASQSVSNDVA

SEQ ID NO: 7851 - protein, 7 aa, Artificial Sequence
  Description of Artificial Sequence: Synthetic peptide
  XENP018666 vlCDR2
YASHRYT

SEQ ID NO: 7852 - protein, 9 aa, Artificial Sequence
  Description of Artificial Sequence: Synthetic peptide
  XENP018666 vlCDR3
QQDYSSPRT

SEQ ID NO: 7853 - protein, 249 aa, Artificial Sequence
  Description of Artificial Sequence: Synthetic polypeptide
  XENP018667 1G6_H1.167_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRFYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7854 - protein, 122 aa, Artificial Sequence
  Description of Artificial Sequence: Synthetic polypeptide
  VH of XENP018667
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRFYGNYGGYFDVWGAGTLVTVSS

SEQ ID NO: 7855 - protein, 107 aa, Artificial Sequence; identical to SEQ ID NO: 6247
  Description of Artificial Sequence: Synthetic polypeptide
  VL of XENP018667

SEQ ID NO: 7856 - protein, 5 aa, Artificial Sequence
  Description of Artificial Sequence: Synthetic peptide
  XENP018667 vhCDR1
NYWMN

SEQ ID NO: 7857 - protein, 19 aa, Artificial Sequence
  Description of Artificial Sequence: Synthetic peptide
  XENP018667 vhCDR2
EIRLKSNNYATHYAEPVKG

SEQ ID NO: 7858 - protein, 11 aa, Artificial Sequence
  Description of Artificial Sequence: Synthetic peptide
  XENP018667 vhCDR3
FYGNYGGYFDV

SEQ ID NO: 7859 - protein, 11 aa, Artificial Sequence
  Description of Artificial Sequence: Synthetic peptide
  XENP018667 vlCDR1
RASQSVSNDVA

SEQ ID NO: 7860 - protein, 7 aa, Artificial Sequence
  Description of Artificial Sequence: Synthetic peptide
  XENP018667 vlCDR2
YASHRYT

SEQ ID NO: 7861 - protein, 9 aa, Artificial Sequence
  Description of Artificial Sequence: Synthetic peptide
  XENP018667 vlCDR3
QQDYSSPRT

SEQ ID NO: 7862 - protein, 249 aa, Artificial Sequence
  Description of Artificial Sequence: Synthetic polypeptide
  XENP018668 1G6_H1.168_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRHYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7863 - protein, 122 aa, Artificial Sequence
  Description of Artificial Sequence: Synthetic polypeptide
  VH of XENP018668
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRHYGNYGGYFDVWGAGTLVTVSS

SEQ ID NO: 7864 - protein, 107 aa, Artificial Sequence; identical to SEQ ID NO: 6247
  Description of Artificial Sequence: Synthetic polypeptide
  VL of XENP018668

SEQ ID NO: 7865 - protein, 5 aa, Artificial Sequence
  Description of Artificial Sequence: Synthetic peptide
  XENP018668 vhCDR1
NYWMN

SEQ ID NO: 7866 - protein, 19 aa, Artificial Sequence
  Description of Artificial Sequence: Synthetic peptide
  XENP018668 vhCDR2
EIRLKSNNYATHYAEPVKG

SEQ ID NO: 7867 - protein, 11 aa, Artificial Sequence
  Description of Artificial Sequence: Synthetic peptide
  XENP018668 vhCDR3
HYGNYGGYFDV

SEQ ID NO: 7868 - protein, 11 aa, Artificial Sequence
  Description of Artificial Sequence: Synthetic peptide
  XENP018668 vlCDR1
RASQSVSNDVA

SEQ ID NO: 7869 - protein, 7 aa, Artificial Sequence
  Description of Artificial Sequence: Synthetic peptide
  XENP018668 vlCDR2
YASHRYT

SEQ ID NO: 7870 - protein, 9 aa, Artificial Sequence
  Description of Artificial Sequence: Synthetic peptide
  XENP018668 vlCDR3
QQDYSSPRT

SEQ ID NO: 7871 - protein, 249 aa, Artificial Sequence
  Description of Artificial Sequence: Synthetic polypeptide
  XENP018669 1G6_H1.169_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRLYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7872 - protein, 122 aa, Artificial Sequence
  Description of Artificial Sequence: Synthetic polypeptide
  VH of XENP018669
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRLYGNYGGYFDVWGAGTLVTVSS

SEQ ID NO: 7873 - protein, 107 aa, Artificial Sequence; identical to SEQ ID NO: 6247
  Description of Artificial Sequence: Synthetic polypeptide
  VL of XENP018669

SEQ ID NO: 7874 - protein, 5 aa, Artificial Sequence
  Description of Artificial Sequence: Synthetic peptide
  XENP018669 vhCDR1
NYWMN

SEQ ID NO: 7875 - protein, 19 aa, Artificial Sequence
  Description of Artificial Sequence: Synthetic peptide
  XENP018669 vhCDR2
EIRLKSNNYATHYAEPVKG

SEQ ID NO: 7876 - protein, 11 aa, Artificial Sequence
  Description of Artificial Sequence: Synthetic peptide
  XENP018669 vhCDR3
LYGNYGGYFDV

SEQ ID NO: 7877 - protein, 11 aa, Artificial Sequence
  Description of Artificial Sequence: Synthetic peptide
  XENP018669 vlCDR1
RASQSVSNDVA

SEQ ID NO: 7878 - protein, 7 aa, Artificial Sequence
  Description of Artificial Sequence: Synthetic peptide
  XENP018669 vlCDR2
YASHRYT

SEQ ID NO: 7879 - protein, 9 aa, Artificial Sequence
  Description of Artificial Sequence: Synthetic peptide
  XENP018669 vlCDR3
QQDYSSPRT

SEQ ID NO: 7880 - protein, 249 aa, Artificial Sequence
  Description of Artificial Sequence: Synthetic polypeptide
  XENP018670 1G6_H1.170_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRWYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7881 - protein, 122 aa, Artificial Sequence
  Description of Artificial Sequence: Synthetic polypeptide
  VH of XENP018670
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRWYGNYGGYFDVWGAGTLVTVSS

SEQ ID NO: 7882 - protein, 107 aa, Artificial Sequence; identical to SEQ ID NO: 6247
  Description of Artificial Sequence: Synthetic polypeptide
  VL of XENP018670

SEQ ID NO: 7883 - protein, 5 aa, Artificial Sequence
  Description of Artificial Sequence: Synthetic peptide
  XENP018670 vhCDR1
NYWMN

SEQ ID NO: 7884 - protein, 19 aa, Artificial Sequence
  Description of Artificial Sequence: Synthetic peptide
  XENP018670 vhCDR2
EIRLKSNNYATHYAEPVKG

SEQ ID NO: 7885 - protein, 11 aa, Artificial Sequence
  Description of Artificial Sequence: Synthetic peptide
  XENP018670 vhCDR3
WYGNYGGYFDV

SEQ ID NO: 7886 - protein, 11 aa, Artificial Sequence
  Description of Artificial Sequence: Synthetic peptide
  XENP018670 vlCDR1
RASQSVSNDVA

SEQ ID NO: 7887 - protein, 7 aa, Artificial Sequence
  Description of Artificial Sequence: Synthetic peptide
  XENP018670 vlCDR2
YASHRYT

SEQ ID NO: 7888 - protein, 9 aa, Artificial Sequence
  Description of Artificial Sequence: Synthetic peptide
  XENP018670 vlCDR3
QQDYSSPRT

SEQ ID NO: 7889 - protein, 249 aa, Artificial Sequence
  Description of Artificial Sequence: Synthetic polypeptide
  XENP018671 1G6_H1.171_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRVYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7890 - protein, 122 aa, Artificial Sequence
  Description of Artificial Sequence: Synthetic polypeptide
  VH of XENP018671
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRVYGNYGGYFDVWGAGTLVTVSS

SEQ ID NO: 7891 - protein, 107 aa, Artificial Sequence; identical to SEQ ID NO: 6247
  Description of Artificial Sequence: Synthetic polypeptide
  VL of XENP018671

SEQ ID NO: 7892 - protein, 5 aa, Artificial Sequence
  Description of Artificial Sequence: Synthetic peptide
  XENP018671 vhCDR1
NYWMN

SEQ ID NO: 7893 - protein, 19 aa, Artificial Sequence
  Description of Artificial Sequence: Synthetic peptide
  XENP018671 vhCDR2
EIRLKSNNYATHYAEPVKG

SEQ ID NO: 7894 - protein, 11 aa, Artificial Sequence
  Description of Artificial Sequence: Synthetic peptide
  XENP018671 vhCDR3
VYGNYGGYFDV

SEQ ID NO: 7895 - protein, 11 aa, Artificial Sequence
  Description of Artificial Sequence: Synthetic peptide
  XENP018671 vlCDR1
RASQSVSNDVA

SEQ ID NO: 7896 - protein, 7 aa, Artificial Sequence
  Description of Artificial Sequence: Synthetic peptide
  XENP018671 vlCDR2
YASHRYT

SEQ ID NO: 7897 - protein, 9 aa, Artificial Sequence
  Description of Artificial Sequence: Synthetic peptide
  XENP018671 vlCDR3
QQDYSSPRT

SEQ ID NO: 7898 - protein, 249 aa, Artificial Sequence
  Description of Artificial Sequence: Synthetic polypeptide
  XENP018672 1G6_H1.172_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRAYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7899 - protein, 122 aa, Artificial Sequence
  Description of Artificial Sequence: Synthetic polypeptide
  VH of XENP018672
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRAYGNYGGYFDVWGAGTLVTVSS

SEQ ID NO: 7900 - protein, 107 aa, Artificial Sequence; identical to SEQ ID NO: 6247
  Description of Artificial Sequence: Synthetic polypeptide
  VL of XENP018672

SEQ ID NO: 7901 - protein, 5 aa, Artificial Sequence
  Description of Artificial Sequence: Synthetic peptide
  XENP018672 vhCDR1
NYWMN

SEQ ID NO: 7902 - protein, 19 aa, Artificial Sequence
  Description of Artificial Sequence: Synthetic peptide
  XENP018672 vhCDR2
EIRLKSNNYATHYAEPVKG

SEQ ID NO: 7903 - protein, 11 aa, Artificial Sequence
  Description of Artificial Sequence: Synthetic peptide
  XENP018672 vhCDR3
AYGNYGGYFDV

SEQ ID NO: 7904 - protein, 11 aa, Artificial Sequence
  Description of Artificial Sequence: Synthetic peptide
  XENP018672 vlCDR1
RASQSVSNDVA

SEQ ID NO: 7905 - protein, 7 aa, Artificial Sequence
  Description of Artificial Sequence: Synthetic peptide
  XENP018672 vlCDR2
YASHRYT

SEQ ID NO: 7906 - protein, 9 aa, Artificial Sequence
  Description of Artificial Sequence: Synthetic peptide
  XENP018672 vlCDR3
QQDYSSPRT

SEQ ID NO: 7907 - protein, 249 aa, Artificial Sequence
  Description of Artificial Sequence: Synthetic polypeptide
  XENP018673 1G6_H1.173_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRQYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7908 - protein, 122 aa, Artificial Sequence
  Description of Artificial Sequence: Synthetic polypeptide
  VH of XENP018673
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRQYGNYGGYFDVWGAGTLVTVSS

SEQ ID NO: 7909 - protein, 107 aa, Artificial Sequence; identical to SEQ ID NO: 6247
  Description of Artificial Sequence: Synthetic polypeptide
  VL of XENP018673

SEQ ID NO: 7910 - protein, 5 aa, Artificial Sequence
  Description of Artificial Sequence: Synthetic peptide
  XENP018673 vhCDR1
NYWMN

SEQ ID NO: 7911 - protein, 19 aa, Artificial Sequence
  Description of Artificial Sequence: Synthetic peptide
  XENP018673 vhCDR2
EIRLKSNNYATHYAEPVKG

SEQ ID NO: 7912 - protein, 11 aa, Artificial Sequence
  Description of Artificial Sequence: Synthetic peptide
  XENP018673 vhCDR3
QYGNYGGYFDV

SEQ ID NO: 7913 - protein, 11 aa, Artificial Sequence
  Description of Artificial Sequence: Synthetic peptide
  XENP018673 vlCDR1
RASQSVSNDVA

SEQ ID NO: 7914 - protein, 7 aa, Artificial Sequence
  Description of Artificial Sequence: Synthetic peptide
  XENP018673 vlCDR2
YASHRYT

SEQ ID NO: 7915 - protein, 9 aa, Artificial Sequence
  Description of Artificial Sequence: Synthetic peptide
  XENP018673 vlCDR3
QQDYSSPRT

SEQ ID NO: 7916 - protein, 249 aa, Artificial Sequence
  Description of Artificial Sequence: Synthetic polypeptide
  XENP018674 1G6_H1.174_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRDYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7917 - protein, 122 aa, Artificial Sequence
  Description of Artificial Sequence: Synthetic polypeptide
  VH of XENP018674
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRDYGNYGGYFDVWGAGTLVTVSS

SEQ ID NO: 7918 - protein, 107 aa, Artificial Sequence; identical to SEQ ID NO: 6247
  Description of Artificial Sequence: Synthetic polypeptide
  VL of XENP018674

SEQ ID NO: 7919 - protein, 5 aa, Artificial Sequence
  Description of Artificial Sequence: Synthetic peptide
  XENP018674 vhCDR1
NYWMN

SEQ ID NO: 7920 - protein, 19 aa, Artificial Sequence
  Description of Artificial Sequence: Synthetic peptide
  XENP018674 vhCDR2
EIRLKSNNYATHYAEPVKG

SEQ ID NO: 7921 - protein, 11 aa, Artificial Sequence
  Description of Artificial Sequence: Synthetic peptide
  XENP018674 vhCDR3
DYGNYGGYFDV

SEQ ID NO: 7922 - protein, 11 aa, Artificial Sequence
  Description of Artificial Sequence: Synthetic peptide
  XENP018674 vlCDR1
RASQSVSNDVA

SEQ ID NO: 7923 - protein, 7 aa, Artificial Sequence
  Description of Artificial Sequence: Synthetic peptide
  XENP018674 vlCDR2
YASHRYT

SEQ ID NO: 7924 - protein, 9 aa, Artificial Sequence
  Description of Artificial Sequence: Synthetic peptide
  XENP018674 vlCDR3
QQDYSSPRT

SEQ ID NO: 7925 - protein, 249 aa, Artificial Sequence
  Description of Artificial Sequence: Synthetic polypeptide
  XENP018675 1G6_H1.175_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRKYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7926 - protein, 122 aa, Artificial Sequence
  Description of Artificial Sequence: Synthetic polypeptide
  VH of XENP018675
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRKYGNYGGYFDVWGAGTLVTVSS

SEQ ID NO: 7927 - protein, 107 aa, Artificial Sequence; identical to SEQ ID NO: 6247
  Description of Artificial Sequence: Synthetic polypeptide
  VL of XENP018675

SEQ ID NO: 7928 - protein, 5 aa, Artificial Sequence
  Description of Artificial Sequence: Synthetic peptide
  XENP018675 vhCDR1
NYWMN

SEQ ID NO: 7929 - protein, 19 aa, Artificial Sequence
  Description of Artificial Sequence: Synthetic peptide
  XENP018675 vhCDR2
EIRLKSNNYATHYAEPVKG

SEQ ID NO: 7930 - protein, 11 aa, Artificial Sequence
  Description of Artificial Sequence: Synthetic peptide
  XENP018675 vhCDR3
KYGNYGGYFDV

SEQ ID NO: 7931 - protein, 11 aa, Artificial Sequence
  Description of Artificial Sequence: Synthetic peptide
  XENP018675 vlCDR1
RASQSVSNDVA

SEQ ID NO: 7932 - protein, 7 aa, Artificial Sequence
  Description of Artificial Sequence: Synthetic peptide
  XENP018675 vlCDR2
YASHRYT

SEQ ID NO: 7933 - protein, 9 aa, Artificial Sequence
  Description of Artificial Sequence: Synthetic peptide
  XENP018675 vlCDR3
QQDYSSPRT

SEQ ID NO: 7934 - protein, 249 aa, Artificial Sequence
  Description of Artificial Sequence: Synthetic polypeptide
  XENP018676 1G6_H1.176_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYFGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7935 - protein, 122 aa, Artificial Sequence
  Description of Artificial Sequence: Synthetic polypeptide
  VH of XENP018676
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYFGNYGGYFDVWGAGTLVTVSS

SEQ ID NO: 7936 - protein, 107 aa, Artificial Sequence; identical to SEQ ID NO: 6247
  Description of Artificial Sequence: Synthetic polypeptide
  VL of XENP018676

SEQ ID NO: 7937 - protein, 5 aa, Artificial Sequence
  Description of Artificial Sequence: Synthetic peptide
  XENP018676 vhCDR1
NYWMN

SEQ ID NO: 7938 - protein, 19 aa, Artificial Sequence
  Description of Artificial Sequence: Synthetic peptide
  XENP018676 vhCDR2
EIRLKSNNYATHYAEPVKG

SEQ ID NO: 7939 - protein, 11 aa, Artificial Sequence
  Description of Artificial Sequence: Synthetic peptide
  XENP018676 vhCDR3
YFGNYGGYFDV

SEQ ID NO: 7940 - protein, 11 aa, Artificial Sequence
  Description of Artificial Sequence: Synthetic peptide
  XENP018676 vlCDR1
RASQSVSNDVA

SEQ ID NO: 7941 - protein, 7 aa, Artificial Sequence
  Description of Artificial Sequence: Synthetic peptide
  XENP018676 vlCDR2
YASHRYT

SEQ ID NO: 7942 - protein, 9 aa, Artificial Sequence
  Description of Artificial Sequence: Synthetic peptide
  XENP018676 vlCDR3
QQDYSSPRT

SEQ ID NO: 7943 - protein, 249 aa, Artificial Sequence
  Description of Artificial Sequence: Synthetic polypeptide
  XENP018677 1G6_H1.177_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYHGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7944 - protein, 122 aa, Artificial Sequence
  Description of Artificial Sequence: Synthetic polypeptide
  VH of XENP018677
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYHGNYGGYFDVWGAGTLVTVSS

SEQ ID NO: 7945 - protein, 107 aa, Artificial Sequence; identical to SEQ ID NO: 6247
  Description of Artificial Sequence: Synthetic polypeptide
  VL of XENP018677

SEQ ID NO: 7946 - protein, 5 aa, Artificial Sequence
  Description of Artificial Sequence: Synthetic peptide
  XENP018677 vhCDR1
NYWMN

SEQ ID NO: 7947 - protein, 19 aa, Artificial Sequence
  Description of Artificial Sequence: Synthetic peptide
  XENP018677 vhCDR2
EIRLKSNNYATHYAEPVKG

SEQ ID NO: 7948 - protein, 11 aa, Artificial Sequence
  Description of Artificial Sequence: Synthetic peptide
  XENP018677 vhCDR3
YHGNYGGYFDV

SEQ ID NO: 7949 - protein, 11 aa, Artificial Sequence
  Description of Artificial Sequence: Synthetic peptide
  XENP018677 vlCDR1
RASQSVSNDVA

SEQ ID NO: 7950 - protein, 7 aa, Artificial Sequence
  Description of Artificial Sequence: Synthetic peptide
  XENP018677 vlCDR2
YASHRYT

SEQ ID NO: 7951 - protein, 9 aa, Artificial Sequence
  Description of Artificial Sequence: Synthetic peptide
  XENP018677 vlCDR3
QQDYSSPRT

SEQ ID NO: 7952 - protein, 249 aa, Artificial Sequence
  Description of Artificial Sequence: Synthetic polypeptide
  XENP018678 1G6_H1.178_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYLGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7953 - protein, 122 aa, Artificial Sequence
  Description of Artificial Sequence: Synthetic polypeptide
  VH of XENP018678
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYLGNYGGYFDVWGAGTLVTVSS

SEQ ID NO: 7954 - protein, 107 aa, Artificial Sequence; identical to SEQ ID NO: 6247
  Description of Artificial Sequence: Synthetic polypeptide
  VL of XENP018678

SEQ ID NO: 7955 - protein, 5 aa, Artificial Sequence
  Description of Artificial Sequence: Synthetic peptide
  XENP018678 vhCDR1
NYWMN

SEQ ID NO: 7956 - protein, 19 aa, Artificial Sequence
  Description of Artificial Sequence: Synthetic peptide
  XENP018678 vhCDR2
EIRLKSNNYATHYAEPVKG

SEQ ID NO: 7957 - protein, 11 aa, Artificial Sequence
  Description of Artificial Sequence: Synthetic peptide
  XENP018678 vhCDR3
YLGNYGGYFDV

SEQ ID NO: 7958 - protein, 11 aa, Artificial Sequence
  Description of Artificial Sequence: Synthetic peptide
  XENP018678 vlCDR1
RASQSVSNDVA

SEQ ID NO: 7959 - protein, 7 aa, Artificial Sequence
  Description of Artificial Sequence: Synthetic peptide
  XENP018678 vlCDR2
YASHRYT

SEQ ID NO: 7960 - protein, 9 aa, Artificial Sequence
  Description of Artificial Sequence: Synthetic peptide
  XENP018678 vlCDR3
QQDYSSPRT

SEQ ID NO: 7961 - protein, 249 aa, Artificial Sequence
  Description of Artificial Sequence: Synthetic polypeptide
  XENP018679 1G6_H1.179_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYWGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7962 - protein, 122 aa, Artificial Sequence
  Description of Artificial Sequence: Synthetic polypeptide
  VH of XENP018679
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYWGNYGGYFDVWGAGTLVTVSS

SEQ ID NO: 7963 - protein, 107 aa, Artificial Sequence; identical to SEQ ID NO: 6247
  Description of Artificial Sequence: Synthetic polypeptide
  VL of XENP018679

SEQ ID NO: 7964 - protein, 5 aa, Artificial Sequence
  Description of Artificial Sequence: Synthetic peptide
  XENP018679 vhCDR1
NYWMN

SEQ ID NO: 7965 - protein, 19 aa, Artificial Sequence
  Description of Artificial Sequence: Synthetic peptide
  XENP018679 vhCDR2
EIRLKSNNYATHYAEPVKG

SEQ ID NO: 7966 - protein, 11 aa, Artificial Sequence
  Description of Artificial Sequence: Synthetic peptide
  XENP018679 vhCDR3
YWGNYGGYFDV

SEQ ID NO: 7967 - protein, 11 aa, Artificial Sequence
  Description of Artificial Sequence: Synthetic peptide
  XENP018679 vlCDR1
RASQSVSNDVA

SEQ ID NO: 7968 - protein, 7 aa, Artificial Sequence
  Description of Artificial Sequence: Synthetic peptide
  XENP018679 vlCDR2
YASHRYT

SEQ ID NO: 7969 - protein, 9 aa, Artificial Sequence
  Description of Artificial Sequence: Synthetic peptide
  XENP018679 vlCDR3
QQDYSSPRT

SEQ ID NO: 7970 - protein, 249 aa, Artificial Sequence
  Description of Artificial Sequence: Synthetic polypeptide
  XENP018680 1G6_H1.180_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYVGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7971 - protein, 122 aa, Artificial Sequence
  Description of Artificial Sequence: Synthetic polypeptide
  VH of XENP018680
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYVGNYGGYFDVWGAGTLVTVSS

SEQ ID NO: 7972 - protein, 107 aa, Artificial Sequence; identical to SEQ ID NO: 6247
  Description of Artificial Sequence: Synthetic polypeptide
  VL of XENP018680

SEQ ID NO: 7973 - protein, 5 aa, Artificial Sequence
  Description of Artificial Sequence: Synthetic peptide
  XENP018680 vhCDR1
NYWMN

SEQ ID NO: 7974 - protein, 19 aa, Artificial Sequence
  Description of Artificial Sequence: Synthetic peptide
  XENP018680 vhCDR2
EIRLKSNNYATHYAEPVKG

SEQ ID NO: 7975 - protein, 11 aa, Artificial Sequence
  Description of Artificial Sequence: Synthetic peptide
  XENP018680 vhCDR3
YVGNYGGYFDV

SEQ ID NO: 7976 - protein, 11 aa, Artificial Sequence
  Description of Artificial Sequence: Synthetic peptide
  XENP018680 vlCDR1
RASQSVSNDVA

SEQ ID NO: 7977 - protein, 7 aa, Artificial Sequence
  Description of Artificial Sequence: Synthetic peptide
  XENP018680 vlCDR2
YASHRYT

SEQ ID NO: 7978 - protein, 9 aa, Artificial Sequence
  Description of Artificial Sequence: Synthetic peptide
  XENP018680 vlCDR3
QQDYSSPRT

SEQ ID NO: 7979 - protein, 249 aa, Artificial Sequence
  Description of Artificial Sequence: Synthetic polypeptide
  XENP018681 1G6_H1.181_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYAGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7980 - protein, 122 aa, Artificial Sequence
  Description of Artificial Sequence: Synthetic polypeptide
  VH of XENP018681
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYAGNYGGYFDVWGAGTLVTVSS

SEQ ID NO: 7981 - protein, 107 aa, Artificial Sequence; identical to SEQ ID NO: 6247
  Description of Artificial Sequence: Synthetic polypeptide
  VL of XENP018681

SEQ ID NO: 7982 - protein, 5 aa, Artificial Sequence
  Description of Artificial Sequence: Synthetic peptide
  XENP018681 vhCDR1
NYWMN

SEQ ID NO: 7983 - protein, 19 aa, Artificial Sequence
  Description of Artificial Sequence: Synthetic peptide
  XENP018681 vhCDR2
EIRLKSNNYATHYAEPVKG

SEQ ID NO: 7984 - protein, 11 aa, Artificial Sequence
  Description of Artificial Sequence: Synthetic peptide
  XENP018681 vhCDR3
YAGNYGGYFDV

SEQ ID NO: 7985 - protein, 11 aa, Artificial Sequence
  Description of Artificial Sequence: Synthetic peptide
  XENP018681 vlCDR1
RASQSVSNDVA

SEQ ID NO: 7986 - protein, 7 aa, Artificial Sequence
  Description of Artificial Sequence: Synthetic peptide
  XENP018681 vlCDR2
YASHRYT

SEQ ID NO: 7987 - protein, 9 aa, Artificial Sequence
  Description of Artificial Sequence: Synthetic peptide
  XENP018681 vlCDR3
QQDYSSPRT

SEQ ID NO: 7988 - protein, 249 aa, Artificial Sequence
  Description of Artificial Sequence: Synthetic polypeptide
  XENP018682 1G6_H1.182_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYQGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7989 - protein, 122 aa, Artificial Sequence
  Description of Artificial Sequence: Synthetic polypeptide
  VH of XENP018682
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYQGNYGGYFDVWGAGTLVTVSS

SEQ ID NO: 7990 - protein, 107 aa, Artificial Sequence; identical to SEQ ID NO: 6247
  Description of Artificial Sequence: Synthetic polypeptide
  VL of XENP018682

SEQ ID NO: 7991 - protein, 5 aa, Artificial Sequence
  Description of Artificial Sequence: Synthetic peptide
  XENP018682 vhCDR1
NYWMN

SEQ ID NO: 7992 - protein, 19 aa, Artificial Sequence
  Description of Artificial Sequence: Synthetic peptide
  XENP018682 vhCDR2
EIRLKSNNYATHYAEPVKG

SEQ ID NO: 7993 - protein, 11 aa, Artificial Sequence
  Description of Artificial Sequence: Synthetic peptide
  XENP018682 vhCDR3
YQGNYGGYFDV

SEQ ID NO: 7994 - protein, 11 aa, Artificial Sequence
  Description of Artificial Sequence: Synthetic peptide
  XENP018682 vlCDR1
RASQSVSNDVA

SEQ ID NO: 7995 - protein, 7 aa, Artificial Sequence
  Description of Artificial Sequence: Synthetic peptide
  XENP018682 vlCDR2
YASHRYT

SEQ ID NO: 7996 - protein, 9 aa, Artificial Sequence
  Description of Artificial Sequence: Synthetic peptide
  XENP018682 vlCDR3
QQDYSSPRT

SEQ ID NO: 7997 - protein, 249 aa, Artificial Sequence
  Description of Artificial Sequence: Synthetic polypeptide
  XENP018683 1G6_H1.183_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYDGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7998 - protein, 122 aa, Artificial Sequence
  Description of Artificial Sequence: Synthetic polypeptide
  VH of XENP018683
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYDGNYGGYFDVWGAGTLVTVSS

SEQ ID NO: 7999 - protein, 107 aa, Artificial Sequence; identical to SEQ ID NO: 6247
  Description of Artificial Sequence: Synthetic polypeptide
  VL of XENP018683

SEQ ID NO: 8000 - protein, 5 aa, Artificial Sequence
  Description of Artificial Sequence: Synthetic peptide
  XENP018683 vhCDR1
NYWMN

SEQ ID NO: 8001 - protein, 19 aa, Artificial Sequence
  Description of Artificial Sequence: Synthetic peptide
  XENP018683 vhCDR2
EIRLKSNNYATHYAEPVKG

SEQ ID NO: 8002 - protein, 11 aa, Artificial Sequence
  Description of Artificial Sequence: Synthetic peptide
  XENP018683 vhCDR3
YDGNYGGYFDV

SEQ ID NO: 8003 - protein, 11 aa, Artificial Sequence
  Description of Artificial Sequence: Synthetic peptide
  XENP018683 vlCDR1
RASQSVSNDVA

SEQ ID NO: 8004 - protein, 7 aa, Artificial Sequence
  Description of Artificial Sequence: Synthetic peptide
  XENP018683 vlCDR2
YASHRYT

SEQ ID NO: 8005 - protein, 9 aa, Artificial Sequence
  Description of Artificial Sequence: Synthetic peptide
  XENP018683 vlCDR3
QQDYSSPRT

SEQ ID NO: 8006 - protein, 249 aa, Artificial Sequence
  Description of Artificial Sequence: Synthetic polypeptide
  XENP018684 1G6_H1.184_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYKGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8007 - protein, 122 aa, Artificial Sequence
  Description of Artificial Sequence: Synthetic polypeptide
  VH of XENP018684
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYKGNYGGYFDVWGAGTLVTVSS

SEQ ID NO: 8008 - protein, 107 aa, Artificial Sequence; identical to SEQ ID NO: 6247
  Description of Artificial Sequence: Synthetic polypeptide
  VL of XENP018684

SEQ ID NO: 8009 - protein, 5 aa, Artificial Sequence
  Description of Artificial Sequence: Synthetic peptide
  XENP018684 vhCDR1
NYWMN

SEQ ID NO: 8010 - protein, 19 aa, Artificial Sequence
  Description of Artificial Sequence: Synthetic peptide
  XENP018684 vhCDR2
EIRLKSNNYATHYAEPVKG

SEQ ID NO: 8011 - protein, 11 aa, Artificial Sequence
  Description of Artificial Sequence: Synthetic peptide
  XENP018684 vhCDR3
YKGNYGGYFDV

SEQ ID NO: 8012 - protein, 11 aa, Artificial Sequence
  Description of Artificial Sequence: Synthetic peptide
  XENP018684 vlCDR1
RASQSVSNDVA

SEQ ID NO: 8013 - protein, 7 aa, Artificial Sequence
  Description of Artificial Sequence: Synthetic peptide
  XENP018684 vlCDR2
YASHRYT

SEQ ID NO: 8014 - protein, 9 aa, Artificial Sequence
  Description of Artificial Sequence: Synthetic peptide
  XENP018684 vlCDR3
QQDYSSPRT

SEQ ID NO: 8015 - protein, 249 aa, Artificial Sequence
  Description of Artificial Sequence: Synthetic polypeptide
  XENP018685 1G6_H1.185_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYANYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8016 - protein, 122 aa, Artificial Sequence
  Description of Artificial Sequence: Synthetic polypeptide
  VH of XENP018685
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYANYGGYFDVWGAGTLVTVSS

SEQ ID NO: 8017 - protein, 107 aa, Artificial Sequence; identical to SEQ ID NO: 6247
  Description of Artificial Sequence: Synthetic polypeptide
  VL of XENP018685

SEQ ID NO: 8018 - protein, 5 aa, Artificial Sequence
  Description of Artificial Sequence: Synthetic peptide
  XENP018685 vhCDR1
NYWMN

SEQ ID NO: 8019 - protein, 19 aa, Artificial Sequence
  Description of Artificial Sequence: Synthetic peptide
  XENP018685 vhCDR2
EIRLKSNNYATHYAEPVKG

SEQ ID NO: 8020 - protein, 11 aa, Artificial Sequence
  Description of Artificial Sequence: Synthetic peptide
  XENP018685 vhCDR3
YYANYGGYFDV

SEQ ID NO: 8021 - protein, 11 aa, Artificial Sequence
  Description of Artificial Sequence: Synthetic peptide
  XENP018685 vlCDR1
RASQSVSNDVA

SEQ ID NO: 8022 - protein, 7 aa, Artificial Sequence
  Description of Artificial Sequence: Synthetic peptide
  XENP018685 vlCDR2
YASHRYT

SEQ ID NO: 8023 - protein, 9 aa, Artificial Sequence
  Description of Artificial Sequence: Synthetic peptide
  XENP018685 vlCDR3
QQDYSSPRT

SEQ ID NO: 8024 - protein, 249 aa, Artificial Sequence
  Description of Artificial Sequence: Synthetic polypeptide
  XENP018686 1G6_H1.186_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYSNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8025 - protein, 122 aa, Artificial Sequence
  Description of Artificial Sequence: Synthetic polypeptide
  VH of XENP018686
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYSNYGGYFDVWGAGTLVTVSS

SEQ ID NO: 8026 - protein, 107 aa, Artificial Sequence; identical to SEQ ID NO: 6247
  Description of Artificial Sequence: Synthetic polypeptide
  VL of XENP018686

SEQ ID NO: 8027 - protein, 5 aa, Artificial Sequence
  Description of Artificial Sequence: Synthetic peptide
  XENP018686 vhCDR1
NYWMN

SEQ ID NO: 8028 - protein, 19 aa, Artificial Sequence
  Description of Artificial Sequence: Synthetic peptide
  XENP018686 vhCDR2
EIRLKSNNYATHYAEPVKG

SEQ ID NO: 8029 - protein, 11 aa, Artificial Sequence
  Description of Artificial Sequence: Synthetic peptide
  XENP018686 vhCDR3
YYSNYGGYFDV

SEQ ID NO: 8030 - protein, 11 aa, Artificial Sequence
  Description of Artificial Sequence: Synthetic peptide
  XENP018686 vlCDR1
RASQSVSNDVA

SEQ ID NO: 8031 - protein, 7 aa, Artificial Sequence
  Description of Artificial Sequence: Synthetic peptide
  XENP018686 vlCDR2
YASHRYT

SEQ ID NO: 8032 - protein, 9 aa, Artificial Sequence
  Description of Artificial Sequence: Synthetic peptide
  XENP018686 vlCDR3
QQDYSSPRT

SEQ ID NO: 8033 - protein, 249 aa, Artificial Sequence
  Description of Artificial Sequence: Synthetic polypeptide
  XENP018687 1G6_H1.187_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYTNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8034 - protein, 122 aa, Artificial Sequence
  Description of Artificial Sequence: Synthetic polypeptide
  VH of XENP018687
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYTNYGGYFDVWGAGTLVTVSS

SEQ ID NO: 8035 - protein, 107 aa, Artificial Sequence; identical to SEQ ID NO: 6247
  Description of Artificial Sequence: Synthetic polypeptide
  VL of XENP018687

SEQ ID NO: 8036 - protein, 5 aa, Artificial Sequence
  Description of Artificial Sequence: Synthetic peptide
  XENP018687 vhCDR1
NYWMN

SEQ ID NO: 8037 - protein, 19 aa, Artificial Sequence
  Description of Artificial Sequence: Synthetic peptide
  XENP018687 vhCDR2
EIRLKSNNYATHYAEPVKG

SEQ ID NO: 8038 - protein, 11 aa, Artificial Sequence
  Description of Artificial Sequence: Synthetic peptide
  XENP018687 vhCDR3
YYTNYGGYFDV

SEQ ID NO: 8039 - protein, 11 aa, Artificial Sequence
  Description of Artificial Sequence: Synthetic peptide
  XENP018687 vlCDR1
RASQSVSNDVA

SEQ ID NO: 8040 - protein, 7 aa, Artificial Sequence
  Description of Artificial Sequence: Synthetic peptide
  XENP018687 vlCDR2
YASHRYT

SEQ ID NO: 8041 - protein, 9 aa, Artificial Sequence
  Description of Artificial Sequence: Synthetic peptide
  XENP018687 vlCDR3
QQDYSSPRT

SEQ ID NO: 8042 - protein, 249 aa, Artificial Sequence
  Description of Artificial Sequence: Synthetic polypeptide
  XENP018688 1G6_H1.188_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYQNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8043 - protein, 122 aa, Artificial Sequence
  Description of Artificial Sequence: Synthetic polypeptide
  VH of XENP018688
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYQNYGGYFDVWGAGTLVTVSS

SEQ ID NO: 8044 - protein, 107 aa, Artificial Sequence; identical to SEQ ID NO: 6247
  Description of Artificial Sequence: Synthetic polypeptide
  VL of XENP018688

SEQ ID NO: 8045 - protein, 5 aa, Artificial Sequence
  Description of Artificial Sequence: Synthetic peptide
  XENP018688 vhCDR1
NYWMN

SEQ ID NO: 8046 - protein, 19 aa, Artificial Sequence
  Description of Artificial Sequence: Synthetic peptide
  XENP018688 vhCDR2
EIRLKSNNYATHYAEPVKG

SEQ ID NO: 8047 - protein, 11 aa, Artificial Sequence
  Description of Artificial Sequence: Synthetic peptide
  XENP018688 vhCDR3
YYQNYGGYFDV

SEQ ID NO: 8048 - protein, 11 aa, Artificial Sequence
  Description of Artificial Sequence: Synthetic peptide
  XENP018688 vlCDR1
RASQSVSNDVA

SEQ ID NO: 8049 - protein, 7 aa, Artificial Sequence
  Description of Artificial Sequence: Synthetic peptide
  XENP018688 vlCDR2
YASHRYT

SEQ ID NO: 8050 - protein, 9 aa, Artificial Sequence
  Description of Artificial Sequence: Synthetic peptide
  XENP018688 vlCDR3
QQDYSSPRT

SEQ ID NO: 8051 - protein, 249 aa, Artificial Sequence
  Description of Artificial Sequence: Synthetic polypeptide
  XENP018689 1G6_H1.189_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYHNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8052 - protein, 122 aa, Artificial Sequence
  Description of Artificial Sequence: Synthetic polypeptide
  VH of XENP018689
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYHNYGGYFDVWGAGTLVTVSS

SEQ ID NO: 8053 - protein, 107 aa, Artificial Sequence; identical to SEQ ID NO: 6247
  Description of Artificial Sequence: Synthetic polypeptide
  VL of XENP018689

SEQ ID NO: 8054 - protein, 5 aa, Artificial Sequence
  Description of Artificial Sequence: Synthetic peptide
  XENP018689 vhCDR1
NYWMN

SEQ ID NO: 8055 - protein, 19 aa, Artificial Sequence
  Description of Artificial Sequence: Synthetic peptide
  XENP018689 vhCDR2
EIRLKSNNYATHYAEPVKG

SEQ ID NO: 8056 - protein, 11 aa, Artificial Sequence
  Description of Artificial Sequence: Synthetic peptide
  XENP018689 vhCDR3
YYHNYGGYFDV

SEQ ID NO: 8057 - protein, 11 aa, Artificial Sequence
  Description of Artificial Sequence: Synthetic peptide
  XENP018689 vlCDR1
RASQSVSNDVA

SEQ ID NO: 8058 - protein, 7 aa, Artificial Sequence
  Description of Artificial Sequence: Synthetic peptide
  XENP018689 vlCDR2
YASHRYT

SEQ ID NO: 8059 - protein, 9 aa, Artificial Sequence
  Description of Artificial Sequence: Synthetic peptide
  XENP018689 vlCDR3
QQDYSSPRT

SEQ ID NO: 8060 - protein, 249 aa, Artificial Sequence
  Description of Artificial Sequence: Synthetic polypeptide
  XENP018690 1G6_H1.190_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYDNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8061 - protein, 122 aa, Artificial Sequence
  Description of Artificial Sequence: Synthetic polypeptide
  VH of XENP018690
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYDNYGGYFDVWGAGTLVTVSS

SEQ ID NO: 8062 - protein, 107 aa, Artificial Sequence; identical to SEQ ID NO: 6247
  Description of Artificial Sequence: Synthetic polypeptide
  VL of XENP018690

SEQ ID NO: 8063 - protein, 5 aa, Artificial Sequence
  Description of Artificial Sequence: Synthetic peptide
  XENP018690 vhCDR1
NYWMN

SEQ ID NO: 8064 - protein, 19 aa, Artificial Sequence
  Description of Artificial Sequence: Synthetic peptide
  XENP018690 vhCDR2
EIRLKSNNYATHYAEPVKG

SEQ ID NO: 8065 - protein, 11 aa, Artificial Sequence
  Description of Artificial Sequence: Synthetic peptide
  XENP018690 vhCDR3
YYDNYGGYFDV

SEQ ID NO: 8066 - protein, 11 aa, Artificial Sequence
  Description of Artificial Sequence: Synthetic peptide
  XENP018690 vlCDR1
RASQSVSNDVA

SEQ ID NO: 8067 - protein, 7 aa, Artificial Sequence
  Description of Artificial Sequence: Synthetic peptide
  XENP018690 vlCDR2
YASHRYT

SEQ ID NO: 8068 - protein, 9 aa, Artificial Sequence
  Description of Artificial Sequence: Synthetic peptide
  XENP018690 vlCDR3
QQDYSSPRT

SEQ ID NO: 8069 - protein, 249 aa, Artificial Sequence
  Description of Artificial Sequence: Synthetic polypeptide
  XENP018691 1G6_H1.191_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYKNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8070 - protein, 122 aa, Artificial Sequence
  Description of Artificial Sequence: Synthetic polypeptide
  VH of XENP018691
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYKNYGGYFDVWGAGTLVTVSS

SEQ ID NO: 8071 - protein, 107 aa, Artificial Sequence; identical to SEQ ID NO: 6247
  Description of Artificial Sequence: Synthetic polypeptide
  VL of XENP018691

SEQ ID NO: 8072 - protein, 5 aa, Artificial Sequence
  Description of Artificial Sequence: Synthetic peptide
  XENP018691 vhCDR1
NYWMN

SEQ ID NO: 8073 - protein, 19 aa, Artificial Sequence
  Description of Artificial Sequence: Synthetic peptide
  XENP018691 vhCDR2
EIRLKSNNYATHYAEPVKG

SEQ ID NO: 8074 - protein, 11 aa, Artificial Sequence
  Description of Artificial Sequence: Synthetic peptide
  XENP018691 vhCDR3
YYKNYGGYFDV

SEQ ID NO: 8075 - protein, 11 aa, Artificial Sequence
  Description of Artificial Sequence: Synthetic peptide
  XENP018691 vlCDR1
RASQSVSNDVA

SEQ ID NO: 8076 - protein, 7 aa, Artificial Sequence
  Description of Artificial Sequence: Synthetic peptide
  XENP018691 vlCDR2
YASHRYT

SEQ ID NO: 8077 - protein, 9 aa, Artificial Sequence
  Description of Artificial Sequence: Synthetic peptide
  XENP018691 vlCDR3
QQDYSSPRT

SEQ ID NO: 8078 - protein, 249 aa, Artificial Sequence
  Description of Artificial Sequence: Synthetic polypeptide
  XENP018692 1G6_H1.192_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYLNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8079 - protein, 122 aa, Artificial Sequence
  Description of Artificial Sequence: Synthetic polypeptide
  VH of XENP018692
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYLNYGGYFDVWGAGTLVTVSS

SEQ ID NO: 8080 - protein, 107 aa, Artificial Sequence; identical to SEQ ID NO: 6247
  Description of Artificial Sequence: Synthetic polypeptide
  VL of XENP018692

SEQ ID NO: 8081 - protein, 5 aa, Artificial Sequence
  Description of Artificial Sequence: Synthetic peptide
  XENP018692 vhCDR1
NYWMN

SEQ ID NO: 8082 - protein, 19 aa, Artificial Sequence
  Description of Artificial Sequence: Synthetic peptide
  XENP018692 vhCDR2
EIRLKSNNYATHYAEPVKG

SEQ ID NO: 8083 - protein, 11 aa, Artificial Sequence
  Description of Artificial Sequence: Synthetic peptide
  XENP018692 vhCDR3
YYLNYGGYFDV

SEQ ID NO: 8084 - protein, 11 aa, Artificial Sequence
  Description of Artificial Sequence: Synthetic peptide
  XENP018692 vlCDR1
RASQSVSNDVA

SEQ ID NO: 8085 - protein, 7 aa, Artificial Sequence
  Description of Artificial Sequence: Synthetic peptide
  XENP018692 vlCDR2
YASHRYT

SEQ ID NO: 8086 - protein, 9 aa, Artificial Sequence
  Description of Artificial Sequence: Synthetic peptide
  XENP018692 vlCDR3
QQDYSSPRT

SEQ ID NO: 8087 - protein, 249 aa, Artificial Sequence
  Description of Artificial Sequence: Synthetic polypeptide
  XENP018693 1G6_H1.193_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYFNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8088 - protein, 122 aa, Artificial Sequence
  Description of Artificial Sequence: Synthetic polypeptide
  VH of XENP018693
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYFNYGGYFDVWGAGTLVTVSS

SEQ ID NO: 8089 - protein, 107 aa, Artificial Sequence; identical to SEQ ID NO: 6247
  Description of Artificial Sequence: Synthetic polypeptide
  VL of XENP018693

SEQ ID NO: 8090 - protein, 5 aa, Artificial Sequence
  Description of Artificial Sequence: Synthetic peptide
  XENP018693 vhCDR1
NYWMN

SEQ ID NO: 8091 - protein, 19 aa, Artificial Sequence
  Description of Artificial Sequence: Synthetic peptide
  XENP018693 vhCDR2
EIRLKSNNYATHYAEPVKG

SEQ ID NO: 8092 - protein, 11 aa, Artificial Sequence
  Description of Artificial Sequence: Synthetic peptide
  XENP018693 vhCDR3
YYFNYGGYFDV

SEQ ID NO: 8093 - protein, 11 aa, Artificial Sequence
  Description of Artificial Sequence: Synthetic peptide
  XENP018693 vlCDR1
RASQSVSNDVA

SEQ ID NO: 8094 - protein, 7 aa, Artificial Sequence
  Description of Artificial Sequence: Synthetic peptide
  XENP018693 vlCDR2
YASHRYT

SEQ ID NO: 8095 - protein, 9 aa, Artificial Sequence
  Description of Artificial Sequence: Synthetic peptide
  XENP018693 vlCDR3
QQDYSSPRT

SEQ ID NO: 8096 - protein, 249 aa, Artificial Sequence
  Description of Artificial Sequence: Synthetic polypeptide
  XENP018694 1G6_H1.194_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGDYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8097 - protein, 122 aa, Artificial Sequence
  Description of Artificial Sequence: Synthetic polypeptide
  VH of XENP018694
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGDYGGYFDVWGAGTLVTVSS

SEQ ID NO: 8098 - protein, 107 aa, Artificial Sequence; identical to SEQ ID NO: 6247
  Description of Artificial Sequence: Synthetic polypeptide
  VL of XENP018694

SEQ ID NO: 8099 - protein, 5 aa, Artificial Sequence
  Description of Artificial Sequence: Synthetic peptide
  XENP018694 vhCDR1
NYWMN

SEQ ID NO: 8100 - protein, 19 aa, Artificial Sequence
  Description of Artificial Sequence: Synthetic peptide
  XENP018694 vhCDR2
EIRLKSNNYATHYAEPVKG

SEQ ID NO: 8101 - protein, 11 aa, Artificial Sequence
  Description of Artificial Sequence: Synthetic peptide
  XENP018694 vhCDR3
YYGDYGGYFDV

SEQ ID NO: 8102 - protein, 11 aa, Artificial Sequence
  Description of Artificial Sequence: Synthetic peptide
  XENP018694 vlCDR1
RASQSVSNDVA

SEQ ID NO: 8103 - protein, 7 aa, Artificial Sequence
  Description of Artificial Sequence: Synthetic peptide
  XENP018694 vlCDR2
YASHRYT

SEQ ID NO: 8104 - protein, 9 aa, Artificial Sequence
  Description of Artificial Sequence: Synthetic peptide
  XENP018694 vlCDR3
QQDYSSPRT

SEQ ID NO: 8105 - protein, 249 aa, Artificial Sequence
  Description of Artificial Sequence: Synthetic polypeptide
  XENP018695 1G6_H1.195_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGHYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8106 - protein, 122 aa, Artificial Sequence
  Description of Artificial Sequence: Synthetic polypeptide
  VH of XENP018695
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGHYGGYFDVWGAGTLVTVSS

SEQ ID NO: 8107 - protein, 107 aa, Artificial Sequence; identical to SEQ ID NO: 6247
  Description of Artificial Sequence: Synthetic polypeptide
  VL of XENP018695

SEQ ID NO: 8108 - protein, 5 aa, Artificial Sequence
  Description of Artificial Sequence: Synthetic peptide
  XENP018695 vhCDR1
NYWMN

SEQ ID NO: 8109 - protein, 19 aa, Artificial Sequence
  Description of Artificial Sequence: Synthetic peptide
  XENP018695 vhCDR2
EIRLKSNNYATHYAEPVKG

SEQ ID NO: 8110 - protein, 11 aa, Artificial Sequence
  Description of Artificial Sequence: Synthetic peptide
  XENP018695 vhCDR3
YYGHYGGYFDV

SEQ ID NO: 8111 - protein, 11 aa, Artificial Sequence
  Description of Artificial Sequence: Synthetic peptide
  XENP018695 vlCDR1
RASQSVSNDVA

SEQ ID NO: 8112 - protein, 7 aa, Artificial Sequence
  Description of Artificial Sequence: Synthetic peptide
  XENP018695 vlCDR2
YASHRYT

SEQ ID NO: 8113 - protein, 9 aa, Artificial Sequence
  Description of Artificial Sequence: Synthetic peptide
  XENP018695 vlCDR3
QQDYSSPRT

SEQ ID NO: 8114 - protein, 249 aa, Artificial Sequence
  Description of Artificial Sequence: Synthetic polypeptide
  XENP018696 1G6_H1.196_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGEYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8115 - protein, 122 aa, Artificial Sequence
  Description of Artificial Sequence: Synthetic polypeptide
  VH of XENP018696
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGEYGGYFDVWGAGTLVTVSS

SEQ ID NO: 8116 - protein, 107 aa, Artificial Sequence; identical to SEQ ID NO: 6247
  Description of Artificial Sequence: Synthetic polypeptide
  VL of XENP018696

SEQ ID NO: 8117 - protein, 5 aa, Artificial Sequence
  Description of Artificial Sequence: Synthetic peptide
  XENP018696 vhCDR1
NYWMN

SEQ ID NO: 8118 - protein, 19 aa, Artificial Sequence
  Description of Artificial Sequence: Synthetic peptide
  XENP018696 vhCDR2
EIRLKSNNYATHYAEPVKG

SEQ ID NO: 8119 - protein, 11 aa, Artificial Sequence
  Description of Artificial Sequence: Synthetic peptide
  XENP018696 vhCDR3
YYGEYGGYFDV

SEQ ID NO: 8120 - protein, 11 aa, Artificial Sequence
  Description of Artificial Sequence: Synthetic peptide
  XENP018696 vlCDR1
RASQSVSNDVA

SEQ ID NO: 8121 - protein, 7 aa, Artificial Sequence
  Description of Artificial Sequence: Synthetic peptide
  XENP018696 vlCDR2
YASHRYT

SEQ ID NO: 8122 - protein, 9 aa, Artificial Sequence
  Description of Artificial Sequence: Synthetic peptide
  XENP018696 vlCDR3
QQDYSSPRT

SEQ ID NO: 8123 - protein, 249 aa, Artificial Sequence
  Description of Artificial Sequence: Synthetic polypeptide
  XENP018701 1G6_H1.197_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGSYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8124 - protein, 122 aa, Artificial Sequence
  Description of Artificial Sequence: Synthetic polypeptide
  VH of XENP018701
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGSYGGYFDVWGAGTLVTVSS

SEQ ID NO: 8125 - protein, 107 aa, Artificial Sequence; identical to SEQ ID NO: 6247
  Description of Artificial Sequence: Synthetic polypeptide
  VL of XENP018701

SEQ ID NO: 8126 - protein, 5 aa, Artificial Sequence
  Description of Artificial Sequence: Synthetic peptide
  XENP018701 vhCDR1
NYWMN

SEQ ID NO: 8127 - protein, 19 aa, Artificial Sequence
  Description of Artificial Sequence: Synthetic peptide
  XENP018701 vhCDR2
EIRLKSNNYATHYAEPVKG

SEQ ID NO: 8128 - protein, 11 aa, Artificial Sequence
  Description of Artificial Sequence: Synthetic peptide
  XENP018701 vhCDR3
YYGSYGGYFDV

SEQ ID NO: 8129 - protein, 11 aa, Artificial Sequence
  Description of Artificial Sequence: Synthetic peptide
  XENP018701 vlCDR1
RASQSVSNDVA

SEQ ID NO: 8130 - protein, 7 aa, Artificial Sequence
  Description of Artificial Sequence: Synthetic peptide
  XENP018701 vlCDR2
YASHRYT

SEQ ID NO: 8131 - protein, 9 aa, Artificial Sequence
  Description of Artificial Sequence: Synthetic peptide
  XENP018701 vlCDR3
QQDYSSPRT

SEQ ID NO: 8132 - protein, 249 aa, Artificial Sequence
  Description of Artificial Sequence: Synthetic polypeptide
  XENP018702 1G6_H1.198_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGRYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8133 - protein, 122 aa, Artificial Sequence
  Description of Artificial Sequence: Synthetic polypeptide
  VH of XENP018702
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGRYGGYFDVWGAGTLVTVSS

SEQ ID NO: 8134 - protein, 107 aa, Artificial Sequence; identical to SEQ ID NO: 6247
  Description of Artificial Sequence: Synthetic polypeptide
  VL of XENP018702

SEQ ID NO: 8135 - protein, 5 aa, Artificial Sequence
  Description of Artificial Sequence: Synthetic peptide
  XENP018702 vhCDR1
NYWMN

SEQ ID NO: 8136 - protein, 19 aa, Artificial Sequence
  Description of Artificial Sequence: Synthetic peptide
  XENP018702 vhCDR2
EIRLKSNNYATHYAEPVKG

SEQ ID NO: 8137 - protein, 11 aa, Artificial Sequence
  Description of Artificial Sequence: Synthetic peptide
  XENP018702 vhCDR3
YYGRYGGYFDV

SEQ ID NO: 8138 - protein, 11 aa, Artificial Sequence
  Description of Artificial Sequence: Synthetic peptide
  XENP018702 vlCDR1
RASQSVSNDVA

SEQ ID NO: 8139 - protein, 7 aa, Artificial Sequence
  Description of Artificial Sequence: Synthetic peptide
  XENP018702 vlCDR2
YASHRYT

SEQ ID NO: 8140 - protein, 9 aa, Artificial Sequence
  Description of Artificial Sequence: Synthetic peptide
  XENP018702 vlCDR3
QQDYSSPRT

SEQ ID NO: 8141 - protein, 249 aa, Artificial Sequence
  Description of Artificial Sequence: Synthetic polypeptide
  XENP018703 1G6_H1.199_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGLYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8142 - protein, 122 aa, Artificial Sequence
  Description of Artificial Sequence: Synthetic polypeptide
  VH of XENP018703
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGLYGGYFDVWGAGTLVTVSS

SEQ ID NO: 8143 - protein, 107 aa, Artificial Sequence; identical to SEQ ID NO: 6247
  Description of Artificial Sequence: Synthetic polypeptide
  VL of XENP018703

SEQ ID NO: 8144 - protein, 5 aa, Artificial Sequence
  Description of Artificial Sequence: Synthetic peptide
  XENP018703 vhCDR1
NYWMN

SEQ ID NO: 8145 - protein, 19 aa, Artificial Sequence
  Description of Artificial Sequence: Synthetic peptide
  XENP018703 vhCDR2
EIRLKSNNYATHYAEPVKG

SEQ ID NO: 8146 - protein, 11 aa, Artificial Sequence
  Description of Artificial Sequence: Synthetic peptide
  XENP018703 vhCDR3
YYGLYGGYFDV

SEQ ID NO: 8147 - protein, 11 aa, Artificial Sequence
  Description of Artificial Sequence: Synthetic peptide
  XENP018703 vlCDR1
RASQSVSNDVA

SEQ ID NO: 8148 - protein, 7 aa, Artificial Sequence
  Description of Artificial Sequence: Synthetic peptide
  XENP018703 vlCDR2
YASHRYT

SEQ ID NO: 8149 - protein, 9 aa, Artificial Sequence
  Description of Artificial Sequence: Synthetic peptide
  XENP018703 vlCDR3
QQDYSSPRT

SEQ ID NO: 8150 - protein, 249 aa, Artificial Sequence
  Description of Artificial Sequence: Synthetic polypeptide
  XENP018704 1G6_H1.200_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGTYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8151 - protein, 122 aa, Artificial Sequence
  Description of Artificial Sequence: Synthetic polypeptide
  VH of XENP018704
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGTYGGYFDVWGAGTLVTVSS

SEQ ID NO: 8152 - protein, 107 aa, Artificial Sequence; identical to SEQ ID NO: 6247
  Description of Artificial Sequence: Synthetic polypeptide
  VL of XENP018704

SEQ ID NO: 8153 - protein, 5 aa, Artificial Sequence
  Description of Artificial Sequence: Synthetic peptide
  XENP018704 vhCDR1
NYWMN

SEQ ID NO: 8154 - protein, 19 aa, Artificial Sequence
  Description of Artificial Sequence: Synthetic peptide
  XENP018704 vhCDR2
EIRLKSNNYATHYAEPVKG

SEQ ID NO: 8155 - protein, 11 aa, Artificial Sequence
  Description of Artificial Sequence: Synthetic peptide
  XENP018704 vhCDR3
YYGTYGGYFDV

SEQ ID NO: 8156 - protein, 11 aa, Artificial Sequence
  Description of Artificial Sequence: Synthetic peptide
  XENP018704 vlCDR1
RASQSVSNDVA

SEQ ID NO: 8157 - protein, 7 aa, Artificial Sequence
  Description of Artificial Sequence: Synthetic peptide
  XENP018704 vlCDR2
YASHRYT

SEQ ID NO: 8158 - protein, 9 aa, Artificial Sequence
  Description of Artificial Sequence: Synthetic peptide
  XENP018704 vlCDR3
QQDYSSPRT

SEQ ID NO: 8159 - protein, 249 aa, Artificial Sequence
  Description of Artificial Sequence: Synthetic polypeptide
  XENP018705 1G6_H1.201_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGGYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8160 - protein, 122 aa, Artificial Sequence
  Description of Artificial Sequence: Synthetic polypeptide
  VH of XENP018705
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGGYGGYFDVWGAGTLVTVSS

SEQ ID NO: 8161 - protein, 107 aa, Artificial Sequence; identical to SEQ ID NO: 6247
  Description of Artificial Sequence: Synthetic polypeptide
  VL of XENP018705

SEQ ID NO: 8162 - protein, 5 aa, Artificial Sequence
  Description of Artificial Sequence: Synthetic peptide
  XENP018705 vhCDR1
NYWMN

SEQ ID NO: 8163 - protein, 19 aa, Artificial Sequence
  Description of Artificial Sequence: Synthetic peptide
  XENP018705 vhCDR2
EIRLKSNNYATHYAEPVKG

SEQ ID NO: 8164 - protein, 11 aa, Artificial Sequence
  Description of Artificial Sequence: Synthetic peptide
  XENP018705 vhCDR3
YYGGYGGYFDV

SEQ ID NO: 8165 - protein, 11 aa, Artificial Sequence
  Description of Artificial Sequence: Synthetic peptide
  XENP018705 vlCDR1
RASQSVSNDVA

SEQ ID NO: 8166 - protein, 7 aa, Artificial Sequence
  Description of Artificial Sequence: Synthetic peptide
  XENP018705 vlCDR2
YASHRYT

SEQ ID NO: 8167 - protein, 9 aa, Artificial Sequence
  Description of Artificial Sequence: Synthetic peptide
  XENP018705 vlCDR3
QQDYSSPRT

SEQ ID NO: 8168 - protein, 249 aa, Artificial Sequence
  Description of Artificial Sequence: Synthetic polypeptide
  XENP018706 1G6_H1.202_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGFYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8169 - protein, 122 aa, Artificial Sequence
  Description of Artificial Sequence: Synthetic polypeptide
  VH of XENP018706
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGFYGGYFDVWGAGTLVTVSS

SEQ ID NO: 8170 - protein, 107 aa, Artificial Sequence; identical to SEQ ID NO: 6247
  Description of Artificial Sequence: Synthetic polypeptide
  VL of XENP018706

SEQ ID NO: 8171 - protein, 5 aa, Artificial Sequence
  Description of Artificial Sequence: Synthetic peptide
  XENP018706 vhCDR1
NYWMN

SEQ ID NO: 8172 - protein, 19 aa, Artificial Sequence
  Description of Artificial Sequence: Synthetic peptide
  XENP018706 vhCDR2
EIRLKSNNYATHYAEPVKG

SEQ ID NO: 8173 - protein, 11 aa, Artificial Sequence
  Description of Artificial Sequence: Synthetic peptide
  XENP018706 vhCDR3
YYGFYGGYFDV

SEQ ID NO: 8174 - protein, 11 aa, Artificial Sequence
  Description of Artificial Sequence: Synthetic peptide
  XENP018706 vlCDR1
RASQSVSNDVA

SEQ ID NO: 8175 - protein, 7 aa, Artificial Sequence
  Description of Artificial Sequence: Synthetic peptide
  XENP018706 vlCDR2
YASHRYT

SEQ ID NO: 8176 - protein, 9 aa, Artificial Sequence
  Description of Artificial Sequence: Synthetic peptide
  XENP018706 vlCDR3
QQDYSSPRT

SEQ ID NO: 8177 - protein, 249 aa, Artificial Sequence
  Description of Artificial Sequence: Synthetic polypeptide
  XENP018707 1G6_H1.203_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNFGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8178 - protein, 122 aa, Artificial Sequence
  Description of Artificial Sequence: Synthetic polypeptide
  VH of XENP018707
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNFGGYFDVWGAGTLVTVSS

SEQ ID NO: 8179 - protein, 107 aa, Artificial Sequence; identical to SEQ ID NO: 6247
  Description of Artificial Sequence: Synthetic polypeptide
  VL of XENP018707

SEQ ID NO: 8180 - protein, 5 aa, Artificial Sequence
  Description of Artificial Sequence: Synthetic peptide
  XENP018707 vhCDR1
NYWMN

SEQ ID NO: 8181 - protein, 19 aa, Artificial Sequence
  Description of Artificial Sequence: Synthetic peptide
  XENP018707 vhCDR2
EIRLKSNNYATHYAEPVKG

SEQ ID NO: 8182 - protein, 11 aa, Artificial Sequence
  Description of Artificial Sequence: Synthetic peptide
  XENP018707 vhCDR3
YYGNFGGYFDV

SEQ ID NO: 8183 - protein, 11 aa, Artificial Sequence
  Description of Artificial Sequence: Synthetic peptide
  XENP018707 vlCDR1
RASQSVSNDVA

SEQ ID NO: 8184 - protein, 7 aa, Artificial Sequence
  Description of Artificial Sequence: Synthetic peptide
  XENP018707 vlCDR2
YASHRYT

SEQ ID NO: 8185 - protein, 9 aa, Artificial Sequence
  Description of Artificial Sequence: Synthetic peptide
  XENP018707 vlCDR3
QQDYSSPRT

SEQ ID NO: 8186 - protein, 249 aa, Artificial Sequence
  Description of Artificial Sequence: Synthetic polypeptide
  XENP018708 1G6_H1.204_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNHGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8187 - protein, 122 aa, Artificial Sequence
  Description of Artificial Sequence: Synthetic polypeptide
  VH of XENP018708
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNHGGYFDVWGAGTLVTVSS

SEQ ID NO: 8188 - protein, 107 aa, Artificial Sequence; identical to SEQ ID NO: 6247
  Description of Artificial Sequence: Synthetic polypeptide
  VL of XENP018708

SEQ ID NO: 8189 - protein, 5 aa, Artificial Sequence
  Description of Artificial Sequence: Synthetic peptide
  XENP018708 vhCDR1
NYWMN

SEQ ID NO: 8190 - protein, 19 aa, Artificial Sequence
  Description of Artificial Sequence: Synthetic peptide
  XENP018708 vhCDR2
EIRLKSNNYATHYAEPVKG

SEQ ID NO: 8191 - protein, 11 aa, Artificial Sequence
  Description of Artificial Sequence: Synthetic peptide
  XENP018708 vhCDR3
YYGNHGGYFDV

SEQ ID NO: 8192 - protein, 11 aa, Artificial Sequence
  Description of Artificial Sequence: Synthetic peptide
  XENP018708 vlCDR1
RASQSVSNDVA

SEQ ID NO: 8193 - protein, 7 aa, Artificial Sequence
  Description of Artificial Sequence: Synthetic peptide
  XENP018708 vlCDR2
YASHRYT

SEQ ID NO: 8194 - protein, 9 aa, Artificial Sequence
  Description of Artificial Sequence: Synthetic peptide
  XENP018708 vlCDR3
QQDYSSPRT

SEQ ID NO: 8195 - protein, 249 aa, Artificial Sequence
  Description of Artificial Sequence: Synthetic polypeptide
  XENP018709 1G6_H1.205_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNLGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8196 - protein, 122 aa, Artificial Sequence
  Description of Artificial Sequence: Synthetic polypeptide
  VH of XENP018709
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNLGGYFDVWGAGTLVTVSS

SEQ ID NO: 8197 - protein, 107 aa, Artificial Sequence; identical to SEQ ID NO: 6247
  Description of Artificial Sequence: Synthetic polypeptide
  VL of XENP018709

SEQ ID NO: 8198 - protein, 5 aa, Artificial Sequence
  Description of Artificial Sequence: Synthetic peptide
  XENP018709 vhCDR1
NYWMN

SEQ ID NO: 8199 - protein, 19 aa, Artificial Sequence
  Description of Artificial Sequence: Synthetic peptide
  XENP018709 vhCDR2
EIRLKSNNYATHYAEPVKG

SEQ ID NO: 8200 - protein, 11 aa, Artificial Sequence
  Description of Artificial Sequence: Synthetic peptide
  XENP018709 vhCDR3
YYGNLGGYFDV

SEQ ID NO: 8201 - protein, 11 aa, Artificial Sequence
  Description of Artificial Sequence: Synthetic peptide
  XENP018709 vlCDR1
RASQSVSNDVA

SEQ ID NO: 8202 - protein, 7 aa, Artificial Sequence
  Description of Artificial Sequence: Synthetic peptide
  XENP018709 vlCDR2
YASHRYT

SEQ ID NO: 8203 - protein, 9 aa, Artificial Sequence
  Description of Artificial Sequence: Synthetic peptide
  XENP018709 vlCDR3
QQDYSSPRT

SEQ ID NO: 8204 - protein, 249 aa, Artificial Sequence
  Description of Artificial Sequence: Synthetic polypeptide
  XENP018710 1G6_H1.206_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNWGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8205 - protein, 122 aa, Artificial Sequence
  Description of Artificial Sequence: Synthetic polypeptide
  VH of XENP018710
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNWGGYFDVWGAGTLVTVSS

SEQ ID NO: 8206 - protein, 107 aa, Artificial Sequence; identical to SEQ ID NO: 6247
  Description of Artificial Sequence: Synthetic polypeptide
  VL of XENP018710

SEQ ID NO: 8207 - protein, 5 aa, Artificial Sequence
  Description of Artificial Sequence: Synthetic peptide
  XENP018710 vhCDR1
NYWMN

SEQ ID NO: 8208 - protein, 19 aa, Artificial Sequence
  Description of Artificial Sequence: Synthetic peptide
  XENP018710 vhCDR2
EIRLKSNNYATHYAEPVKG

SEQ ID NO: 8209 - protein, 11 aa, Artificial Sequence
  Description of Artificial Sequence: Synthetic peptide
  XENP018710 vhCDR3
YYGNWGGYFDV

SEQ ID NO: 8210 - protein, 11 aa, Artificial Sequence
  Description of Artificial Sequence: Synthetic peptide
  XENP018710 vlCDR1
RASQSVSNDVA

SEQ ID NO: 8211 - protein, 7 aa, Artificial Sequence
  Description of Artificial Sequence: Synthetic peptide
  XENP018710 vlCDR2
YASHRYT

SEQ ID NO: 8212 - protein, 9 aa, Artificial Sequence
  Description of Artificial Sequence: Synthetic peptide
  XENP018710 vlCDR3
QQDYSSPRT

SEQ ID NO: 8213 - protein, 249 aa, Artificial Sequence
  Description of Artificial Sequence: Synthetic polypeptide
  XENP018711 1G6_H1.207_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNVGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8214 - protein, 122 aa, Artificial Sequence
  Description of Artificial Sequence: Synthetic polypeptide
  VH of XENP018711
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNVGGYFDVWGAGTLVTVSS

SEQ ID NO: 8215 - protein, 107 aa, Artificial Sequence; identical to SEQ ID NO: 6247
  Description of Artificial Sequence: Synthetic polypeptide
  VL of XENP018711

SEQ ID NO: 8216 - protein, 5 aa, Artificial Sequence
  Description of Artificial Sequence: Synthetic peptide
  XENP018711 vhCDR1
NYWMN

SEQ ID NO: 8217 - protein, 19 aa, Artificial Sequence
  Description of Artificial Sequence: Synthetic peptide
  XENP018711 vhCDR2
EIRLKSNNYATHYAEPVKG

SEQ ID NO: 8218 - protein, 11 aa, Artificial Sequence
  Description of Artificial Sequence: Synthetic peptide
  XENP018711 vhCDR3
YYGNVGGYFDV

SEQ ID NO: 8219 - protein, 11 aa, Artificial Sequence
  Description of Artificial Sequence: Synthetic peptide
  XENP018711 vlCDR1
RASQSVSNDVA

SEQ ID NO: 8220 - protein, 7 aa, Artificial Sequence
  Description of Artificial Sequence: Synthetic peptide
  XENP018711 vlCDR2
YASHRYT

SEQ ID NO: 8221 - protein, 9 aa, Artificial Sequence
  Description of Artificial Sequence: Synthetic peptide
  XENP018711 vlCDR3
QQDYSSPRT

SEQ ID NO: 8222 - protein, 249 aa, Artificial Sequence
  Description of Artificial Sequence: Synthetic polypeptide
  XENP018712 1G6_H1.208_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNAGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8223 - protein, 122 aa, Artificial Sequence
  Description of Artificial Sequence: Synthetic polypeptide
  VH of XENP018712
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNAGGYFDVWGAGTLVTVSS

SEQ ID NO: 8224 - protein, 107 aa, Artificial Sequence; identical to SEQ ID NO: 6247
  Description of Artificial Sequence: Synthetic polypeptide
  VL of XENP018712

SEQ ID NO: 8225 - protein, 5 aa, Artificial Sequence
  Description of Artificial Sequence: Synthetic peptide
  XENP018712 vhCDR1
NYWMN

SEQ ID NO: 8226 - protein, 19 aa, Artificial Sequence
  Description of Artificial Sequence: Synthetic peptide
  XENP018712 vhCDR2
EIRLKSNNYATHYAEPVKG

SEQ ID NO: 8227 - protein, 11 aa, Artificial Sequence
  Description of Artificial Sequence: Synthetic peptide
  XENP018712 vhCDR3
YYGNAGGYFDV

SEQ ID NO: 8228 - protein, 11 aa, Artificial Sequence
  Description of Artificial Sequence: Synthetic peptide
  XENP018712 vlCDR1
RASQSVSNDVA

SEQ ID NO: 8229 - protein, 7 aa, Artificial Sequence
  Description of Artificial Sequence: Synthetic peptide
  XENP018712 vlCDR2
YASHRYT

SEQ ID NO: 8230 - protein, 9 aa, Artificial Sequence
  Description of Artificial Sequence: Synthetic peptide
  XENP018712 vlCDR3
QQDYSSPRT

SEQ ID NO: 8231 - protein, 249 aa, Artificial Sequence
  Description of Artificial Sequence: Synthetic polypeptide
  XENP018713 1G6_H1.209_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNQGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8232 - protein, 122 aa, Artificial Sequence
  Description of Artificial Sequence: Synthetic polypeptide
  VH of XENP018713
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNQGGYFDVWGAGTLVTVSS

SEQ ID NO: 8233 - protein, 107 aa, Artificial Sequence; identical to SEQ ID NO: 6247
  Description of Artificial Sequence: Synthetic polypeptide
  VL of XENP018713

SEQ ID NO: 8234 - protein, 5 aa, Artificial Sequence
  Description of Artificial Sequence: Synthetic peptide
  XENP018713 vhCDR1
NYWMN

SEQ ID NO: 8235 - protein, 19 aa, Artificial Sequence
  Description of Artificial Sequence: Synthetic peptide
  XENP018713 vhCDR2
EIRLKSNNYATHYAEPVKG

SEQ ID NO: 8236 - protein, 11 aa, Artificial Sequence
  Description of Artificial Sequence: Synthetic peptide
  XENP018713 vhCDR3
YYGNQGGYFDV

SEQ ID NO: 8237 - protein, 11 aa, Artificial Sequence
  Description of Artificial Sequence: Synthetic peptide
  XENP018713 vlCDR1
RASQSVSNDVA

SEQ ID NO: 8238 - protein, 7 aa, Artificial Sequence
  Description of Artificial Sequence: Synthetic peptide
  XENP018713 vlCDR2
YASHRYT

SEQ ID NO: 8239 - protein, 9 aa, Artificial Sequence
  Description of Artificial Sequence: Synthetic peptide
  XENP018713 vlCDR3
QQDYSSPRT

SEQ ID NO: 8240 - protein, 249 aa, Artificial Sequence
  Description of Artificial Sequence: Synthetic polypeptide
  XENP018714 1G6_H1.210_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNEGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8241 - protein, 122 aa, Artificial Sequence
  Description of Artificial Sequence: Synthetic polypeptide
  VH of XENP018714
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNEGGYFDVWGAGTLVTVSS

SEQ ID NO: 8242 - protein, 107 aa, Artificial Sequence; identical to SEQ ID NO: 6247
  Description of Artificial Sequence: Synthetic polypeptide
  VL of XENP018714

SEQ ID NO: 8243 - protein, 5 aa, Artificial Sequence
  Description of Artificial Sequence: Synthetic peptide
  XENP018714 vhCDR1
NYWMN

SEQ ID NO: 8244 - protein, 19 aa, Artificial Sequence
  Description of Artificial Sequence: Synthetic peptide
  XENP018714 vhCDR2
EIRLKSNNYATHYAEPVKG

SEQ ID NO: 8245 - protein, 11 aa, Artificial Sequence
  Description of Artificial Sequence: Synthetic peptide
  XENP018714 vhCDR3
YYGNEGGYFDV

SEQ ID NO: 8246 - protein, 11 aa, Artificial Sequence
  Description of Artificial Sequence: Synthetic peptide
  XENP018714 vlCDR1
RASQSVSNDVA

SEQ ID NO: 8247 - protein, 7 aa, Artificial Sequence
  Description of Artificial Sequence: Synthetic peptide
  XENP018714 vlCDR2
YASHRYT

SEQ ID NO: 8248 - protein, 9 aa, Artificial Sequence
  Description of Artificial Sequence: Synthetic peptide
  XENP018714 vlCDR3
QQDYSSPRT

SEQ ID NO: 8249 - protein, 249 aa, Artificial Sequence
  Description of Artificial Sequence: Synthetic polypeptide
  XENP018715 1G6_H1.211_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNKGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8250 - protein, 122 aa, Artificial Sequence
  Description of Artificial Sequence: Synthetic polypeptide
  VH of XENP018715
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNKGGYFDVWGAGTLVTVSS

SEQ ID NO: 8251 - protein, 107 aa, Artificial Sequence; identical to SEQ ID NO: 6247
  Description of Artificial Sequence: Synthetic polypeptide
  VL of XENP018715

SEQ ID NO: 8252 - protein, 5 aa, Artificial Sequence
  Description of Artificial Sequence: Synthetic peptide
  XENP018715 vhCDR1
NYWMN

SEQ ID NO: 8253 - protein, 19 aa, Artificial Sequence
  Description of Artificial Sequence: Synthetic peptide
  XENP018715 vhCDR2
EIRLKSNNYATHYAEPVKG

SEQ ID NO: 8254 - protein, 11 aa, Artificial Sequence
  Description of Artificial Sequence: Synthetic peptide
  XENP018715 vhCDR3
YYGNKGGYFDV

SEQ ID NO: 8255 - protein, 11 aa, Artificial Sequence
  Description of Artificial Sequence: Synthetic peptide
  XENP018715 vlCDR1
RASQSVSNDVA

SEQ ID NO: 8256 - protein, 7 aa, Artificial Sequence
  Description of Artificial Sequence: Synthetic peptide
  XENP018715 vlCDR2
YASHRYT

SEQ ID NO: 8257 - protein, 9 aa, Artificial Sequence
  Description of Artificial Sequence: Synthetic peptide
  XENP018715 vlCDR3
QQDYSSPRT

SEQ ID NO: 8258 - protein, 249 aa, Artificial Sequence
  Description of Artificial Sequence: Synthetic polypeptide
  XENP018716 1G6_H1.212_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYAGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8259 - protein, 122 aa, Artificial Sequence
  Description of Artificial Sequence: Synthetic polypeptide
  VH of XENP018716
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYAGYFDVWGAGTLVTVSS

SEQ ID NO: 8260 - protein, 107 aa, Artificial Sequence; identical to SEQ ID NO: 6247
  Description of Artificial Sequence: Synthetic polypeptide
  VL of XENP018716

SEQ ID NO: 8261 - protein, 5 aa, Artificial Sequence
  Description of Artificial Sequence: Synthetic peptide
  XENP018716 vhCDR1
NYWMN

SEQ ID NO: 8262 - protein, 19 aa, Artificial Sequence
  Description of Artificial Sequence: Synthetic peptide
  XENP018716 vhCDR2
EIRLKSNNYATHYAEPVKG

SEQ ID NO: 8263 - protein, 11 aa, Artificial Sequence
  Description of Artificial Sequence: Synthetic peptide
  XENP018716 vhCDR3
YYGNYAGYFDV

SEQ ID NO: 8264 - protein, 11 aa, Artificial Sequence
  Description of Artificial Sequence: Synthetic peptide
  XENP018716 vlCDR1
RASQSVSNDVA

SEQ ID NO: 8265 - protein, 7 aa, Artificial Sequence
  Description of Artificial Sequence: Synthetic peptide
  XENP018716 vlCDR2
YASHRYT

SEQ ID NO: 8266 - protein, 9 aa, Artificial Sequence
  Description of Artificial Sequence: Synthetic peptide
  XENP018716 vlCDR3
QQDYSSPRT

SEQ ID NO: 8267 - protein, 249 aa, Artificial Sequence
  Description of Artificial Sequence: Synthetic polypeptide
  XENP018717 1G6_H1.213_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYQGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8268 - protein, 122 aa, Artificial Sequence
  Description of Artificial Sequence: Synthetic polypeptide
  VH of XENP018717
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYQGYFDVWGAGTLVTVSS

SEQ ID NO: 8269 - protein, 107 aa, Artificial Sequence; identical to SEQ ID NO: 6247
  Description of Artificial Sequence: Synthetic polypeptide
  VL of XENP018717

SEQ ID NO: 8270 - protein, 5 aa, Artificial Sequence
  Description of Artificial Sequence: Synthetic peptide
  XENP018717 vhCDR1
NYWMN

SEQ ID NO: 8271 - protein, 19 aa, Artificial Sequence
  Description of Artificial Sequence: Synthetic peptide
  XENP018717 vhCDR2
EIRLKSNNYATHYAEPVKG

SEQ ID NO: 8272 - protein, 11 aa, Artificial Sequence
  Description of Artificial Sequence: Synthetic peptide
  XENP018717 vhCDR3
YYGNYQGYFDV

SEQ ID NO: 8273 - protein, 11 aa, Artificial Sequence
  Description of Artificial Sequence: Synthetic peptide
  XENP018717 vlCDR1
RASQSVSNDVA

SEQ ID NO: 8274 - protein, 7 aa, Artificial Sequence
  Description of Artificial Sequence: Synthetic peptide
  XENP018717 vlCDR2
YASHRYT

SEQ ID NO: 8275 - protein, 9 aa, Artificial Sequence
  Description of Artificial Sequence: Synthetic peptide
  XENP018717 vlCDR3
QQDYSSPRT

SEQ ID NO: 8276 - protein, 249 aa, Artificial Sequence
  Description of Artificial Sequence: Synthetic polypeptide
  XENP018718 1G6_H1.214_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYHGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8277 - protein, 122 aa, Artificial Sequence
  Description of Artificial Sequence: Synthetic polypeptide
  VH of XENP018718
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYHGYFDVWGAGTLVTVSS

SEQ ID NO: 8278 - protein, 107 aa, Artificial Sequence; identical to SEQ ID NO: 6247
  Description of Artificial Sequence: Synthetic polypeptide
  VL of XENP018718

SEQ ID NO: 8279 - protein, 5 aa, Artificial Sequence
  Description of Artificial Sequence: Synthetic peptide
  XENP018718 vhCDR1
NYWMN

SEQ ID NO: 8280 - protein, 19 aa, Artificial Sequence
  Description of Artificial Sequence: Synthetic peptide
  XENP018718 vhCDR2
EIRLKSNNYATHYAEPVKG

SEQ ID NO: 8281 - protein, 11 aa, Artificial Sequence
  Description of Artificial Sequence: Synthetic peptide
  XENP018718 vhCDR3
YYGNYHGYFDV

SEQ ID NO: 8282 - protein, 11 aa, Artificial Sequence
  Description of Artificial Sequence: Synthetic peptide
  XENP018718 vlCDR1
RASQSVSNDVA

SEQ ID NO: 8283 - protein, 7 aa, Artificial Sequence
  Description of Artificial Sequence: Synthetic peptide
  XENP018718 vlCDR2
YASHRYT

SEQ ID NO: 8284 - protein, 9 aa, Artificial Sequence
  Description of Artificial Sequence: Synthetic peptide
  XENP018718 vlCDR3
QQDYSSPRT

SEQ ID NO: 8285 - protein, 249 aa, Artificial Sequence
  Description of Artificial Sequence: Synthetic polypeptide
  XENP018719 1G6_H1.215_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYDGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8286 - protein, 122 aa, Artificial Sequence
  Description of Artificial Sequence: Synthetic polypeptide
  VH of XENP018719
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYDGYFDVWGAGTLVTVSS

SEQ ID NO: 8287 - protein, 107 aa, Artificial Sequence; identical to SEQ ID NO: 6247
  Description of Artificial Sequence: Synthetic polypeptide
  VL of XENP018719

SEQ ID NO: 8288 - protein, 5 aa, Artificial Sequence
  Description of Artificial Sequence: Synthetic peptide
  XENP018719 vhCDR1
NYWMN

SEQ ID NO: 8289 - protein, 19 aa, Artificial Sequence
  Description of Artificial Sequence: Synthetic peptide
  XENP018719 vhCDR2
EIRLKSNNYATHYAEPVKG

SEQ ID NO: 8290 - protein, 11 aa, Artificial Sequence
  Description of Artificial Sequence: Synthetic peptide
  XENP018719 vhCDR3
YYGNYDGYFDV

SEQ ID NO: 8291 - protein, 11 aa, Artificial Sequence
  Description of Artificial Sequence: Synthetic peptide
  XENP018719 vlCDR1
RASQSVSNDVA

SEQ ID NO: 8292 - protein, 7 aa, Artificial Sequence
  Description of Artificial Sequence: Synthetic peptide
  XENP018719 vlCDR2
YASHRYT

SEQ ID NO: 8293 - protein, 9 aa, Artificial Sequence
  Description of Artificial Sequence: Synthetic peptide
  XENP018719 vlCDR3
QQDYSSPRT

SEQ ID NO: 8294 - protein, 249 aa, Artificial Sequence
  Description of Artificial Sequence: Synthetic polypeptide
  XENP018720 1G6_H1.216_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYKGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8295 - protein, 122 aa, Artificial Sequence
  Description of Artificial Sequence: Synthetic polypeptide
  VH of XENP018720
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYKGYFDVWGAGTLVTVSS

SEQ ID NO: 8296 - protein, 107 aa, Artificial Sequence; identical to SEQ ID NO: 6247
  Description of Artificial Sequence: Synthetic polypeptide
  VL of XENP018720

SEQ ID NO: 8297 - protein, 5 aa, Artificial Sequence
  Description of Artificial Sequence: Synthetic peptide
  XENP018720 vhCDR1
NYWMN

SEQ ID NO: 8298 - protein, 19 aa, Artificial Sequence
  Description of Artificial Sequence: Synthetic peptide
  XENP018720 vhCDR2
EIRLKSNNYATHYAEPVKG

SEQ ID NO: 8299 - protein, 11 aa, Artificial Sequence
  Description of Artificial Sequence: Synthetic peptide
  XENP018720 vhCDR3
YYGNYKGYFDV

SEQ ID NO: 8300 - protein, 11 aa, Artificial Sequence
  Description of Artificial Sequence: Synthetic peptide
  XENP018720 vlCDR1
RASQSVSNDVA

SEQ ID NO: 8301 - protein, 7 aa, Artificial Sequence
  Description of Artificial Sequence: Synthetic peptide
  XENP018720 vlCDR2
YASHRYT

SEQ ID NO: 8302 - protein, 9 aa, Artificial Sequence
  Description of Artificial Sequence: Synthetic peptide
  XENP018720 vlCDR3
QQDYSSPRT

SEQ ID NO: 8303 - protein, 249 aa, Artificial Sequence
  Description of Artificial Sequence: Synthetic polypeptide
  XENP018721 1G6_H1.217_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYLGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8304 - protein, 122 aa, Artificial Sequence
  Description of Artificial Sequence: Synthetic polypeptide
  VH of XENP018721
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYLGYFDVWGAGTLVTVSS

SEQ ID NO: 8305 - protein, 107 aa, Artificial Sequence; identical to SEQ ID NO: 6247
  Description of Artificial Sequence: Synthetic polypeptide
  VL of XENP018721

SEQ ID NO: 8306 - protein, 5 aa, Artificial Sequence
  Description of Artificial Sequence: Synthetic peptide
  XENP018721 vhCDR1
NYWMN

SEQ ID NO: 8307 - protein, 19 aa, Artificial Sequence
  Description of Artificial Sequence: Synthetic peptide
  XENP018721 vhCDR2
EIRLKSNNYATHYAEPVKG

SEQ ID NO: 8308 - protein, 11 aa, Artificial Sequence
  Description of Artificial Sequence: Synthetic peptide
  XENP018721 vhCDR3
YYGNYLGYFDV

SEQ ID NO: 8309 - protein, 11 aa, Artificial Sequence
  Description of Artificial Sequence: Synthetic peptide
  XENP018721 vlCDR1
RASQSVSNDVA

SEQ ID NO: 8310 - protein, 7 aa, Artificial Sequence
  Description of Artificial Sequence: Synthetic peptide
  XENP018721 vlCDR2
YASHRYT

SEQ ID NO: 8311 - protein, 9 aa, Artificial Sequence
  Description of Artificial Sequence: Synthetic peptide
  XENP018721 vlCDR3
QQDYSSPRT

SEQ ID NO: 8312 - protein, 249 aa, Artificial Sequence
  Description of Artificial Sequence: Synthetic polypeptide
  XENP018722 1G6_H1.218_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYFGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8313 - protein, 122 aa, Artificial Sequence
  Description of Artificial Sequence: Synthetic polypeptide
  VH of XENP018722
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYFGYFDVWGAGTLVTVSS

SEQ ID NO: 8314 - protein, 107 aa, Artificial Sequence; identical to SEQ ID NO: 6247
  Description of Artificial Sequence: Synthetic polypeptide
  VL of XENP018722

SEQ ID NO: 8315 - protein, 5 aa, Artificial Sequence
  Description of Artificial Sequence: Synthetic peptide
  XENP018722 vhCDR1
NYWMN

SEQ ID NO: 8316 - protein, 19 aa, Artificial Sequence
  Description of Artificial Sequence: Synthetic peptide
  XENP018722 vhCDR2
EIRLKSNNYATHYAEPVKG

SEQ ID NO: 8317 - protein, 11 aa, Artificial Sequence
  Description of Artificial Sequence: Synthetic peptide
  XENP018722 vhCDR3
YYGNYFGYFDV

SEQ ID NO: 8318 - protein, 11 aa, Artificial Sequence
  Description of Artificial Sequence: Synthetic peptide
  XENP018722 vlCDR1
RASQSVSNDVA

SEQ ID NO: 8319 - protein, 7 aa, Artificial Sequence
  Description of Artificial Sequence: Synthetic peptide
  XENP018722 vlCDR2
YASHRYT

SEQ ID NO: 8320 - protein, 9 aa, Artificial Sequence
  Description of Artificial Sequence: Synthetic peptide
  XENP018722 vlCDR3
QQDYSSPRT

SEQ ID NO: 8321 - protein, 249 aa, Artificial Sequence
  Description of Artificial Sequence: Synthetic polypeptide
  XENP018723 1G6_H1.219_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGAYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8322 - protein, 122 aa, Artificial Sequence
  Description of Artificial Sequence: Synthetic polypeptide
  VH of XENP018723
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGAYFDVWGAGTLVTVSS

SEQ ID NO: 8323 - protein, 107 aa, Artificial Sequence; identical to SEQ ID NO: 6247
  Description of Artificial Sequence: Synthetic polypeptide
  VL of XENP018723

SEQ ID NO: 8324 - protein, 5 aa, Artificial Sequence
  Description of Artificial Sequence: Synthetic peptide
  XENP018723 vhCDR1
NYWMN

SEQ ID NO: 8325 - protein, 19 aa, Artificial Sequence
  Description of Artificial Sequence: Synthetic peptide
  XENP018723 vhCDR2
EIRLKSNNYATHYAEPVKG

SEQ ID NO: 8326 - protein, 11 aa, Artificial Sequence
  Description of Artificial Sequence: Synthetic peptide
  XENP018723 vhCDR3
YYGNYGAYFDV

SEQ ID NO: 8327 - protein, 11 aa, Artificial Sequence
  Description of Artificial Sequence: Synthetic peptide
  XENP018723 vlCDR1
RASQSVSNDVA

SEQ ID NO: 8328 - protein, 7 aa, Artificial Sequence
  Description of Artificial Sequence: Synthetic peptide
  XENP018723 vlCDR2
YASHRYT

SEQ ID NO: 8329 - protein, 9 aa, Artificial Sequence
  Description of Artificial Sequence: Synthetic peptide
  XENP018723 vlCDR3
QQDYSSPRT

SEQ ID NO: 8330 - protein, 249 aa, Artificial Sequence
  Description of Artificial Sequence: Synthetic polypeptide
  XENP018724 1G6_H1.220_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGSYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8331 - protein, 122 aa, Artificial Sequence
  Description of Artificial Sequence: Synthetic polypeptide
  VH of XENP018724
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGSYFDVWGAGTLVTVSS

SEQ ID NO: 8332 - protein, 107 aa, Artificial Sequence; identical to SEQ ID NO: 6247
  Description of Artificial Sequence: Synthetic polypeptide
  VL of XENP018724

SEQ ID NO: 8333 - protein, 5 aa, Artificial Sequence
  Description of Artificial Sequence: Synthetic peptide
  XENP018724 vhCDR1
NYWMN

SEQ ID NO: 8334 - protein, 19 aa, Artificial Sequence
  Description of Artificial Sequence: Synthetic peptide
  XENP018724 vhCDR2
EIRLKSNNYATHYAEPVKG

SEQ ID NO: 8335 - protein, 11 aa, Artificial Sequence
  Description of Artificial Sequence: Synthetic peptide
  XENP018724 vhCDR3
YYGNYGSYFDV

SEQ ID NO: 8336 - protein, 11 aa, Artificial Sequence
  Description of Artificial Sequence: Synthetic peptide
  XENP018724 vlCDR1
RASQSVSNDVA

SEQ ID NO: 8337 - protein, 7 aa, Artificial Sequence
  Description of Artificial Sequence: Synthetic peptide
  XENP018724 vlCDR2
YASHRYT

SEQ ID NO: 8338 - protein, 9 aa, Artificial Sequence
  Description of Artificial Sequence: Synthetic peptide
  XENP018724 vlCDR3
QQDYSSPRT

SEQ ID NO: 8339 - protein, 249 aa, Artificial Sequence
  Description of Artificial Sequence: Synthetic polypeptide
  XENP018725 1G6_H1.221_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGTYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8340 - protein, 122 aa, Artificial Sequence
  Description of Artificial Sequence: Synthetic polypeptide
  VH of XENP018725
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGTYFDVWGAGTLVTVSS

SEQ ID NO: 8341 - protein, 107 aa, Artificial Sequence; identical to SEQ ID NO: 6247
  Description of Artificial Sequence: Synthetic polypeptide
  VL of XENP018725

SEQ ID NO: 8342 - protein, 5 aa, Artificial Sequence
  Description of Artificial Sequence: Synthetic peptide
  XENP018725 vhCDR1
NYWMN

SEQ ID NO: 8343 - protein, 19 aa, Artificial Sequence
  Description of Artificial Sequence: Synthetic peptide
  XENP018725 vhCDR2
EIRLKSNNYATHYAEPVKG

SEQ ID NO: 8344 - protein, 11 aa, Artificial Sequence
  Description of Artificial Sequence: Synthetic peptide
  XENP018725 vhCDR3
YYGNYGTYFDV

SEQ ID NO: 8345 - protein, 11 aa, Artificial Sequence
  Description of Artificial Sequence: Synthetic peptide
  XENP018725 vlCDR1
RASQSVSNDVA

SEQ ID NO: 8346 - protein, 7 aa, Artificial Sequence
  Description of Artificial Sequence: Synthetic peptide
  XENP018725 vlCDR2
YASHRYT

SEQ ID NO: 8347 - protein, 9 aa, Artificial Sequence
  Description of Artificial Sequence: Synthetic peptide
  XENP018725 vlCDR3
QQDYSSPRT

SEQ ID NO: 8348 - protein, 249 aa, Artificial Sequence
  Description of Artificial Sequence: Synthetic polypeptide
  XENP018726 1G6_H1.222_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGNYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8349 - protein, 122 aa, Artificial Sequence
  Description of Artificial Sequence: Synthetic polypeptide
  VH of XENP018726
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGNYFDVWGAGTLVTVSS

SEQ ID NO: 8350 - protein, 107 aa, Artificial Sequence; identical to SEQ ID NO: 6247
  Description of Artificial Sequence: Synthetic polypeptide
  VL of XENP018726

SEQ ID NO: 8351 - protein, 5 aa, Artificial Sequence
  Description of Artificial Sequence: Synthetic peptide
  XENP018726 vhCDR1
NYWMN

SEQ ID NO: 8352 - protein, 19 aa, Artificial Sequence
  Description of Artificial Sequence: Synthetic peptide
  XENP018726 vhCDR2
EIRLKSNNYATHYAEPVKG

SEQ ID NO: 8353 - protein, 11 aa, Artificial Sequence
  Description of Artificial Sequence: Synthetic peptide
  XENP018726 vhCDR3
YYGNYGNYFDV

SEQ ID NO: 8354 - protein, 11 aa, Artificial Sequence
  Description of Artificial Sequence: Synthetic peptide
  XENP018726 vlCDR1
RASQSVSNDVA

SEQ ID NO: 8355 - protein, 7 aa, Artificial Sequence
  Description of Artificial Sequence: Synthetic peptide
  XENP018726 vlCDR2
YASHRYT

SEQ ID NO: 8356 - protein, 9 aa, Artificial Sequence
  Description of Artificial Sequence: Synthetic peptide
  XENP018726 vlCDR3
QQDYSSPRT

SEQ ID NO: 8357 - protein, 249 aa, Artificial Sequence
  Description of Artificial Sequence: Synthetic polypeptide
  XENP018727 1G6_H1.223_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGHYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8358 - protein, 122 aa, Artificial Sequence
  Description of Artificial Sequence: Synthetic polypeptide
  VH of XENP018727
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGHYFDVWGAGTLVTVSS

SEQ ID NO: 8359 - protein, 107 aa, Artificial Sequence; identical to SEQ ID NO: 6247
  Description of Artificial Sequence: Synthetic polypeptide
  VL of XENP018727

SEQ ID NO: 8360 - protein, 5 aa, Artificial Sequence
  Description of Artificial Sequence: Synthetic peptide
  XENP018727 vhCDR1
NYWMN

SEQ ID NO: 8361 - protein, 19 aa, Artificial Sequence
  Description of Artificial Sequence: Synthetic peptide
  XENP018727 vhCDR2
EIRLKSNNYATHYAEPVKG

SEQ ID NO: 8362 - protein, 11 aa, Artificial Sequence
  Description of Artificial Sequence: Synthetic peptide
  XENP018727 vhCDR3
YYGNYGHYFDV

SEQ ID NO: 8363 - protein, 11 aa, Artificial Sequence
  Description of Artificial Sequence: Synthetic peptide
  XENP018727 vlCDR1
RASQSVSNDVA

SEQ ID NO: 8364 - protein, 7 aa, Artificial Sequence
  Description of Artificial Sequence: Synthetic peptide
  XENP018727 vlCDR2
YASHRYT

SEQ ID NO: 8365 - protein, 9 aa, Artificial Sequence
  Description of Artificial Sequence: Synthetic peptide
  XENP018727 vlCDR3
QQDYSSPRT

SEQ ID NO: 8366 - protein, 249 aa, Artificial Sequence
  Description of Artificial Sequence: Synthetic polypeptide
  XENP018728 1G6_H1.224_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGDYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8367 - protein, 122 aa, Artificial Sequence
  Description of Artificial Sequence: Synthetic polypeptide
  VH of XENP018728
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGDYFDVWGAGTLVTVSS

SEQ ID NO: 8368 - protein, 107 aa, Artificial Sequence; identical to SEQ ID NO: 6247
  Description of Artificial Sequence: Synthetic polypeptide
  VL of XENP018728

SEQ ID NO: 8369 - protein, 5 aa, Artificial Sequence
  Description of Artificial Sequence: Synthetic peptide
  XENP018728 vhCDR1
NYWMN

SEQ ID NO: 8370 - protein, 19 aa, Artificial Sequence
  Description of Artificial Sequence: Synthetic peptide
  XENP018728 vhCDR2
EIRLKSNNYATHYAEPVKG

SEQ ID NO: 8371 - protein, 11 aa, Artificial Sequence
  Description of Artificial Sequence: Synthetic peptide
  XENP018728 vhCDR3
YYGNYGDYFDV

SEQ ID NO: 8372 - protein, 11 aa, Artificial Sequence
  Description of Artificial Sequence: Synthetic peptide
  XENP018728 vlCDR1
RASQSVSNDVA

SEQ ID NO: 8373 - protein, 7 aa, Artificial Sequence
  Description of Artificial Sequence: Synthetic peptide
  XENP018728 vlCDR2
YASHRYT

SEQ ID NO: 8374 - protein, 9 aa, Artificial Sequence
  Description of Artificial Sequence: Synthetic peptide
  XENP018728 vlCDR3
QQDYSSPRT

SEQ ID NO: 8375 - protein, 249 aa, Artificial Sequence
  Description of Artificial Sequence: Synthetic polypeptide
  XENP018729 1G6_H1.225_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGKYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8376 - protein, 122 aa, Artificial Sequence
  Description of Artificial Sequence: Synthetic polypeptide
  VH of XENP018729
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGKYFDVWGAGTLVTVSS

SEQ ID NO: 8377 - protein, 107 aa, Artificial Sequence; identical to SEQ ID NO: 6247
  Description of Artificial Sequence: Synthetic polypeptide
  VL of XENP018729

SEQ ID NO: 8378 - protein, 5 aa, Artificial Sequence
  Description of Artificial Sequence: Synthetic peptide
  XENP018729 vhCDR1
NYWMN

SEQ ID NO: 8379 - protein, 19 aa, Artificial Sequence
  Description of Artificial Sequence: Synthetic peptide
  XENP018729 vhCDR2
EIRLKSNNYATHYAEPVKG

SEQ ID NO: 8380 - protein, 11 aa, Artificial Sequence
  Description of Artificial Sequence: Synthetic peptide
  XENP018729 vhCDR3
YYGNYGKYFDV

SEQ ID NO: 8381 - protein, 11 aa, Artificial Sequence
  Description of Artificial Sequence: Synthetic peptide
  XENP018729 vlCDR1
RASQSVSNDVA

SEQ ID NO: 8382 - protein, 7 aa, Artificial Sequence
  Description of Artificial Sequence: Synthetic peptide
  XENP018729 vlCDR2
YASHRYT

SEQ ID NO: 8383 - protein, 9 aa, Artificial Sequence
  Description of Artificial Sequence: Synthetic peptide
  XENP018729 vlCDR3
QQDYSSPRT

SEQ ID NO: 8384 - protein, 249 aa, Artificial Sequence
  Description of Artificial Sequence: Synthetic polypeptide
  XENP018730 1G6_H1.226_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGLYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8385 - protein, 122 aa, Artificial Sequence
  Description of Artificial Sequence: Synthetic polypeptide
  VH of XENP018730
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGLYFDVWGAGTLVTVSS

SEQ ID NO: 8386 - protein, 107 aa, Artificial Sequence; identical to SEQ ID NO: 6247
  Description of Artificial Sequence: Synthetic polypeptide
  VL of XENP018730

SEQ ID NO: 8387 - protein, 5 aa, Artificial Sequence
  Description of Artificial Sequence: Synthetic peptide
  XENP018730 vhCDR1
NYWMN

SEQ ID NO: 8388 - protein, 19 aa, Artificial Sequence
  Description of Artificial Sequence: Synthetic peptide
  XENP018730 vhCDR2
EIRLKSNNYATHYAEPVKG

SEQ ID NO: 8389 - protein, 11 aa, Artificial Sequence
  Description of Artificial Sequence: Synthetic peptide
  XENP018730 vhCDR3
YYGNYGLYFDV

SEQ ID NO: 8390 - protein, 11 aa, Artificial Sequence
  Description of Artificial Sequence: Synthetic peptide
  XENP018730 vlCDR1
RASQSVSNDVA

SEQ ID NO: 8391 - protein, 7 aa, Artificial Sequence
  Description of Artificial Sequence: Synthetic peptide
  XENP018730 vlCDR2
YASHRYT

SEQ ID NO: 8392 - protein, 9 aa, Artificial Sequence
  Description of Artificial Sequence: Synthetic peptide
  XENP018730 vlCDR3
QQDYSSPRT

SEQ ID NO: 8393 - protein, 249 aa, Artificial Sequence
  Description of Artificial Sequence: Synthetic polypeptide
  XENP018731 1G6_H1.227_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGFYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8394 - protein, 122 aa, Artificial Sequence
  Description of Artificial Sequence: Synthetic polypeptide
  VH of XENP018731
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGFYFDVWGAGTLVTVSS

SEQ ID NO: 8395 - protein, 107 aa, Artificial Sequence; identical to SEQ ID NO: 6247
  Description of Artificial Sequence: Synthetic polypeptide
  VL of XENP018731

SEQ ID NO: 8396 - protein, 5 aa, Artificial Sequence
  Description of Artificial Sequence: Synthetic peptide
  XENP018731 vhCDR1
NYWMN

SEQ ID NO: 8397 - protein, 19 aa, Artificial Sequence
  Description of Artificial Sequence: Synthetic peptide
  XENP018731 vhCDR2
EIRLKSNNYATHYAEPVKG

SEQ ID NO: 8398 - protein, 11 aa, Artificial Sequence
  Description of Artificial Sequence: Synthetic peptide
  XENP018731 vhCDR3
YYGNYGFYFDV

SEQ ID NO: 8399 - protein, 11 aa, Artificial Sequence
  Description of Artificial Sequence: Synthetic peptide
  XENP018731 vlCDR1
RASQSVSNDVA

SEQ ID NO: 8400 - protein, 7 aa, Artificial Sequence
  Description of Artificial Sequence: Synthetic peptide
  XENP018731 vlCDR2
YASHRYT

SEQ ID NO: 8401 - protein, 9 aa, Artificial Sequence
  Description of Artificial Sequence: Synthetic peptide
  XENP018731 vlCDR3
QQDYSSPRT

SEQ ID NO: 8402 - protein, 249 aa, Artificial Sequence
  Description of Artificial Sequence: Synthetic polypeptide
  XENP018732 1G6_H1.228_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGFFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8403 - protein, 122 aa, Artificial Sequence
  Description of Artificial Sequence: Synthetic polypeptide
  VH of XENP018732
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGFFDVWGAGTLVTVSS

SEQ ID NO: 8404 - protein, 107 aa, Artificial Sequence; identical to SEQ ID NO: 6247
  Description of Artificial Sequence: Synthetic polypeptide
  VL of XENP018732

SEQ ID NO: 8405 - protein, 5 aa, Artificial Sequence
  Description of Artificial Sequence: Synthetic peptide
  XENP018732 vhCDR1
NYWMN

SEQ ID NO: 8406 - protein, 19 aa, Artificial Sequence
  Description of Artificial Sequence: Synthetic peptide
  XENP018732 vhCDR2
EIRLKSNNYATHYAEPVKG

SEQ ID NO: 8407 - protein, 11 aa, Artificial Sequence
  Description of Artificial Sequence: Synthetic peptide
  XENP018732 vhCDR3
YYGNYGGFFDV

SEQ ID NO: 8408 - protein, 11 aa, Artificial Sequence
  Description of Artificial Sequence: Synthetic peptide
  XENP018732 vlCDR1
RASQSVSNDVA

SEQ ID NO: 8409 - protein, 7 aa, Artificial Sequence
  Description of Artificial Sequence: Synthetic peptide
  XENP018732 vlCDR2
YASHRYT

SEQ ID NO: 8410 - protein, 9 aa, Artificial Sequence
  Description of Artificial Sequence: Synthetic peptide
  XENP018732 vlCDR3
QQDYSSPRT

SEQ ID NO: 8411 - protein, 249 aa, Artificial Sequence
  Description of Artificial Sequence: Synthetic polypeptide
  XENP018733 1G6_H1.229_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGHFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8412 - protein, 122 aa, Artificial Sequence
  Description of Artificial Sequence: Synthetic polypeptide
  VH of XENP018733
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGHFDVWGAGTLVTVSS

SEQ ID NO: 8413 - protein, 107 aa, Artificial Sequence; identical to SEQ ID NO: 6247
  Description of Artificial Sequence: Synthetic polypeptide
  VL of XENP018733

SEQ ID NO: 8414 - protein, 5 aa, Artificial Sequence
  Description of Artificial Sequence: Synthetic peptide
  XENP018733 vhCDR1
NYWMN

SEQ ID NO: 8415 - protein, 19 aa, Artificial Sequence
  Description of Artificial Sequence: Synthetic peptide
  XENP018733 vhCDR2
EIRLKSNNYATHYAEPVKG

SEQ ID NO: 8416 - protein, 11 aa, Artificial Sequence
  Description of Artificial Sequence: Synthetic peptide
  XENP018733 vhCDR3
YYGNYGGHFDV

SEQ ID NO: 8417 - protein, 11 aa, Artificial Sequence
  Description of Artificial Sequence: Synthetic peptide
  XENP018733 vlCDR1
RASQSVSNDVA

SEQ ID NO: 8418 - protein, 7 aa, Artificial Sequence
  Description of Artificial Sequence: Synthetic peptide
  XENP018733 vlCDR2
YASHRYT

SEQ ID NO: 8419 - protein, 9 aa, Artificial Sequence
  Description of Artificial Sequence: Synthetic peptide
  XENP018733 vlCDR3
QQDYSSPRT

SEQ ID NO: 8420 - protein, 249 aa, Artificial Sequence
  Description of Artificial Sequence: Synthetic polypeptide
  XENP018734 1G6_H1.230_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGLFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8421 - protein, 122 aa, Artificial Sequence
  Description of Artificial Sequence: Synthetic polypeptide
  VH of XENP018734
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGLFDVWGAGTLVTVSS

SEQ ID NO: 8422 - protein, 107 aa, Artificial Sequence; identical to SEQ ID NO: 6247
  Description of Artificial Sequence: Synthetic polypeptide
  VL of XENP018734

SEQ ID NO: 8423 - protein, 5 aa, Artificial Sequence
  Description of Artificial Sequence: Synthetic peptide
  XENP018734 vhCDR1
NYWMN

SEQ ID NO: 8424 - protein, 19 aa, Artificial Sequence
  Description of Artificial Sequence: Synthetic peptide
  XENP018734 vhCDR2
EIRLKSNNYATHYAEPVKG

SEQ ID NO: 8425 - protein, 11 aa, Artificial Sequence
  Description of Artificial Sequence: Synthetic peptide
  XENP018734 vhCDR3
YYGNYGGLFDV

SEQ ID NO: 8426 - protein, 11 aa, Artificial Sequence
  Description of Artificial Sequence: Synthetic peptide
  XENP018734 vlCDR1
RASQSVSNDVA

SEQ ID NO: 8427 - protein, 7 aa, Artificial Sequence
  Description of Artificial Sequence: Synthetic peptide
  XENP018734 vlCDR2
YASHRYT

SEQ ID NO: 8428 - protein, 9 aa, Artificial Sequence
  Description of Artificial Sequence: Synthetic peptide
  XENP018734 vlCDR3
QQDYSSPRT

SEQ ID NO: 8429 - protein, 249 aa, Artificial Sequence
  Description of Artificial Sequence: Synthetic polypeptide
  XENP018735 1G6_H1.231_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGWFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8430 - protein, 122 aa, Artificial Sequence
  Description of Artificial Sequence: Synthetic polypeptide
  VH of XENP018735
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGWFDVWGAGTLVTVSS

SEQ ID NO: 8431 - protein, 107 aa, Artificial Sequence; identical to SEQ ID NO: 6247
  Description of Artificial Sequence: Synthetic polypeptide
  VL of XENP018735

SEQ ID NO: 8432 - protein, 5 aa, Artificial Sequence
  Description of Artificial Sequence: Synthetic peptide
  XENP018735 vhCDR1
NYWMN

SEQ ID NO: 8433 - protein, 19 aa, Artificial Sequence
  Description of Artificial Sequence: Synthetic peptide
  XENP018735 vhCDR2
EIRLKSNNYATHYAEPVKG

SEQ ID NO: 8434 - protein, 11 aa, Artificial Sequence
  Description of Artificial Sequence: Synthetic peptide
  XENP018735 vhCDR3
YYGNYGGWFDV

SEQ ID NO: 8435 - protein, 11 aa, Artificial Sequence
  Description of Artificial Sequence: Synthetic peptide
  XENP018735 vlCDR1
RASQSVSNDVA

SEQ ID NO: 8436 - protein, 7 aa, Artificial Sequence
  Description of Artificial Sequence: Synthetic peptide
  XENP018735 vlCDR2
YASHRYT

SEQ ID NO: 8437 - protein, 9 aa, Artificial Sequence
  Description of Artificial Sequence: Synthetic peptide
  XENP018735 vlCDR3
QQDYSSPRT

SEQ ID NO: 8438 - protein, 249 aa, Artificial Sequence
  Description of Artificial Sequence: Synthetic polypeptide
  XENP018736 1G6_H1.232_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGVFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8439 - protein, 122 aa, Artificial Sequence
  Description of Artificial Sequence: Synthetic polypeptide
  VH of XENP018736
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGVFDVWGAGTLVTVSS

SEQ ID NO: 8440 - protein, 107 aa, Artificial Sequence; identical to SEQ ID NO: 6247
  Description of Artificial Sequence: Synthetic polypeptide
  VL of XENP018736

SEQ ID NO: 8441 - protein, 5 aa, Artificial Sequence
  Description of Artificial Sequence: Synthetic peptide
  XENP018736 vhCDR1
NYWMN

SEQ ID NO: 8442 - protein, 19 aa, Artificial Sequence
  Description of Artificial Sequence: Synthetic peptide
  XENP018736 vhCDR2
EIRLKSNNYATHYAEPVKG

SEQ ID NO: 8443 - protein, 11 aa, Artificial Sequence
  Description of Artificial Sequence: Synthetic peptide
  XENP018736 vhCDR3
YYGNYGGVFDV

SEQ ID NO: 8444 - protein, 11 aa, Artificial Sequence
  Description of Artificial Sequence: Synthetic peptide
  XENP018736 vlCDR1
RASQSVSNDVA

SEQ ID NO: 8445 - protein, 7 aa, Artificial Sequence
  Description of Artificial Sequence: Synthetic peptide
  XENP018736 vlCDR2
YASHRYT

SEQ ID NO: 8446 - protein, 9 aa, Artificial Sequence
  Description of Artificial Sequence: Synthetic peptide
  XENP018736 vlCDR3
QQDYSSPRT

SEQ ID NO: 8447 - protein, 249 aa, Artificial Sequence
  Description of Artificial Sequence: Synthetic polypeptide
  XENP018737 1G6_H1.233_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGAFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8448 - protein, 122 aa, Artificial Sequence
  Description of Artificial Sequence: Synthetic polypeptide
  VH of XENP018737
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGAFDVWGAGTLVTVSS

SEQ ID NO: 8449 - protein, 107 aa, Artificial Sequence; identical to SEQ ID NO: 6247
  Description of Artificial Sequence: Synthetic polypeptide
  VL of XENP018737

SEQ ID NO: 8450 - protein, 5 aa, Artificial Sequence
  Description of Artificial Sequence: Synthetic peptide
  XENP018737 vhCDR1
NYWMN

SEQ ID NO: 8451 - protein, 19 aa, Artificial Sequence
  Description of Artificial Sequence: Synthetic peptide
  XENP018737 vhCDR2
EIRLKSNNYATHYAEPVKG

SEQ ID NO: 8452 - protein, 11 aa, Artificial Sequence
  Description of Artificial Sequence: Synthetic peptide
  XENP018737 vhCDR3
YYGNYGGAFDV

SEQ ID NO: 8453 - protein, 11 aa, Artificial Sequence
  Description of Artificial Sequence: Synthetic peptide
  XENP018737 vlCDR1
RASQSVSNDVA

SEQ ID NO: 8454 - protein, 7 aa, Artificial Sequence
  Description of Artificial Sequence: Synthetic peptide
  XENP018737 vlCDR2
YASHRYT

SEQ ID NO: 8455 - protein, 9 aa, Artificial Sequence
  Description of Artificial Sequence: Synthetic peptide
  XENP018737 vlCDR3
QQDYSSPRT

SEQ ID NO: 8456 - protein, 249 aa, Artificial Sequence
  Description of Artificial Sequence: Synthetic polypeptide
  XENP018738 1G6_H1.234_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGQFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8457 - protein, 122 aa, Artificial Sequence
  Description of Artificial Sequence: Synthetic polypeptide
  VH of XENP018738
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGQFDVWGAGTLVTVSS

SEQ ID NO: 8458 - protein, 107 aa, Artificial Sequence; identical to SEQ ID NO: 6247
  Description of Artificial Sequence: Synthetic polypeptide
  VL of XENP018738

SEQ ID NO: 8459 - protein, 5 aa, Artificial Sequence
  Description of Artificial Sequence: Synthetic peptide
  XENP018738 vhCDR1
NYWMN

SEQ ID NO: 8460 - protein, 19 aa, Artificial Sequence
  Description of Artificial Sequence: Synthetic peptide
  XENP018738 vhCDR2
EIRLKSNNYATHYAEPVKG

SEQ ID NO: 8461 - protein, 11 aa, Artificial Sequence
  Description of Artificial Sequence: Synthetic peptide
  XENP018738 vhCDR3
YYGNYGGQFDV

SEQ ID NO: 8462 - protein, 11 aa, Artificial Sequence
  Description of Artificial Sequence: Synthetic peptide
  XENP018738 vlCDR1
RASQSVSNDVA

SEQ ID NO: 8463 - protein, 7 aa, Artificial Sequence
  Description of Artificial Sequence: Synthetic peptide
  XENP018738 vlCDR2
YASHRYT

SEQ ID NO: 8464 - protein, 9 aa, Artificial Sequence
  Description of Artificial Sequence: Synthetic peptide
  XENP018738 vlCDR3
QQDYSSPRT

SEQ ID NO: 8465 - protein, 249 aa, Artificial Sequence
  Description of Artificial Sequence: Synthetic polypeptide
  XENP018739 1G6_H1.235_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGDFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8466 - protein, 122 aa, Artificial Sequence
  Description of Artificial Sequence: Synthetic polypeptide
  VH of XENP018739
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGDFDVWGAGTLVTVSS

SEQ ID NO: 8467 - protein, 107 aa, Artificial Sequence; identical to SEQ ID NO: 6247
  Description of Artificial Sequence: Synthetic polypeptide
  VL of XENP018739

SEQ ID NO: 8468 - protein, 5 aa, Artificial Sequence
  Description of Artificial Sequence: Synthetic peptide
  XENP018739 vhCDR1
NYWMN

SEQ ID NO: 8469 - protein, 19 aa, Artificial Sequence
  Description of Artificial Sequence: Synthetic peptide
  XENP018739 vhCDR2
EIRLKSNNYATHYAEPVKG

SEQ ID NO: 8470 - protein, 11 aa, Artificial Sequence
  Description of Artificial Sequence: Synthetic peptide
  XENP018739 vhCDR3
YYGNYGGDFDV

SEQ ID NO: 8471 - protein, 11 aa, Artificial Sequence
  Description of Artificial Sequence: Synthetic peptide
  XENP018739 vlCDR1
RASQSVSNDVA

SEQ ID NO: 8472 - protein, 7 aa, Artificial Sequence
  Description of Artificial Sequence: Synthetic peptide
  XENP018739 vlCDR2
YASHRYT

SEQ ID NO: 8473 - protein, 9 aa, Artificial Sequence
  Description of Artificial Sequence: Synthetic peptide
  XENP018739 vlCDR3
QQDYSSPRT

SEQ ID NO: 8474 - protein, 249 aa, Artificial Sequence
  Description of Artificial Sequence: Synthetic polypeptide
  XENP018740 1G6_H1.236_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGKFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8475 - protein, 122 aa, Artificial Sequence
  Description of Artificial Sequence: Synthetic polypeptide
  VH of XENP018740
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGKFDVWGAGTLVTVSS

SEQ ID NO: 8476 - protein, 107 aa, Artificial Sequence; identical to SEQ ID NO: 6247
  Description of Artificial Sequence: Synthetic polypeptide
  VL of XENP018740

SEQ ID NO: 8477 - protein, 5 aa, Artificial Sequence
  Description of Artificial Sequence: Synthetic peptide
  XENP018740 vhCDR1
NYWMN

SEQ ID NO: 8478 - protein, 19 aa, Artificial Sequence
  Description of Artificial Sequence: Synthetic peptide
  XENP018740 vhCDR2
EIRLKSNNYATHYAEPVKG

SEQ ID NO: 8479 - protein, 11 aa, Artificial Sequence
  Description of Artificial Sequence: Synthetic peptide
  XENP018740 vhCDR3
YYGNYGGKFDV

SEQ ID NO: 8480 - protein, 11 aa, Artificial Sequence
  Description of Artificial Sequence: Synthetic peptide
  XENP018740 vlCDR1
RASQSVSNDVA

SEQ ID NO: 8481 - protein, 7 aa, Artificial Sequence
  Description of Artificial Sequence: Synthetic peptide
  XENP018740 vlCDR2
YASHRYT

SEQ ID NO: 8482 - protein, 9 aa, Artificial Sequence
  Description of Artificial Sequence: Synthetic peptide
  XENP018740 vlCDR3
QQDYSSPRT

SEQ ID NO: 8483 - protein, 249 aa, Artificial Sequence
  Description of Artificial Sequence: Synthetic polypeptide
  XENP018741 1G6_H1.237_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDYWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8484 - protein, 122 aa, Artificial Sequence
  Description of Artificial Sequence: Synthetic polypeptide
  VH of XENP018741
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDYWGAGTLVTVSS

SEQ ID NO: 8485 - protein, 107 aa, Artificial Sequence; identical to SEQ ID NO: 6247
  Description of Artificial Sequence: Synthetic polypeptide
  VL of XENP018741

SEQ ID NO: 8486 - protein, 5 aa, Artificial Sequence
  Description of Artificial Sequence: Synthetic peptide
  XENP018741 vhCDR1
NYWMN

SEQ ID NO: 8487 - protein, 19 aa, Artificial Sequence
  Description of Artificial Sequence: Synthetic peptide
  XENP018741 vhCDR2
EIRLKSNNYATHYAEPVKG

SEQ ID NO: 8488 - protein, 11 aa, Artificial Sequence
  Description of Artificial Sequence: Synthetic peptide
  XENP018741 vhCDR3
YYGNYGGYFDY

SEQ ID NO: 8489 - protein, 11 aa, Artificial Sequence
  Description of Artificial Sequence: Synthetic peptide
  XENP018741 vlCDR1
RASQSVSNDVA

SEQ ID NO: 8490 - protein, 7 aa, Artificial Sequence
  Description of Artificial Sequence: Synthetic peptide
  XENP018741 vlCDR2
YASHRYT

SEQ ID NO: 8491 - protein, 9 aa, Artificial Sequence
  Description of Artificial Sequence: Synthetic peptide
  XENP018741 vlCDR3
QQDYSSPRT

SEQ ID NO: 8492 - protein, 249 aa, Artificial Sequence
  Description of Artificial Sequence: Synthetic polypeptide
  XENP018742 1G6_H1.238_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGQGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8493 - protein, 122 aa, Artificial Sequence
  Description of Artificial Sequence: Synthetic polypeptide
  VH of XENP018742
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGQGTLVTVSS

SEQ ID NO: 8494 - protein, 107 aa, Artificial Sequence; identical to SEQ ID NO: 6247
  Description of Artificial Sequence: Synthetic polypeptide
  VL of XENP018742

SEQ ID NO: 8495 - protein, 5 aa, Artificial Sequence
  Description of Artificial Sequence: Synthetic peptide
  XENP018742 vhCDR1
NYWMN

SEQ ID NO: 8496 - protein, 19 aa, Artificial Sequence
  Description of Artificial Sequence: Synthetic peptide
  XENP018742 vhCDR2
EIRLKSNNYATHYAEPVKG

SEQ ID NO: 8497 - protein, 11 aa, Artificial Sequence
  Description of Artificial Sequence: Synthetic peptide
  XENP018742 vhCDR3
YYGNYGGYFDV

SEQ ID NO: 8498 - protein, 11 aa, Artificial Sequence
  Description of Artificial Sequence: Synthetic peptide
  XENP018742 vlCDR1
RASQSVSNDVA

SEQ ID NO: 8499 - protein, 7 aa, Artificial Sequence
  Description of Artificial Sequence: Synthetic peptide
  XENP018742 vlCDR2
YASHRYT

SEQ ID NO: 8500 - protein, 9 aa, Artificial Sequence
  Description of Artificial Sequence: Synthetic peptide
  XENP018742 vlCDR3
QQDYSSPRT

SEQ ID NO: 8501 - protein, 249 aa, Artificial Sequence
  Description of Artificial Sequence: Synthetic polypeptide
  XENP018743 1G6_H1_L1.1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSEIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8502 - protein, 122 aa, Artificial Sequence; identical to SEQ ID NO: 6246
  Description of Artificial Sequence: Synthetic polypeptide
  VH of XENP018743

SEQ ID NO: 8503 - protein, 107 aa, Artificial Sequence
  Description of Artificial Sequence: Synthetic polypeptide
  VL of XENP018743
EIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8504 - protein, 5 aa, Artificial Sequence
  Description of Artificial Sequence: Synthetic peptide
  XENP018743 vhCDR1
NYWMN

SEQ ID NO: 8505 - protein, 19 aa, Artificial Sequence
  Description of Artificial Sequence: Synthetic peptide
  XENP018743 vhCDR2
EIRLKSNNYATHYAEPVKG

SEQ ID NO: 8506 - protein, 11 aa, Artificial Sequence
  Description of Artificial Sequence: Synthetic peptide
  XENP018743 vhCDR3
YYGNYGGYFDV

SEQ ID NO: 8507 - protein, 11 aa, Artificial Sequence
  Description of Artificial Sequence: Synthetic peptide
  XENP018743 vlCDR1
RASQSVSNDVA

SEQ ID NO: 8508 - protein, 7 aa, Artificial Sequence
  Description of Artificial Sequence: Synthetic peptide
  XENP018743 vlCDR2
YASHRYT

SEQ ID NO: 8509 - protein, 9 aa, Artificial Sequence
  Description of Artificial Sequence: Synthetic peptide
  XENP018743 vlCDR3
QQDYSSPRT

SEQ ID NO: 8510 - protein, 249 aa, Artificial Sequence
  Description of Artificial Sequence: Synthetic polypeptide
  XENP018744 1G6_H1_L1.2_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSDIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8511 - protein, 122 aa, Artificial Sequence; identical to SEQ ID NO: 6246
  Description of Artificial Sequence: Synthetic polypeptide
  VH of XENP018744

SEQ ID NO: 8512 - protein, 107 aa, Artificial Sequence
  Description of Artificial Sequence: Synthetic polypeptide
  VL of XENP018744
DIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8513 - protein, 5 aa, Artificial Sequence
  Description of Artificial Sequence: Synthetic peptide
  XENP018744 vhCDR1
NYWMN

SEQ ID NO: 8514 - protein, 19 aa, Artificial Sequence
  Description of Artificial Sequence: Synthetic peptide
  XENP018744 vhCDR2
EIRLKSNNYATHYAEPVKG

SEQ ID NO: 8515 - protein, 11 aa, Artificial Sequence
  Description of Artificial Sequence: Synthetic peptide
  XENP018744 vhCDR3
YYGNYGGYFDV

SEQ ID NO: 8516 - protein, 11 aa, Artificial Sequence
  Description of Artificial Sequence: Synthetic peptide
  XENP018744 vlCDR1
RASQSVSNDVA

SEQ ID NO: 8517 - protein, 7 aa, Artificial Sequence
  Description of Artificial Sequence: Synthetic peptide
  XENP018744 vlCDR2
YASHRYT

SEQ ID NO: 8518 - protein, 9 aa, Artificial Sequence
  Description of Artificial Sequence: Synthetic peptide
  XENP018744 vlCDR3
QQDYSSPRT

SEQ ID NO: 8519 - protein, 249 aa, Artificial Sequence
  Description of Artificial Sequence: Synthetic polypeptide
  XENP018745 1G6_H1_L1.3_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSVVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8520 - protein, 122 aa, Artificial Sequence; identical to SEQ ID NO: 6246
  Description of Artificial Sequence: Synthetic polypeptide
  VH of XENP018745

SEQ ID NO: 8521 - protein, 107 aa, Artificial Sequence
  Description of Artificial Sequence: Synthetic polypeptide
  VL of XENP018745
SVVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8522 - protein, 5 aa, Artificial Sequence
  Description of Artificial Sequence: Synthetic peptide
  XENP018745 vhCDR1
NYWMN

SEQ ID NO: 8523 - protein, 19 aa, Artificial Sequence
  Description of Artificial Sequence: Synthetic peptide
  XENP018745 vhCDR2
EIRLKSNNYATHYAEPVKG

SEQ ID NO: 8524 - protein, 11 aa, Artificial Sequence
  Description of Artificial Sequence: Synthetic peptide
  XENP018745 vhCDR3
YYGNYGGYFDV

SEQ ID NO: 8525 - protein, 11 aa, Artificial Sequence
  Description of Artificial Sequence: Synthetic peptide
  XENP018745 vlCDR1
RASQSVSNDVA

SEQ ID NO: 8526 - protein, 7 aa, Artificial Sequence
  Description of Artificial Sequence: Synthetic peptide
  XENP018745 vlCDR2
YASHRYT

SEQ ID NO: 8527 - protein, 9 aa, Artificial Sequence
  Description of Artificial Sequence: Synthetic peptide
  XENP018745 vlCDR3
QQDYSSPRT

SEQ ID NO: 8528 - protein, 249 aa, Artificial Sequence
  Description of Artificial Sequence: Synthetic polypeptide
  XENP018746 1G6_H1_L1.4_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVLTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8529 - protein, 122 aa, Artificial Sequence; identical to SEQ ID NO: 6246
  Description of Artificial Sequence: Synthetic polypeptide
  VH of XENP018746

SEQ ID NO: 8530 - protein, 107 aa, Artificial Sequence
  Description of Artificial Sequence: Synthetic polypeptide
  VL of XENP018746
SIVLTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8531 - protein, 5 aa, Artificial Sequence
  Description of Artificial Sequence: Synthetic peptide
  XENP018746 vhCDR1
NYWMN

SEQ ID NO: 8532 - protein, 19 aa, Artificial Sequence
  Description of Artificial Sequence: Synthetic peptide
  XENP018746 vhCDR2
EIRLKSNNYATHYAEPVKG

SEQ ID NO: 8533 - protein, 11 aa, Artificial Sequence
  Description of Artificial Sequence: Synthetic peptide
  XENP018746 vhCDR3
YYGNYGGYFDV

SEQ ID NO: 8534 - protein, 11 aa, Artificial Sequence
  Description of Artificial Sequence: Synthetic peptide
  XENP018746 vlCDR1
RASQSVSNDVA

SEQ ID NO: 8535 - protein, 7 aa, Artificial Sequence
  Description of Artificial Sequence: Synthetic peptide
  XENP018746 vlCDR2
YASHRYT

SEQ ID NO: 8536 - protein, 9 aa, Artificial Sequence
  Description of Artificial Sequence: Synthetic peptide
  XENP018746 vlCDR3
QQDYSSPRT

SEQ ID NO: 8537 - protein, 249 aa, Artificial Sequence
  Description of Artificial Sequence: Synthetic polypeptide
  XENP018747 1G6_H1_L1.5_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQTPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8538 - protein, 122 aa, Artificial Sequence; identical to SEQ ID NO: 6246
  Description of Artificial Sequence: Synthetic polypeptide
  VH of XENP018747

SEQ ID NO: 8539 - protein, 107 aa, Artificial Sequence
  Description of Artificial Sequence: Synthetic polypeptide
  VL of XENP018747
SIVMTQTPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8540 - protein, 5 aa, Artificial Sequence
  Description of Artificial Sequence: Synthetic peptide
  XENP018747 vhCDR1
NYWMN

SEQ ID NO: 8541 - protein, 19 aa, Artificial Sequence
  Description of Artificial Sequence: Synthetic peptide
  XENP018747 vhCDR2
EIRLKSNNYATHYAEPVKG

SEQ ID NO: 8542 - protein, 11 aa, Artificial Sequence
  Description of Artificial Sequence: Synthetic peptide
  XENP018747 vhCDR3
YYGNYGGYFDV

SEQ ID NO: 8543 - protein, 11 aa, Artificial Sequence
  Description of Artificial Sequence: Synthetic peptide
  XENP018747 vlCDR1
RASQSVSNDVA

SEQ ID NO: 8544 - protein, 7 aa, Artificial Sequence
  Description of Artificial Sequence: Synthetic peptide
  XENP018747 vlCDR2
YASHRYT

SEQ ID NO: 8545 - protein, 9 aa, Artificial Sequence
  Description of Artificial Sequence: Synthetic peptide
  XENP018747 vlCDR3
QQDYSSPRT

SEQ ID NO: 8546 - protein, 249 aa, Artificial Sequence
  Description of Artificial Sequence: Synthetic polypeptide
  XENP018748 1G6_H1_L1.6_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPKTLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8547 - protein, 122 aa, Artificial Sequence; identical to SEQ ID NO: 6246
  Description of Artificial Sequence: Synthetic polypeptide
  VH of XENP018748

SEQ ID NO: 8548 - protein, 107 aa, Artificial Sequence
  Description of Artificial Sequence: Synthetic polypeptide
  VL of XENP018748
SIVMTQSPKTLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8549 - protein, 5 aa, Artificial Sequence
  Description of Artificial Sequence: Synthetic peptide
  XENP018748 vhCDR1
NYWMN

SEQ ID NO: 8550 - protein, 19 aa, Artificial Sequence
  Description of Artificial Sequence: Synthetic peptide
  XENP018748 vhCDR2
EIRLKSNNYATHYAEPVKG

SEQ ID NO: 8551 - protein, 11 aa, Artificial Sequence
  Description of Artificial Sequence: Synthetic peptide
  XENP018748 vhCDR3
YYGNYGGYFDV

SEQ ID NO: 8552 - protein, 11 aa, Artificial Sequence
  Description of Artificial Sequence: Synthetic peptide
  XENP018748 vlCDR1
RASQSVSNDVA

SEQ ID NO: 8553 - protein, 7 aa, Artificial Sequence
  Description of Artificial Sequence: Synthetic peptide
  XENP018748 vlCDR2
YASHRYT

SEQ ID NO: 8554 - protein, 9 aa, Artificial Sequence
  Description of Artificial Sequence: Synthetic peptide
  XENP018748 vlCDR3
QQDYSSPRT

SEQ ID NO: 8555 - protein, 249 aa, Artificial Sequence
  Description of Artificial Sequence: Synthetic polypeptide
  XENP018749 1G6_H1_L1.7_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPASLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8556 - protein, 122 aa, Artificial Sequence; identical to SEQ ID NO: 6246
  Description of Artificial Sequence: Synthetic polypeptide
  VH of XENP018749

SEQ ID NO: 8557 - protein, 107 aa, Artificial Sequence
  Description of Artificial Sequence: Synthetic polypeptide
  VL of XENP018749
SIVMTQSPASLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8558 - protein, 5 aa, Artificial Sequence
  Description of Artificial Sequence: Synthetic peptide
  XENP018749 vhCDR1
NYWMN

SEQ ID NO: 8559 - protein, 19 aa, Artificial Sequence
  Description of Artificial Sequence: Synthetic peptide
  XENP018749 vhCDR2
EIRLKSNNYATHYAEPVKG

SEQ ID NO: 8560 - protein, 11 aa, Artificial Sequence
  Description of Artificial Sequence: Synthetic peptide
  XENP018749 vhCDR3
YYGNYGGYFDV

SEQ ID NO: 8561 - protein, 11 aa, Artificial Sequence
  Description of Artificial Sequence: Synthetic peptide
  XENP018749 vlCDR1
RASQSVSNDVA

SEQ ID NO: 8562 - protein, 7 aa, Artificial Sequence
  Description of Artificial Sequence: Synthetic peptide
  XENP018749 vlCDR2
YASHRYT

SEQ ID NO: 8563 - protein, 9 aa, Artificial Sequence
  Description of Artificial Sequence: Synthetic peptide
  XENP018749 vlCDR3
QQDYSSPRT

SEQ ID NO: 8564 - protein, 249 aa, Artificial Sequence
  Description of Artificial Sequence: Synthetic polypeptide
  XENP018750 1G6_H1_L1.8_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPAFLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8565 - protein, 122 aa, Artificial Sequence; identical to SEQ ID NO: 6246
  Description of Artificial Sequence: Synthetic polypeptide
  VH of XENP018750

SEQ ID NO: 8566 - protein, 107 aa, Artificial Sequence
  Description of Artificial Sequence: Synthetic polypeptide
  VL of XENP018750
SIVMTQSPAFLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8567 - protein, 5 aa, Artificial Sequence
  Description of Artificial Sequence: Synthetic peptide
  XENP018750 vhCDR1
NYWMN

SEQ ID NO: 8568 - protein, 19 aa, Artificial Sequence
  Description of Artificial Sequence: Synthetic peptide
  XENP018750 vhCDR2
EIRLKSNNYATHYAEPVKG

SEQ ID NO: 8569 - protein, 11 aa, Artificial Sequence
  Description of Artificial Sequence: Synthetic peptide
  XENP018750 vhCDR3
YYGNYGGYFDV

SEQ ID NO: 8570 - protein, 11 aa, Artificial Sequence
  Description of Artificial Sequence: Synthetic peptide
  XENP018750 vlCDR1
RASQSVSNDVA

SEQ ID NO: 8571 - protein, 7 aa, Artificial Sequence
  Description of Artificial Sequence: Synthetic peptide
  XENP018750 vlCDR2
YASHRYT

SEQ ID NO: 8572 - protein, 9 aa, Artificial Sequence
  Description of Artificial Sequence: Synthetic peptide
  XENP018750 vlCDR3
QQDYSSPRT

SEQ ID NO: 8573 - protein, 249 aa, Artificial Sequence
  Description of Artificial Sequence: Synthetic polypeptide
  XENP018751 1G6_H1_L1.9_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLLVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8574 - protein, 122 aa, Artificial Sequence; identical to SEQ ID NO: 6246
  Description of Artificial Sequence: Synthetic polypeptide
  VH of XENP018751

SEQ ID NO: 8575 - protein, 107 aa, Artificial Sequence
  Description of Artificial Sequence: Synthetic polypeptide
  VL of XENP018751
SIVMTQSPATLLVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8576 - protein, 5 aa, Artificial Sequence
  Description of Artificial Sequence: Synthetic peptide
  XENP018751 vhCDR1
NYWMN

SEQ ID NO: 8577 - protein, 19 aa, Artificial Sequence
  Description of Artificial Sequence: Synthetic peptide
  XENP018751 vhCDR2
EIRLKSNNYATHYAEPVKG

SEQ ID NO: 8578 - protein, 11 aa, Artificial Sequence
  Description of Artificial Sequence: Synthetic peptide
  XENP018751 vhCDR3
YYGNYGGYFDV

SEQ ID NO: 8579 - protein, 11 aa, Artificial Sequence
  Description of Artificial Sequence: Synthetic peptide
  XENP018751 vlCDR1
RASQSVSNDVA

SEQ ID NO: 8580 - protein, 7 aa, Artificial Sequence
  Description of Artificial Sequence: Synthetic peptide
  XENP018751 vlCDR2
YASHRYT

SEQ ID NO: 8581 - protein, 9 aa, Artificial Sequence
  Description of Artificial Sequence: Synthetic peptide
  XENP018751 vlCDR3
QQDYSSPRT

SEQ ID NO: 8582 - protein, 249 aa, Artificial Sequence
  Description of Artificial Sequence: Synthetic polypeptide
  XENP018752 1G6_H1_L1.10_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSAGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8583 - protein, 122 aa, Artificial Sequence; identical to SEQ ID NO: 6246
  Description of Artificial Sequence: Synthetic polypeptide
  VH of XENP018752

SEQ ID NO: 8584 - protein, 107 aa, Artificial Sequence
  Description of Artificial Sequence: Synthetic polypeptide
  VL of XENP018752
SIVMTQSPATLSVSAGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8585 - protein, 5 aa, Artificial Sequence
  Description of Artificial Sequence: Synthetic peptide
  XENP018752 vhCDR1
NYWMN

SEQ ID NO: 8586 - protein, 19 aa, Artificial Sequence
  Description of Artificial Sequence: Synthetic peptide
  XENP018752 vhCDR2
EIRLKSNNYATHYAEPVKG

SEQ ID NO: 8587 - protein, 11 aa, Artificial Sequence
  Description of Artificial Sequence: Synthetic peptide
  XENP018752 vhCDR3
YYGNYGGYFDV

SEQ ID NO: 8588 - protein, 11 aa, Artificial Sequence
  Description of Artificial Sequence: Synthetic peptide
  XENP018752 vlCDR1
RASQSVSNDVA

SEQ ID NO: 8589 - protein, 7 aa, Artificial Sequence
  Description of Artificial Sequence: Synthetic peptide
  XENP018752 vlCDR2
YASHRYT

SEQ ID NO: 8590 - protein, 9 aa, Artificial Sequence
  Description of Artificial Sequence: Synthetic peptide
  XENP018752 vlCDR3
QQDYSSPRT

SEQ ID NO: 8591 - protein, 249 aa, Artificial Sequence
  Description of Artificial Sequence: Synthetic polypeptide
  XENP018753 1G6_H1_L1.11_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGDRATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8592 - protein, 122 aa, Artificial Sequence; identical to SEQ ID NO: 6246
  Description of Artificial Sequence: Synthetic polypeptide
  VH of XENP018753

SEQ ID NO: 8593 - protein, 107 aa, Artificial Sequence
  Description of Artificial Sequence: Synthetic polypeptide
  VL of XENP018753
SIVMTQSPATLSVSPGDRATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8594 - protein, 5 aa, Artificial Sequence
  Description of Artificial Sequence: Synthetic peptide
  XENP018753 vhCDR1
NYWMN

SEQ ID NO: 8595 - protein, 19 aa, Artificial Sequence
  Description of Artificial Sequence: Synthetic peptide
  XENP018753 vhCDR2
EIRLKSNNYATHYAEPVKG

SEQ ID NO: 8596 - protein, 11 aa, Artificial Sequence
  Description of Artificial Sequence: Synthetic peptide
  XENP018753 vhCDR3
YYGNYGGYFDV

SEQ ID NO: 8597 - protein, 11 aa, Artificial Sequence
  Description of Artificial Sequence: Synthetic peptide
  XENP018753 vlCDR1
RASQSVSNDVA

SEQ ID NO: 8598 - protein, 7 aa, Artificial Sequence
  Description of Artificial Sequence: Synthetic peptide
  XENP018753 vlCDR2
YASHRYT

SEQ ID NO: 8599 - protein, 9 aa, Artificial Sequence
  Description of Artificial Sequence: Synthetic peptide
  XENP018753 vlCDR3
QQDYSSPRT

SEQ ID NO: 8600 - protein, 249 aa, Artificial Sequence
  Description of Artificial Sequence: Synthetic polypeptide
  XENP018754 1G6_H1_L1.12_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERVTLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8601 - protein, 122 aa, Artificial Sequence; identical to SEQ ID NO: 6246
  Description of Artificial Sequence: Synthetic polypeptide
  VH of XENP018754

SEQ ID NO: 8602 - protein, 107 aa, Artificial Sequence
  Description of Artificial Sequence: Synthetic polypeptide
  VL of XENP018754
SIVMTQSPATLSVSPGERVTLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8603 - protein, 5 aa, Artificial Sequence
  Description of Artificial Sequence: Synthetic peptide
  XENP018754 vhCDR1
NYWMN

SEQ ID NO: 8604 - protein, 19 aa, Artificial Sequence
  Description of Artificial Sequence: Synthetic peptide
  XENP018754 vhCDR2
EIRLKSNNYATHYAEPVKG

SEQ ID NO: 8605 - protein, 11 aa, Artificial Sequence
  Description of Artificial Sequence: Synthetic peptide
  XENP018754 vhCDR3
YYGNYGGYFDV

SEQ ID NO: 8606 - protein, 11 aa, Artificial Sequence
  Description of Artificial Sequence: Synthetic peptide
  XENP018754 vlCDR1
RASQSVSNDVA

SEQ ID NO: 8607 - protein, 7 aa, Artificial Sequence
  Description of Artificial Sequence: Synthetic peptide
  XENP018754 vlCDR2
YASHRYT

SEQ ID NO: 8608 - protein, 9 aa, Artificial Sequence
  Description of Artificial Sequence: Synthetic peptide
  XENP018754 vlCDR3
QQDYSSPRT

SEQ ID NO: 8609 - protein, 249 aa, Artificial Sequence
  Description of Artificial Sequence: Synthetic polypeptide
  XENP018755 1G6_H1_L1.13_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATISCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8610 - protein, 122 aa, Artificial Sequence; identical to SEQ ID NO: 6246
  Description of Artificial Sequence: Synthetic polypeptide
  VH of XENP018755

SEQ ID NO: 8611 - protein, 107 aa, Artificial Sequence
  Description of Artificial Sequence: Synthetic polypeptide
  VL of XENP018755
SIVMTQSPATLSVSPGERATISCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8612 - protein, 5 aa, Artificial Sequence
  Description of Artificial Sequence: Synthetic peptide
  XENP018755 vhCDR1
NYWMN

SEQ ID NO: 8613 - protein, 19 aa, Artificial Sequence
  Description of Artificial Sequence: Synthetic peptide
  XENP018755 vhCDR2
EIRLKSNNYATHYAEPVKG

SEQ ID NO: 8614 - protein, 11 aa, Artificial Sequence
  Description of Artificial Sequence: Synthetic peptide
  XENP018755 vhCDR3
YYGNYGGYFDV

SEQ ID NO: 8615 - protein, 11 aa, Artificial Sequence
  Description of Artificial Sequence: Synthetic peptide
  XENP018755 vlCDR1
RASQSVSNDVA

SEQ ID NO: 8616 - protein, 7 aa, Artificial Sequence
  Description of Artificial Sequence: Synthetic peptide
  XENP018755 vlCDR2
YASHRYT

SEQ ID NO: 8617 - protein, 9 aa, Artificial Sequence
  Description of Artificial Sequence: Synthetic peptide
  XENP018755 vlCDR3
QQDYSSPRT

SEQ ID NO: 8618 - protein, 249 aa, Artificial Sequence
  Description of Artificial Sequence: Synthetic polypeptide
  XENP018756 1G6_H1_L1.14_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLTCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8619 - protein, 122 aa, Artificial Sequence; identical to SEQ ID NO: 6246
  Description of Artificial Sequence: Synthetic polypeptide
  VH of XENP018756

SEQ ID NO: 8620 - protein, 107 aa, Artificial Sequence
  Description of Artificial Sequence: Synthetic polypeptide
  VL of XENP018756
SIVMTQSPATLSVSPGERATLTCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8621 - protein, 5 aa, Artificial Sequence
  Description of Artificial Sequence: Synthetic peptide
  XENP018756 vhCDR1
NYWMN

SEQ ID NO: 8622 - protein, 19 aa, Artificial Sequence
  Description of Artificial Sequence: Synthetic peptide
  XENP018756 vhCDR2
EIRLKSNNYATHYAEPVKG

SEQ ID NO: 8623 - protein, 11 aa, Artificial Sequence
  Description of Artificial Sequence: Synthetic peptide
  XENP018756 vhCDR3
YYGNYGGYFDV

SEQ ID NO: 8624 - protein, 11 aa, Artificial Sequence
  Description of Artificial Sequence: Synthetic peptide
  XENP018756 vlCDR1
RASQSVSNDVA

SEQ ID NO: 8625 - protein, 7 aa, Artificial Sequence
  Description of Artificial Sequence: Synthetic peptide
  XENP018756 vlCDR2
YASHRYT

SEQ ID NO: 8626 - protein, 9 aa, Artificial Sequence
  Description of Artificial Sequence: Synthetic peptide
  XENP018756 vlCDR3
QQDYSSPRT

SEQ ID NO: 8627 - protein, 249 aa, Artificial Sequence
  Description of Artificial Sequence: Synthetic polypeptide
  XENP018757 1G6_H1_L1.15_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCKASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8628 - protein, 122 aa, Artificial Sequence; identical to SEQ ID NO: 6246
  Description of Artificial Sequence: Synthetic polypeptide
  VH of XENP018757

SEQ ID NO: 8629 - protein, 107 aa, Artificial Sequence
  Description of Artificial Sequence: Synthetic polypeptide
  VL of XENP018757
SIVMTQSPATLSVSPGERATLSCKASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8630 - protein, 5 aa, Artificial Sequence
  Description of Artificial Sequence: Synthetic peptide
  XENP018757 vhCDR1
NYWMN

SEQ ID NO: 8631 - protein, 19 aa, Artificial Sequence
  Description of Artificial Sequence: Synthetic peptide
  XENP018757 vhCDR2
EIRLKSNNYATHYAEPVKG

SEQ ID NO: 8632 - protein, 11 aa, Artificial Sequence
  Description of Artificial Sequence: Synthetic peptide
  XENP018757 vhCDR3
YYGNYGGYFDV

SEQ ID NO: 8633 - protein, 11 aa, Artificial Sequence
  Description of Artificial Sequence: Synthetic peptide
  XENP018757 vlCDR1
KASQSVSNDVA

SEQ ID NO: 8634 - protein, 7 aa, Artificial Sequence
  Description of Artificial Sequence: Synthetic peptide
  XENP018757 vlCDR2
YASHRYT

SEQ ID NO: 8635 - protein, 9 aa, Artificial Sequence
  Description of Artificial Sequence: Synthetic peptide
  XENP018757 vlCDR3
QQDYSSPRT

SEQ ID NO: 8636 - protein, 249 aa, Artificial Sequence
  Description of Artificial Sequence: Synthetic polypeptide
  XENP018758 1G6_H1_L1.16_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQDVSNDVAWYQQKPGQSPRLLINYASHRYTGVPDRFTGSGYGTEFTLTISSLQSEDFAVYFCQQDYSSPRTFGGGTKVEIK

SEQ ID NO: 8637 - protein, 122 aa, Artificial Sequence; identical to SEQ ID NO: 6246
  Description of Artificial Sequence: Synthetic polypeptide
  VH of XENP018758

SEQ ID NO: 8638 - protein, 107 aa, Artificial Sequence
  Description of Artificial Sequence: Synthetic polypeptide
  VL of XENP018758
SIVMTQSPATLSVSPGERATLSCRASQDVSNDVAWYQQKPGQSPRLLINYASHRYTGVPDRFTGSGYGTEFTLTISSLQSEDFAVYFCQQDYSSPRTFGGGTKVEIK

SEQ ID NO: 8639 - protein, 5 aa, Artificial Sequence
  Description of Artificial Sequence: Synthetic peptide
  XENP018758 vhCDR1
NYWMN

SEQ ID NO: 8640 - protein, 19 aa, Artificial Sequence
  Description of Artificial Sequence: Synthetic peptide
  XENP018758 vhCDR2
EIRLKSNNYATHYAEPVKG

SEQ ID NO: 8641 - protein, 11 aa, Artificial Sequence
  Description of Artificial Sequence: Synthetic peptide
  XENP018758 vhCDR3
YYGNYGGYFDV

SEQ ID NO: 8642 - protein, 11 aa, Artificial Sequence
  Description of Artificial Sequence: Synthetic peptide
  XENP018758 vlCDR1
RASQDVSNDVA

SEQ ID NO: 8643 - protein, 7 aa, Artificial Sequence
  Description of Artificial Sequence: Synthetic peptide
  XENP018758 vlCDR2
YASHRYT

SEQ ID NO: 8644 - protein, 9 aa, Artificial Sequence
  Description of Artificial Sequence: Synthetic peptide
  XENP018758 vlCDR3
QQDYSSPRT

SEQ ID NO: 8645 - protein, 249 aa, Artificial Sequence
  Description of Artificial Sequence: Synthetic polypeptide
  XENP018759 1G6_H1_L1.17_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQGVSNDVAWYQQKPGQSPRLLINYASHRYTGVPDRFTGSGYGTEFTLTISSLQSEDFAVYFCQQDYSSPRTFGGGTKVEIK

SEQ ID NO: 8646 - protein, 122 aa, Artificial Sequence; identical to SEQ ID NO: 6246
  Description of Artificial Sequence: Synthetic polypeptide
  VH of XENP018759

SEQ ID NO: 8647 - protein, 107 aa, Artificial Sequence
  Description of Artificial Sequence: Synthetic polypeptide
  VL of XENP018759
SIVMTQSPATLSVSPGERATLSCRASQGVSNDVAWYQQKPGQSPRLLINYASHRYTGVPDRFTGSGYGTEFTLTISSLQSEDFAVYFCQQDYSSPRTFGGGTKVEIK

SEQ ID NO: 8648 - protein, 5 aa, Artificial Sequence
  Description of Artificial Sequence: Synthetic peptide
  XENP018759 vhCDR1
NYWMN

SEQ ID NO: 8649 - protein, 19 aa, Artificial Sequence
  Description of Artificial Sequence: Synthetic peptide
  XENP018759 vhCDR2
EIRLKSNNYATHYAEPVKG

SEQ ID NO: 8650 - protein, 11 aa, Artificial Sequence
  Description of Artificial Sequence: Synthetic peptide
  XENP018759 vhCDR3
YYGNYGGYFDV

SEQ ID NO: 8651 - protein, 11 aa, Artificial Sequence
  Description of Artificial Sequence: Synthetic peptide
  XENP018759 vlCDR1
RASQGVSNDVA

SEQ ID NO: 8652 - protein, 7 aa, Artificial Sequence
  Description of Artificial Sequence: Synthetic peptide
  XENP018759 vlCDR2
YASHRYT

SEQ ID NO: 8653 - protein, 9 aa, Artificial Sequence
  Description of Artificial Sequence: Synthetic peptide
  XENP018759 vlCDR3
QQDYSSPRT

SEQ ID NO: 8654 - protein, 249 aa, Artificial Sequence
  Description of Artificial Sequence: Synthetic polypeptide
  XENP018760 1G6_H1_L1.18_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSISNDVAWYQQKPGQSPRLLINYASHRYTGVPDRFTGSGYGTEFTLTISSLQSEDFAVYFCQQDYSSPRTFGGGTKVEIK

SEQ ID NO: 8655 - protein, 122 aa, Artificial Sequence; identical to SEQ ID NO: 6246
  Description of Artificial Sequence: Synthetic polypeptide
  VH of XENP018760

SEQ ID NO: 8656 - protein, 107 aa, Artificial Sequence
  Description of Artificial Sequence: Synthetic polypeptide
  VL of XENP018760
SIVMTQSPATLSVSPGERATLSCRASQSISNDVAWYQQKPGQSPRLLINYASHRYTGVPDRFTGSGYGTEFTLTISSLQSEDFAVYFCQQDYSSPRTFGGGTKVEIK

SEQ ID NO: 8657 - protein, 5 aa, Artificial Sequence
  Description of Artificial Sequence: Synthetic peptide
  XENP018760 vhCDR1
NYWMN

SEQ ID NO: 8658 - protein, 19 aa, Artificial Sequence
  Description of Artificial Sequence: Synthetic peptide
  XENP018760 vhCDR2
EIRLKSNNYATHYAEPVKG

SEQ ID NO: 8659 - protein, 11 aa, Artificial Sequence
  Description of Artificial Sequence: Synthetic peptide
  XENP018760 vhCDR3
YYGNYGGYFDV

SEQ ID NO: 8660 - protein, 11 aa, Artificial Sequence
  Description of Artificial Sequence: Synthetic peptide
  XENP018760 vlCDR1
RASQSISNDVA

SEQ ID NO: 8661 - protein, 7 aa, Artificial Sequence
  Description of Artificial Sequence: Synthetic peptide
  XENP018760 vlCDR2
YASHRYT

SEQ ID NO: 8662 - protein, 9 aa, Artificial Sequence
  Description of Artificial Sequence: Synthetic peptide
  XENP018760 vlCDR3
QQDYSSPRT

SEQ ID NO: 8663 - protein, 249 aa, Artificial Sequence
  Description of Artificial Sequence: Synthetic polypeptide
  XENP018761 1G6_H1_L1.19_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSLSNDVAWYQQKPGQSPRLLINYASHRYTGVPDRFTGSGYGTEFTLTISSLQSEDFAVYFCQQDYSSPRTFGGGTKVEIK

SEQ ID NO: 8664 - protein, 122 aa, Artificial Sequence; identical to SEQ ID NO: 6246
  Description of Artificial Sequence: Synthetic polypeptide
  VH of XENP018761

SEQ ID NO: 8665 - protein, 107 aa, Artificial Sequence
  Description of Artificial Sequence: Synthetic polypeptide
  VL of XENP018761
SIVMTQSPATLSVSPGERATLSCRASQSLSNDVAWYQQKPGQSPRLLINYASHRYTGVPDRFTGSGYGTEFTLTISSLQSEDFAVYFCQQDYSSPRTFGGGTKVEIK

SEQ ID NO: 8666 - protein, 5 aa, Artificial Sequence
  Description of Artificial Sequence: Synthetic peptide
  XENP018761 vhCDR1
NYWMN

SEQ ID NO: 8667 - protein, 19 aa, Artificial Sequence
  Description of Artificial Sequence: Synthetic peptide
  XENP018761 vhCDR2
EIRLKSNNYATHYAEPVKG

SEQ ID NO: 8668 - protein, 11 aa, Artificial Sequence
  Description of Artificial Sequence: Synthetic peptide
  XENP018761 vhCDR3
YYGNYGGYFDV

SEQ ID NO: 8669 - protein, 11 aa, Artificial Sequence
  Description of Artificial Sequence: Synthetic peptide
  XENP018761 vlCDR1
RASQSLSNDVA

SEQ ID NO: 8670 - protein, 7 aa, Artificial Sequence
  Description of Artificial Sequence: Synthetic peptide
  XENP018761 vlCDR2
YASHRYT

SEQ ID NO: 8671 - protein, 9 aa, Artificial Sequence
  Description of Artificial Sequence: Synthetic peptide
  XENP018761 vlCDR3
QQDYSSPRT

SEQ ID NO: 8672 - protein, 249 aa, Artificial Sequence
  Description of Artificial Sequence: Synthetic polypeptide
  XENP018762 1G6_H1_L1.20_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVTNDVAWYQQKPGQSPRLLINYASHRYTGVPDRFTGSGYGTEFTLTISSLQSEDFAVYFCQQDYSSPRTFGGGTKVEIK

SEQ ID NO: 8673 - protein, 122 aa, Artificial Sequence; identical to SEQ ID NO: 6246
  Description of Artificial Sequence: Synthetic polypeptide
  VH of XENP018762

SEQ ID NO: 8674 - protein, 107 aa, Artificial Sequence
  Description of Artificial Sequence: Synthetic polypeptide
  VL of XENP018762
SIVMTQSPATLSVSPGERATLSCRASQSVTNDVAWYQQKPGQSPRLLINYASHRYTGVPDRFTGSGYGTEFTLTISSLQSEDFAVYFCQQDYSSPRTFGGGTKVEIK

SEQ ID NO: 8675 - protein, 5 aa, Artificial Sequence
  Description of Artificial Sequence: Synthetic peptide
  XENP018762 vhCDR1
NYWMN

SEQ ID NO: 8676 - protein, 19 aa, Artificial Sequence
  Description of Artificial Sequence: Synthetic peptide
  XENP018762 vhCDR2
EIRLKSNNYATHYAEPVKG

SEQ ID NO: 8677 - protein, 11 aa, Artificial Sequence
  Description of Artificial Sequence: Synthetic peptide
  XENP018762 vhCDR3
YYGNYGGYFDV

SEQ ID NO: 8678 - protein, 11 aa, Artificial Sequence
  Description of Artificial Sequence: Synthetic peptide
  XENP018762 vlCDR1
RASQSVTNDVA

SEQ ID NO: 8679 - protein, 7 aa, Artificial Sequence
  Description of Artificial Sequence: Synthetic peptide
  XENP018762 vlCDR2
YASHRYT

SEQ ID NO: 8680 - protein, 9 aa, Artificial Sequence
  Description of Artificial Sequence: Synthetic peptide
  XENP018762 vlCDR3
QQDYSSPRT

SEQ ID NO: 8681 - protein, 249 aa, Artificial Sequence
  Description of Artificial Sequence: Synthetic polypeptide
  XENP018763 1G6_H1_L1.21_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVANDVAWYQQKPGQSPRLLINYASHRYTGVPDRFTGSGYGTEFTLTISSLQSEDFAVYFCQQDYSSPRTFGGGTKVEIK

SEQ ID NO: 8682 - protein, 122 aa, Artificial Sequence; identical to SEQ ID NO: 6246
  Description of Artificial Sequence: Synthetic polypeptide
  VH of XENP018763

SEQ ID NO: 8683 - protein, 107 aa, Artificial Sequence
  Description of Artificial Sequence: Synthetic polypeptide
  VL of XENP018763
SIVMTQSPATLSVSPGERATLSCRASQSVANDVAWYQQKPGQSPRLLINYASHRYTGVPDRFTGSGYGTEFTLTISSLQSEDFAVYFCQQDYSSPRTFGGGTKVEIK

SEQ ID NO: 8684 - protein, 5 aa, Artificial Sequence
  Description of Artificial Sequence: Synthetic peptide
  XENP018763 vhCDR1
NYWMN

SEQ ID NO: 8685 - protein, 19 aa, Artificial Sequence
  Description of Artificial Sequence: Synthetic peptide
  XENP018763 vhCDR2
EIRLKSNNYATHYAEPVKG

SEQ ID NO: 8686 - protein, 11 aa, Artificial Sequence
  Description of Artificial Sequence: Synthetic peptide
  XENP018763 vhCDR3
YYGNYGGYFDV

SEQ ID NO: 8687 - protein, 11 aa, Artificial Sequence
  Description of Artificial Sequence: Synthetic peptide
  XENP018763 vlCDR1
RASQSVANDVA

SEQ ID NO: 8688 - protein, 7 aa, Artificial Sequence
  Description of Artificial Sequence: Synthetic peptide
  XENP018763 vlCDR2
YASHRYT

SEQ ID NO: 8689 - protein, 9 aa, Artificial Sequence
  Description of Artificial Sequence: Synthetic peptide
  XENP018763 vlCDR3
QQDYSSPRT

SEQ ID NO: 8690 - protein, 249 aa, Artificial Sequence
  Description of Artificial Sequence: Synthetic polypeptide
  XENP018764 1G6_H1_L1.22_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVQNDVAWYQQKPGQSPRLLINYASHRYTGVPDRFTGSGYGTEFTLTISSLQSEDFAVYFCQQDYSSPRTFGGGTKVEIK

SEQ ID NO: 8691 - protein, 122 aa, Artificial Sequence; identical to SEQ ID NO: 6246
  Description of Artificial Sequence: Synthetic polypeptide
  VH of XENP018764

SEQ ID NO: 8692 - protein, 107 aa, Artificial Sequence
  Description of Artificial Sequence: Synthetic polypeptide
  VL of XENP018764
SIVMTQSPATLSVSPGERATLSCRASQSVQNDVAWYQQKPGQSPRLLINYASHRYTGVPDRFTGSGYGTEFTLTISSLQSEDFAVYFCQQDYSSPRTFGGGTKVEIK

SEQ ID NO: 8693 - protein, 5 aa, Artificial Sequence
  Description of Artificial Sequence: Synthetic peptide
  XENP018764 vhCDR1
NYWMN

SEQ ID NO: 8694 - protein, 19 aa, Artificial Sequence
  Description of Artificial Sequence: Synthetic peptide
  XENP018764 vhCDR2
EIRLKSNNYATHYAEPVKG

SEQ ID NO: 8695 - protein, 11 aa, Artificial Sequence
  Description of Artificial Sequence: Synthetic peptide
  XENP018764 vhCDR3
YYGNYGGYFDV

SEQ ID NO: 8696 - protein, 11 aa, Artificial Sequence
  Description of Artificial Sequence: Synthetic peptide
  XENP018764 vlCDR1
RASQSVQNDVA

SEQ ID NO: 8697 - protein, 7 aa, Artificial Sequence
  Description of Artificial Sequence: Synthetic peptide
  XENP018764 vlCDR2
YASHRYT

SEQ ID NO: 8698 - protein, 9 aa, Artificial Sequence
  Description of Artificial Sequence: Synthetic peptide
  XENP018764 vlCDR3
QQDYSSPRT

SEQ ID NO: 8699 - protein, 249 aa, Artificial Sequence
  Description of Artificial Sequence: Synthetic polypeptide
  XENP018765 1G6_H1_L1.23_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTGVPDRFTGSGYGTEFTLTISSLQSEDFAVYFCQQDYSSPRTFGGGTKVEIK

SEQ ID NO: 8700 - protein, 122 aa, Artificial Sequence; identical to SEQ ID NO: 6246
  Description of Artificial Sequence: Synthetic polypeptide
  VH of XENP018765

SEQ ID NO: 8701 - protein, 107 aa, Artificial Sequence
  Description of Artificial Sequence: Synthetic polypeptide
  VL of XENP018765
SIVMTQSPATLSVSPGERATLSCRASQSVGNDVAWYQQKPGQSPRLLINYASHRYTGVPDRFTGSGYGTEFTLTISSLQSEDFAVYFCQQDYSSPRTFGGGTKVEIK

SEQ ID NO: 8702 - protein, 5 aa, Artificial Sequence
  Description of Artificial Sequence: Synthetic peptide
  XENP018765 vhCDR1
NYWMN

SEQ ID NO: 8703 - protein, 19 aa, Artificial Sequence
  Description of Artificial Sequence: Synthetic peptide
  XENP018765 vhCDR2
EIRLKSNNYATHYAEPVKG

SEQ ID NO: 8704 - protein, 11 aa, Artificial Sequence
  Description of Artificial Sequence: Synthetic peptide
  XENP018765 vhCDR3
YYGNYGGYFDV

SEQ ID NO: 8705 - protein, 11 aa, Artificial Sequence
  Description of Artificial Sequence: Synthetic peptide
  XENP018765 vlCDR1
RASQSVGNDVA

SEQ ID NO: 8706 - protein, 7 aa, Artificial Sequence
  Description of Artificial Sequence: Synthetic peptide
  XENP018765 vlCDR2
YASHRYT

SEQ ID NO: 8707 - protein, 9 aa, Artificial Sequence
  Description of Artificial Sequence: Synthetic peptide
  XENP018765 vlCDR3
QQDYSSPRT

SEQ ID NO: 8708 - protein, 249 aa, Artificial Sequence
  Description of Artificial Sequence: Synthetic polypeptide
  XENP018766 1G6_H1_L1.24_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVVNDVAWYQQKPGQSPRLLINYASHRYTGVPDRFTGSGYGTEFTLTISSLQSEDFAVYFCQQDYSSPRTFGGGTKVEIK

SEQ ID NO: 8709 - protein, 122 aa, Artificial Sequence; identical to SEQ ID NO: 6246
  Description of Artificial Sequence: Synthetic polypeptide
  VH of XENP018766

SEQ ID NO: 8710 - protein, 107 aa, Artificial Sequence
  Description of Artificial Sequence: Synthetic polypeptide
  VL of XENP018766
SIVMTQSPATLSVSPGERATLSCRASQSVVNDVAWYQQKPGQSPRLLINYASHRYTGVPDRFTGSGYGTEFTLTISSLQSEDFAVYFCQQDYSSPRTFGGGTKVEIK

SEQ ID NO: 8711 - protein, 5 aa, Artificial Sequence
  Description of Artificial Sequence: Synthetic peptide
  XENP018766 vhCDR1
NYWMN

SEQ ID NO: 8712 - protein, 19 aa, Artificial Sequence
  Description of Artificial Sequence: Synthetic peptide
  XENP018766 vhCDR2
EIRLKSNNYATHYAEPVKG

SEQ ID NO: 8713 - protein, 11 aa, Artificial Sequence
  Description of Artificial Sequence: Synthetic peptide
  XENP018766 vhCDR3
YYGNYGGYFDV

SEQ ID NO: 8714 - protein, 11 aa, Artificial Sequence
  Description of Artificial Sequence: Synthetic peptide
  XENP018766 vlCDR1
RASQSVVNDVA

SEQ ID NO: 8715 - protein, 7 aa, Artificial Sequence
  Description of Artificial Sequence: Synthetic peptide
  XENP018766 vlCDR2
YASHRYT

SEQ ID NO: 8716 - protein, 9 aa, Artificial Sequence
  Description of Artificial Sequence: Synthetic peptide
  XENP018766 vlCDR3
QQDYSSPRT

SEQ ID NO: 8717 - protein, 249 aa, Artificial Sequence
  Description of Artificial Sequence: Synthetic polypeptide
  XENP018767 1G6_H1_L1.25_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVHNDVAWYQQKPGQSPRLLINYASHRYTGVPDRFTGSGYGTEFTLTISSLQSEDFAVYFCQQDYSSPRTFGGGTKVEIK

SEQ ID NO: 8718 - protein, 122 aa, Artificial Sequence; identical to SEQ ID NO: 6246
  Description of Artificial Sequence: Synthetic polypeptide
  VH of XENP018767

SEQ ID NO: 8719 - protein, 107 aa, Artificial Sequence
  Description of Artificial Sequence: Synthetic polypeptide
  VL of XENP018767
SIVMTQSPATLSVSPGERATLSCRASQSVHNDVAWYQQKPGQSPRLLINYASHRYTGVPDRFTGSGYGTEFTLTISSLQSEDFAVYFCQQDYSSPRTFGGGTKVEIK

SEQ ID NO: 8720 - protein, 5 aa, Artificial Sequence
  Description of Artificial Sequence: Synthetic peptide
  XENP018767 vhCDR1
NYWMN

SEQ ID NO: 8721 - protein, 19 aa, Artificial Sequence
  Description of Artificial Sequence: Synthetic peptide
  XENP018767 vhCDR2
EIRLKSNNYATHYAEPVKG

SEQ ID NO: 8722 - protein, 11 aa, Artificial Sequence
  Description of Artificial Sequence: Synthetic peptide
  XENP018767 vhCDR3
YYGNYGGYFDV

SEQ ID NO: 8723 - protein, 11 aa, Artificial Sequence
  Description of Artificial Sequence: Synthetic peptide
  XENP018767 vlCDR1
RASQSVHNDVA

SEQ ID NO: 8724 - protein, 7 aa, Artificial Sequence
  Description of Artificial Sequence: Synthetic peptide
  XENP018767 vlCDR2
YASHRYT

SEQ ID NO: 8725 - protein, 9 aa, Artificial Sequence
  Description of Artificial Sequence: Synthetic peptide
  XENP018767 vlCDR3
QQDYSSPRT

SEQ ID NO: 8726 - protein, 249 aa, Artificial Sequence
  Description of Artificial Sequence: Synthetic polypeptide
  XENP018768 1G6_H1_L1.26_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVDNDVAWYQQKPGQSPRLLINYASHRYTGVPDRFTGSGYGTEFTLTISSLQSEDFAVYFCQQDYSSPRTFGGGTKVEIK

SEQ ID NO: 8727 - protein, 122 aa, Artificial Sequence; identical to SEQ ID NO: 6246
  Description of Artificial Sequence: Synthetic polypeptide
  VH of XENP018768

SEQ ID NO: 8728 - protein, 107 aa, Artificial Sequence
  Description of Artificial Sequence: Synthetic polypeptide
  VL of XENP018768
SIVMTQSPATLSVSPGERATLSCRASQSVDNDVAWYQQKPGQSPRLLINYASHRYTGVPDRFTGSGYGTEFTLTISSLQSEDFAVYFCQQDYSSPRTFGGGTKVEIK

SEQ ID NO: 8729 - protein, 5 aa, Artificial Sequence
  Description of Artificial Sequence: Synthetic peptide
  XENP018768 vhCDR1
NYWMN

SEQ ID NO: 8730 - protein, 19 aa, Artificial Sequence
  Description of Artificial Sequence: Synthetic peptide
  XENP018768 vhCDR2
EIRLKSNNYATHYAEPVKG

SEQ ID NO: 8731 - protein, 11 aa, Artificial Sequence
  Description of Artificial Sequence: Synthetic peptide
  XENP018768 vhCDR3
YYGNYGGYFDV

SEQ ID NO: 8732 - protein, 11 aa, Artificial Sequence
  Description of Artificial Sequence: Synthetic peptide
  XENP018768 vlCDR1
RASQSVDNDVA

SEQ ID NO: 8733 - protein, 7 aa, Artificial Sequence
  Description of Artificial Sequence: Synthetic peptide
  XENP018768 vlCDR2
YASHRYT

SEQ ID NO: 8734 - protein, 9 aa, Artificial Sequence
  Description of Artificial Sequence: Synthetic peptide
  XENP018768 vlCDR3
QQDYSSPRT

SEQ ID NO: 8735 - protein, 249 aa, Artificial Sequence
  Description of Artificial Sequence: Synthetic polypeptide
  XENP018769 1G6_H1_L1.27_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVKNDVAWYQQKPGQSPRLLINYASHRYTGVPDRFTGSGYGTEFTLTISSLQSEDFAVYFCQQDYSSPRTFGGGTKVEIK

SEQ ID NO: 8736 - protein, 122 aa, Artificial Sequence; identical to SEQ ID NO: 6246
  Description of Artificial Sequence: Synthetic polypeptide
  VH of XENP018769

SEQ ID NO: 8737 - protein, 107 aa, Artificial Sequence
  Description of Artificial Sequence: Synthetic polypeptide
  VL of XENP018769
SIVMTQSPATLSVSPGERATLSCRASQSVKNDVAWYQQKPGQSPRLLINYASHRYTGVPDRFTGSGYGTEFTLTISSLQSEDFAVYFCQQDYSSPRTFGGGTKVEIK

SEQ ID NO: 8738 - protein, 5 aa, Artificial Sequence
  Description of Artificial Sequence: Synthetic peptide
  XENP018769 vhCDR1
NYWMN

SEQ ID NO: 8739 - protein, 19 aa, Artificial Sequence
  Description of Artificial Sequence: Synthetic peptide
  XENP018769 vhCDR2
EIRLKSNNYATHYAEPVKG

SEQ ID NO: 8740 - protein, 11 aa, Artificial Sequence
  Description of Artificial Sequence: Synthetic peptide
  XENP018769 vhCDR3
YYGNYGGYFDV

SEQ ID NO: 8741 - protein, 11 aa, Artificial Sequence
  Description of Artificial Sequence: Synthetic peptide
  XENP018769 vlCDR1
RASQSVKNDVA

SEQ ID NO: 8742 - protein, 7 aa, Artificial Sequence
  Description of Artificial Sequence: Synthetic peptide
  XENP018769 vlCDR2
YASHRYT

SEQ ID NO: 8743 - protein, 9 aa, Artificial Sequence
  Description of Artificial Sequence: Synthetic peptide
  XENP018769 vlCDR3
QQDYSSPRT

SEQ ID NO: 8744 - protein, 249 aa, Artificial Sequence
  Description of Artificial Sequence: Synthetic polypeptide
  XENP018770 1G6_H1_L1.28_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVYNDVAWYQQKPGQSPRLLINYASHRYTGVPDRFTGSGYGTEFTLTISSLQSEDFAVYFCQQDYSSPRTFGGGTKVEIK

SEQ ID NO: 8745 - protein, 122 aa, Artificial Sequence; identical to SEQ ID NO: 6246
  Description of Artificial Sequence: Synthetic polypeptide
  VH of XENP018770

SEQ ID NO: 8746 - protein, 107 aa, Artificial Sequence
  Description of Artificial Sequence: Synthetic polypeptide
  VL of XENP018770
SIVMTQSPATLSVSPGERATLSCRASQSVYNDVAWYQQKPGQSPRLLINYASHRYTGVPDRFTGSGYGTEFTLTISSLQSEDFAVYFCQQDYSSPRTFGGGTKVEIK

SEQ ID NO: 8747 - protein, 5 aa, Artificial Sequence
  Description of Artificial Sequence: Synthetic peptide
  XENP018770 vhCDR1
NYWMN

SEQ ID NO: 8748 - protein, 19 aa, Artificial Sequence
  Description of Artificial Sequence: Synthetic peptide
  XENP018770 vhCDR2
EIRLKSNNYATHYAEPVKG

SEQ ID NO: 8749 - protein, 11 aa, Artificial Sequence
  Description of Artificial Sequence: Synthetic peptide
  XENP018770 vhCDR3
YYGNYGGYFDV

SEQ ID NO: 8750 - protein, 11 aa, Artificial Sequence
  Description of Artificial Sequence: Synthetic peptide
  XENP018770 vlCDR1
RASQSVYNDVA

SEQ ID NO: 8751 - protein, 7 aa, Artificial Sequence
  Description of Artificial Sequence: Synthetic peptide
  XENP018770 vlCDR2
YASHRYT

SEQ ID NO: 8752 - protein, 9 aa, Artificial Sequence
  Description of Artificial Sequence: Synthetic peptide
  XENP018770 vlCDR3
QQDYSSPRT

SEQ ID NO: 8753 - protein, 249 aa, Artificial Sequence
  Description of Artificial Sequence: Synthetic polypeptide
  XENP018771 1G6_H1_L1.29_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSDDVAWYQQKPGQSPRLLINYASHRYTGVPDRFTGSGYGTEFTLTISSLQSEDFAVYFCQQDYSSPRTFGGGTKVEIK

SEQ ID NO: 8754 - protein, 122 aa, Artificial Sequence; identical to SEQ ID NO: 6246
  Description of Artificial Sequence: Synthetic polypeptide
  VH of XENP018771

SEQ ID NO: 8755 - protein, 107 aa, Artificial Sequence
  Description of Artificial Sequence: Synthetic polypeptide
  VL of XENP018771
SIVMTQSPATLSVSPGERATLSCRASQSVSDDVAWYQQKPGQSPRLLINYASHRYTGVPDRFTGSGYGTEFTLTISSLQSEDFAVYFCQQDYSSPRTFGGGTKVEIK

SEQ ID NO: 8756 - protein, 5 aa, Artificial Sequence
  Description of Artificial Sequence: Synthetic peptide
  XENP018771 vhCDR1
NYWMN

SEQ ID NO: 8757 - protein, 19 aa, Artificial Sequence
  Description of Artificial Sequence: Synthetic peptide
  XENP018771 vhCDR2
EIRLKSNNYATHYAEPVKG

SEQ ID NO: 8758 - protein, 11 aa, Artificial Sequence
  Description of Artificial Sequence: Synthetic peptide
  XENP018771 vhCDR3
YYGNYGGYFDV

SEQ ID NO: 8759 - protein, 11 aa, Artificial Sequence
  Description of Artificial Sequence: Synthetic peptide
  XENP018771 vlCDR1
RASQSVSDDVA

SEQ ID NO: 8760 - protein, 7 aa, Artificial Sequence
  Description of Artificial Sequence: Synthetic peptide
  XENP018771 vlCDR2
YASHRYT

SEQ ID NO: 8761 - protein, 9 aa, Artificial Sequence
  Description of Artificial Sequence: Synthetic peptide
  XENP018771 vlCDR3
QQDYSSPRT

SEQ ID NO: 8762 - protein, 249 aa, Artificial Sequence
  Description of Artificial Sequence: Synthetic polypeptide
  XENP018772 1G6_H1_L1.30_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSHDVAWYQQKPGQSPRLLINYASHRYTGVPDRFTGSGYGTEFTLTISSLQSEDFAVYFCQQDYSSPRTFGGGTKVEIK

SEQ ID NO: 8763 - protein, 122 aa, Artificial Sequence; identical to SEQ ID NO: 6246
  Description of Artificial Sequence: Synthetic polypeptide
  VH of XENP018772

SEQ ID NO: 8764 - protein, 107 aa, Artificial Sequence
  Description of Artificial Sequence: Synthetic polypeptide
  VL of XENP018772
SIVMTQSPATLSVSPGERATLSCRASQSVSHDVAWYQQKPGQSPRLLINYASHRYTGVPDRFTGSGYGTEFTLTISSLQSEDFAVYFCQQDYSSPRTFGGGTKVEIK

SEQ ID NO: 8765 - protein, 5 aa, Artificial Sequence
  Description of Artificial Sequence: Synthetic peptide
  XENP018772 vhCDR1
NYWMN

SEQ ID NO: 8766 - protein, 19 aa, Artificial Sequence
  Description of Artificial Sequence: Synthetic peptide
  XENP018772 vhCDR2
EIRLKSNNYATHYAEPVKG

SEQ ID NO: 8767 - protein, 11 aa, Artificial Sequence
  Description of Artificial Sequence: Synthetic peptide
  XENP018772 vhCDR3
YYGNYGGYFDV

SEQ ID NO: 8768 - protein, 11 aa, Artificial Sequence
  Description of Artificial Sequence: Synthetic peptide
  XENP018772 vlCDR1
RASQSVSHDVA

SEQ ID NO: 8769 - protein, 7 aa, Artificial Sequence
  Description of Artificial Sequence: Synthetic peptide
  XENP018772 vlCDR2
YASHRYT

SEQ ID NO: 8770 - protein, 9 aa, Artificial Sequence
  Description of Artificial Sequence: Synthetic peptide
  XENP018772 vlCDR3
QQDYSSPRT

SEQ ID NO: 8771 - protein, 249 aa, Artificial Sequence
  Description of Artificial Sequence: Synthetic polypeptide
  XENP018773 1G6_H1_L1.31_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSEDVAWYQQKPGQSPRLLINYASHRYTGVPDRFTGSGYGTEFTLTISSLQSEDFAVYFCQQDYSSPRTFGGGTKVEIK

SEQ ID NO: 8772 - protein, 122 aa, Artificial Sequence; identical to SEQ ID NO: 6246
  Description of Artificial Sequence: Synthetic polypeptide
  VH of XENP018773

SEQ ID NO: 8773 - protein, 107 aa, Artificial Sequence
  Description of Artificial Sequence: Synthetic polypeptide
  VL of XENP018773
SIVMTQSPATLSVSPGERATLSCRASQSVSEDVAWYQQKPGQSPRLLINYASHRYTGVPDRFTGSGYGTEFTLTISSLQSEDFAVYFCQQDYSSPRTFGGGTKVEIK

SEQ ID NO: 8774 - protein, 5 aa, Artificial Sequence
  Description of Artificial Sequence: Synthetic peptide
  XENP018773 vhCDR1
NYWMN

SEQ ID NO: 8775 - protein, 19 aa, Artificial Sequence
  Description of Artificial Sequence: Synthetic peptide
  XENP018773 vhCDR2
EIRLKSNNYATHYAEPVKG

SEQ ID NO: 8776 - protein, 11 aa, Artificial Sequence
  Description of Artificial Sequence: Synthetic peptide
  XENP018773 vhCDR3
YYGNYGGYFDV

SEQ ID NO: 8777 - protein, 11 aa, Artificial Sequence
  Description of Artificial Sequence: Synthetic peptide
  XENP018773 vlCDR1
RASQSVSEDVA

SEQ ID NO: 8778 - protein, 7 aa, Artificial Sequence
  Description of Artificial Sequence: Synthetic peptide
  XENP018773 vlCDR2
YASHRYT

SEQ ID NO: 8779 - protein, 9 aa, Artificial Sequence
  Description of Artificial Sequence: Synthetic peptide
  XENP018773 vlCDR3
QQDYSSPRT

SEQ ID NO: 8780 - protein, 249 aa, Artificial Sequence
  Description of Artificial Sequence: Synthetic polypeptide
  XENP018774 1G6_H1_L1.32_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSSDVAWYQQKPGQSPRLLINYASHRYTGVPDRFTGSGYGTEFTLTISSLQSEDFAVYFCQQDYSSPRTFGGGTKVEIK

SEQ ID NO: 8781 - protein, 122 aa, Artificial Sequence; identical to SEQ ID NO: 6246
  Description of Artificial Sequence: Synthetic polypeptide
  VH of XENP018774

SEQ ID NO: 8782 - protein, 107 aa, Artificial Sequence
  Description of Artificial Sequence: Synthetic polypeptide
  VL of XENP018774
SIVMTQSPATLSVSPGERATLSCRASQSVSSDVAWYQQKPGQSPRLLINYASHRYTGVPDRFTGSGYGTEFTLTISSLQSEDFAVYFCQQDYSSPRTFGGGTKVEIK

SEQ ID NO: 8783 - protein, 5 aa, Artificial Sequence
  Description of Artificial Sequence: Synthetic peptide
  XENP018774 vhCDR1
NYWMN

SEQ ID NO: 8784 - protein, 19 aa, Artificial Sequence
  Description of Artificial Sequence: Synthetic peptide
  XENP018774 vhCDR2
EIRLKSNNYATHYAEPVKG

SEQ ID NO: 8785 - protein, 11 aa, Artificial Sequence
  Description of Artificial Sequence: Synthetic peptide
  XENP018774 vhCDR3
YYGNYGGYFDV

SEQ ID NO: 8786 - protein, 11 aa, Artificial Sequence
  Description of Artificial Sequence: Synthetic peptide
  XENP018774 vlCDR1
RASQSVSSDVA

SEQ ID NO: 8787 - protein, 7 aa, Artificial Sequence
  Description of Artificial Sequence: Synthetic peptide
  XENP018774 vlCDR2
YASHRYT

SEQ ID NO: 8788 - protein, 9 aa, Artificial Sequence
  Description of Artificial Sequence: Synthetic peptide
  XENP018774 vlCDR3
QQDYSSPRT

SEQ ID NO: 8789 - protein, 249 aa, Artificial Sequence
  Description of Artificial Sequence: Synthetic polypeptide
  XENP018775 1G6_H1_L1.33_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSRDVAWYQQKPGQSPRLLINYASHRYTGVPDRFTGSGYGTEFTLTISSLQSEDFAVYFCQQDYSSPRTFGGGTKVEIK

SEQ ID NO: 8790 - protein, 122 aa, Artificial Sequence; identical to SEQ ID NO: 6246
  Description of Artificial Sequence: Synthetic polypeptide
  VH of XENP018775

SEQ ID NO: 8791 - protein, 107 aa, Artificial Sequence
  Description of Artificial Sequence: Synthetic polypeptide
  VL of XENP018775
SIVMTQSPATLSVSPGERATLSCRASQSVSRDVAWYQQKPGQSPRLLINYASHRYTGVPDRFTGSGYGTEFTLTISSLQSEDFAVYFCQQDYSSPRTFGGGTKVEIK

SEQ ID NO: 8792 - protein, 5 aa, Artificial Sequence
  Description of Artificial Sequence: Synthetic peptide
  XENP018775 vhCDR1
NYWMN

SEQ ID NO: 8793 - protein, 19 aa, Artificial Sequence
  Description of Artificial Sequence: Synthetic peptide
  XENP018775 vhCDR2
EIRLKSNNYATHYAEPVKG

SEQ ID NO: 8794 - protein, 11 aa, Artificial Sequence
  Description of Artificial Sequence: Synthetic peptide
  XENP018775 vhCDR3
YYGNYGGYFDV

SEQ ID NO: 8795 - protein, 11 aa, Artificial Sequence
  Description of Artificial Sequence: Synthetic peptide
  XENP018775 vlCDR1
RASQSVSRDVA

SEQ ID NO: 8796 - protein, 7 aa, Artificial Sequence
  Description of Artificial Sequence: Synthetic peptide
  XENP018775 vlCDR2
YASHRYT

SEQ ID NO: 8797 - protein, 9 aa, Artificial Sequence
  Description of Artificial Sequence: Synthetic peptide
  XENP018775 vlCDR3
QQDYSSPRT

SEQ ID NO: 8798 - protein, 249 aa, Artificial Sequence
  Description of Artificial Sequence: Synthetic polypeptide
  XENP018776 1G6_H1_L1.34_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSLDVAWYQQKPGQSPRLLINYASHRYTGVPDRFTGSGYGTEFTLTISSLQSEDFAVYFCQQDYSSPRTFGGGTKVEIK

SEQ ID NO: 8799 - protein, 122 aa, Artificial Sequence; identical to SEQ ID NO: 6246
  Description of Artificial Sequence: Synthetic polypeptide
  VH of XENP018776

SEQ ID NO: 8800 - protein, 107 aa, Artificial Sequence
  Description of Artificial Sequence: Synthetic polypeptide
  VL of XENP018776
SIVMTQSPATLSVSPGERATLSCRASQSVSLDVAWYQQKPGQSPRLLINYASHRYTGVPDRFTGSGYGTEFTLTISSLQSEDFAVYFCQQDYSSPRTFGGGTKVEIK

SEQ ID NO: 8801 - protein, 5 aa, Artificial Sequence
  Description of Artificial Sequence: Synthetic peptide
  XENP018776 vhCDR1
NYWMN

SEQ ID NO: 8802 - protein, 19 aa, Artificial Sequence
  Description of Artificial Sequence: Synthetic peptide
  XENP018776 vhCDR2
EIRLKSNNYATHYAEPVKG

SEQ ID NO: 8803 - protein, 11 aa, Artificial Sequence
  Description of Artificial Sequence: Synthetic peptide
  XENP018776 vhCDR3
YYGNYGGYFDV

SEQ ID NO: 8804 - protein, 11 aa, Artificial Sequence
  Description of Artificial Sequence: Synthetic peptide
  XENP018776 vlCDR1
RASQSVSLDVA

SEQ ID NO: 8805 - protein, 7 aa, Artificial Sequence
  Description of Artificial Sequence: Synthetic peptide
  XENP018776 vlCDR2
YASHRYT

SEQ ID NO: 8806 - protein, 9 aa, Artificial Sequence
  Description of Artificial Sequence: Synthetic peptide
  XENP018776 vlCDR3
QQDYSSPRT

SEQ ID NO: 8807 - protein, 249 aa, Artificial Sequence
  Description of Artificial Sequence: Synthetic polypeptide
  XENP018777 1G6_H1_L1.35_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSTDVAWYQQKPGQSPRLLINYASHRYTGVPDRFTGSGYGTEFTLTISSLQSEDFAVYFCQQDYSSPRTFGGGTKVEIK

SEQ ID NO: 8808 - protein, 122 aa, Artificial Sequence; identical to SEQ ID NO: 6246
  Description of Artificial Sequence: Synthetic polypeptide
  VH of XENP018777

SEQ ID NO: 8809 - protein, 107 aa, Artificial Sequence
  Description of Artificial Sequence: Synthetic polypeptide
  VL of XENP018777
SIVMTQSPATLSVSPGERATLSCRASQSVSTDVAWYQQKPGQSPRLLINYASHRYTGVPDRFTGSGYGTEFTLTISSLQSEDFAVYFCQQDYSSPRTFGGGTKVEIK

SEQ ID NO: 8810 - protein, 5 aa, Artificial Sequence
  Description of Artificial Sequence: Synthetic peptide
  XENP018777 vhCDR1
NYWMN

SEQ ID NO: 8811 - protein, 19 aa, Artificial Sequence
  Description of Artificial Sequence: Synthetic peptide
  XENP018777 vhCDR2
EIRLKSNNYATHYAEPVKG

SEQ ID NO: 8812 - protein, 11 aa, Artificial Sequence
  Description of Artificial Sequence: Synthetic peptide
  XENP018777 vhCDR3
YYGNYGGYFDV

SEQ ID NO: 8813 - protein, 11 aa, Artificial Sequence
  Description of Artificial Sequence: Synthetic peptide
  XENP018777 vlCDR1
RASQSVSTDVA

SEQ ID NO: 8814 - protein, 7 aa, Artificial Sequence
  Description of Artificial Sequence: Synthetic peptide
  XENP018777 vlCDR2
YASHRYT

SEQ ID NO: 8815 - protein, 9 aa, Artificial Sequence
  Description of Artificial Sequence: Synthetic peptide
  XENP018777 vlCDR3
QQDYSSPRT

SEQ ID NO: 8816 - protein, 249 aa, Artificial Sequence
  Description of Artificial Sequence: Synthetic polypeptide
  XENP018778 1G6_H1_L1.36_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSGDVAWYQQKPGQSPRLLINYASHRYTGVPDRFTGSGYGTEFTLTISSLQSEDFAVYFCQQDYSSPRTFGGGTKVEIK

SEQ ID NO: 8817 - protein, 122 aa, Artificial Sequence; identical to SEQ ID NO: 6246
  Description of Artificial Sequence: Synthetic polypeptide
  VH of XENP018778

SEQ ID NO: 8818 - protein, 107 aa, Artificial Sequence
  Description of Artificial Sequence: Synthetic polypeptide
  VL of XENP018778
SIVMTQSPATLSVSPGERATLSCRASQSVSGDVAWYQQKPGQSPRLLINYASHRYTGVPDRFTGSGYGTEFTLTISSLQSEDFAVYFCQQDYSSPRTFGGGTKVEIK

SEQ ID NO: 8819 - protein, 5 aa, Artificial Sequence
  Description of Artificial Sequence: Synthetic peptide
  XENP018778 vhCDR1
NYWMN

SEQ ID NO: 8820 - protein, 19 aa, Artificial Sequence
  Description of Artificial Sequence: Synthetic peptide
  XENP018778 vhCDR2
EIRLKSNNYATHYAEPVKG

SEQ ID NO: 8821 - protein, 11 aa, Artificial Sequence
  Description of Artificial Sequence: Synthetic peptide
  XENP018778 vhCDR3
YYGNYGGYFDV

SEQ ID NO: 8822 - protein, 11 aa, Artificial Sequence
  Description of Artificial Sequence: Synthetic peptide
  XENP018778 vlCDR1
RASQSVSGDVA

SEQ ID NO: 8823 - protein, 7 aa, Artificial Sequence
  Description of Artificial Sequence: Synthetic peptide
  XENP018778 vlCDR2
YASHRYT

SEQ ID NO: 8824 - protein, 9 aa, Artificial Sequence
  Description of Artificial Sequence: Synthetic peptide
  XENP018778 vlCDR3
QQDYSSPRT

SEQ ID NO: 8825 - protein, 249 aa, Artificial Sequence
  Description of Artificial Sequence: Synthetic polypeptide
  XENP018779 1G6_H1_L1.37_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSYDVAWYQQKPGQSPRLLINYASHRYTGVPDRFTGSGYGTEFTLTISSLQSEDFAVYFCQQDYSSPRTFGGGTKVEIK

SEQ ID NO: 8826 - protein, 122 aa, Artificial Sequence; identical to SEQ ID NO: 6246
  Description of Artificial Sequence: Synthetic polypeptide
  VH of XENP018779

SEQ ID NO: 8827 - protein, 107 aa, Artificial Sequence
  Description of Artificial Sequence: Synthetic polypeptide
  VL of XENP018779
SIVMTQSPATLSVSPGERATLSCRASQSVSYDVAWYQQKPGQSPRLLINYASHRYTGVPDRFTGSGYGTEFTLTISSLQSEDFAVYFCQQDYSSPRTFGGGTKVEIK

SEQ ID NO: 8828 - protein, 5 aa, Artificial Sequence
  Description of Artificial Sequence: Synthetic peptide
  XENP018779 vhCDR1
NYWMN

SEQ ID NO: 8829 - protein, 19 aa, Artificial Sequence
  Description of Artificial Sequence: Synthetic peptide
  XENP018779 vhCDR2
EIRLKSNNYATHYAEPVKG

SEQ ID NO: 8830 - protein, 11 aa, Artificial Sequence
  Description of Artificial Sequence: Synthetic peptide
  XENP018779 vhCDR3
YYGNYGGYFDV

SEQ ID NO: 8831 - protein, 11 aa, Artificial Sequence
  Description of Artificial Sequence: Synthetic peptide
  XENP018779 vlCDR1
RASQSVSYDVA

SEQ ID NO: 8832 - protein, 7 aa, Artificial Sequence
  Description of Artificial Sequence: Synthetic peptide
  XENP018779 vlCDR2
YASHRYT

SEQ ID NO: 8833 - protein, 9 aa, Artificial Sequence
  Description of Artificial Sequence: Synthetic peptide
  XENP018779 vlCDR3
QQDYSSPRT

SEQ ID NO: 8834 - protein, 249 aa, Artificial Sequence
  Description of Artificial Sequence: Synthetic polypeptide
  XENP018780 1G6_H1_L1.38_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNNVAWYQQKPGQSPRLLINYASHRYTGVPDRFTGSGYGTEFTLTISSLQSEDFAVYFCQQDYSSPRTFGGGTKVEIK

SEQ ID NO: 8835 - protein, 122 aa, Artificial Sequence; identical to SEQ ID NO: 6246
  Description of Artificial Sequence: Synthetic polypeptide
  VH of XENP018780

SEQ ID NO: 8836 - protein, 107 aa, Artificial Sequence
  Description of Artificial Sequence: Synthetic polypeptide
  VL of XENP018780
SIVMTQSPATLSVSPGERATLSCRASQSVSNNVAWYQQKPGQSPRLLINYASHRYTGVPDRFTGSGYGTEFTLTISSLQSEDFAVYFCQQDYSSPRTFGGGTKVEIK

SEQ ID NO: 8837 - protein, 5 aa, Artificial Sequence
  Description of Artificial Sequence: Synthetic peptide
  XENP018780 vhCDR1
NYWMN

SEQ ID NO: 8838 - protein, 19 aa, Artificial Sequence
  Description of Artificial Sequence: Synthetic peptide
  XENP018780 vhCDR2
EIRLKSNNYATHYAEPVKG

SEQ ID NO: 8839 - protein, 11 aa, Artificial Sequence
  Description of Artificial Sequence: Synthetic peptide
  XENP018780 vhCDR3
YYGNYGGYFDV

SEQ ID NO: 8840 - protein, 11 aa, Artificial Sequence
  Description of Artificial Sequence: Synthetic peptide
  XENP018780 vlCDR1
RASQSVSNNVA

SEQ ID NO: 8841 - protein, 7 aa, Artificial Sequence
  Description of Artificial Sequence: Synthetic peptide
  XENP018780 vlCDR2
YASHRYT

SEQ ID NO: 8842 - protein, 9 aa, Artificial Sequence
  Description of Artificial Sequence: Synthetic peptide
  XENP018780 vlCDR3
QQDYSSPRT

SEQ ID NO: 8843 - protein, 249 aa, Artificial Sequence
  Description of Artificial Sequence: Synthetic polypeptide
  XENP018781 1G6_H1_L1.39_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNEVAWYQQKPGQSPRLLINYASHRYTGVPDRFTGSGYGTEFTLTISSLQSEDFAVYFCQQDYSSPRTFGGGTKVEIK

SEQ ID NO: 8844 - protein, 122 aa, Artificial Sequence; identical to SEQ ID NO: 6246
  Description of Artificial Sequence: Synthetic polypeptide
  VH of XENP018781

SEQ ID NO: 8845 - protein, 107 aa, Artificial Sequence
  Description of Artificial Sequence: Synthetic polypeptide
  VL of XENP018781
SIVMTQSPATLSVSPGERATLSCRASQSVSNEVAWYQQKPGQSPRLLINYASHRYTGVPDRFTGSGYGTEFTLTISSLQSEDFAVYFCQQDYSSPRTFGGGTKVEIK

SEQ ID NO: 8846 - protein, 5 aa, Artificial Sequence
  Description of Artificial Sequence: Synthetic peptide
  XENP018781 vhCDR1
NYWMN

SEQ ID NO: 8847 - protein, 19 aa, Artificial Sequence
  Description of Artificial Sequence: Synthetic peptide
  XENP018781 vhCDR2
EIRLKSNNYATHYAEPVKG

SEQ ID NO: 8848 - protein, 11 aa, Artificial Sequence
  Description of Artificial Sequence: Synthetic peptide
  XENP018781 vhCDR3
YYGNYGGYFDV

SEQ ID NO: 8849 - protein, 11 aa, Artificial Sequence
  Description of Artificial Sequence: Synthetic peptide
  XENP018781 vlCDR1
RASQSVSNEVA

SEQ ID NO: 8850 - protein, 7 aa, Artificial Sequence
  Description of Artificial Sequence: Synthetic peptide
  XENP018781 vlCDR2
YASHRYT

SEQ ID NO: 8851 - protein, 9 aa, Artificial Sequence
  Description of Artificial Sequence: Synthetic peptide
  XENP018781 vlCDR3
QQDYSSPRT

SEQ ID NO: 8852 - protein, 249 aa, Artificial Sequence
  Description of Artificial Sequence: Synthetic polypeptide
  XENP018782 1G6_H1_L1.40_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNHVAWYQQKPGQSPRLLINYASHRYTGVPDRFTGSGYGTEFTLTISSLQSEDFAVYFCQQDYSSPRTFGGGTKVEIK

SEQ ID NO: 8853 - protein, 122 aa, Artificial Sequence; identical to SEQ ID NO: 6246
  Description of Artificial Sequence: Synthetic polypeptide
  VH of XENP018782

SEQ ID NO: 8854 - protein, 107 aa, Artificial Sequence
  Description of Artificial Sequence: Synthetic polypeptide
  VL of XENP018782
SIVMTQSPATLSVSPGERATLSCRASQSVSNHVAWYQQKPGQSPRLLINYASHRYTGVPDRFTGSGYGTEFTLTISSLQSEDFAVYFCQQDYSSPRTFGGGTKVEIK

SEQ ID NO: 8855 - protein, 5 aa, Artificial Sequence
  Description of Artificial Sequence: Synthetic peptide
  XENP018782 vhCDR1
NYWMN

SEQ ID NO: 8856 - protein, 19 aa, Artificial Sequence
  Description of Artificial Sequence: Synthetic peptide
  XENP018782 vhCDR2
EIRLKSNNYATHYAEPVKG

SEQ ID NO: 8857 - protein, 11 aa, Artificial Sequence
  Description of Artificial Sequence: Synthetic peptide
  XENP018782 vhCDR3
YYGNYGGYFDV

SEQ ID NO: 8858 - protein, 11 aa, Artificial Sequence
  Description of Artificial Sequence: Synthetic peptide
  XENP018782 vlCDR1
RASQSVSNHVA

SEQ ID NO: 8859 - protein, 7 aa, Artificial Sequence
  Description of Artificial Sequence: Synthetic peptide
  XENP018782 vlCDR2
YASHRYT

SEQ ID NO: 8860 - protein, 9 aa, Artificial Sequence
  Description of Artificial Sequence: Synthetic peptide
  XENP018782 vlCDR3
QQDYSSPRT

SEQ ID NO: 8861 - protein, 249 aa, Artificial Sequence
  Description of Artificial Sequence: Synthetic polypeptide
  XENP018783 1G6_H1_L1.41_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNSVAWYQQKPGQSPRLLINYASHRYTGVPDRFTGSGYGTEFTLTISSLQSEDFAVYFCQQDYSSPRTFGGGTKVEIK

SEQ ID NO: 8862 - protein, 122 aa, Artificial Sequence; identical to SEQ ID NO: 6246
  Description of Artificial Sequence: Synthetic polypeptide
  VH of XENP018783

SEQ ID NO: 8863 - protein, 107 aa, Artificial Sequence
  Description of Artificial Sequence: Synthetic polypeptide
  VL of XENP018783
SIVMTQSPATLSVSPGERATLSCRASQSVSNSVAWYQQKPGQSPRLLINYASHRYTGVPDRFTGSGYGTEFTLTISSLQSEDFAVYFCQQDYSSPRTFGGGTKVEIK

SEQ ID NO: 8864 - protein, 5 aa, Artificial Sequence
  Description of Artificial Sequence: Synthetic peptide
  XENP018783 vhCDR1
NYWMN

SEQ ID NO: 8865 - protein, 19 aa, Artificial Sequence
  Description of Artificial Sequence: Synthetic peptide
  XENP018783 vhCDR2
EIRLKSNNYATHYAEPVKG

SEQ ID NO: 8866 - protein, 11 aa, Artificial Sequence
  Description of Artificial Sequence: Synthetic peptide
  XENP018783 vhCDR3
YYGNYGGYFDV

SEQ ID NO: 8867 - protein, 11 aa, Artificial Sequence
  Description of Artificial Sequence: Synthetic peptide
  XENP018783 vlCDR1
RASQSVSNSVA

SEQ ID NO: 8868 - protein, 7 aa, Artificial Sequence
  Description of Artificial Sequence: Synthetic peptide
  XENP018783 vlCDR2
YASHRYT

SEQ ID NO: 8869 - protein, 9 aa, Artificial Sequence
  Description of Artificial Sequence: Synthetic peptide
  XENP018783 vlCDR3
QQDYSSPRT

SEQ ID NO: 8870 - protein, 249 aa, Artificial Sequence
  Description of Artificial Sequence: Synthetic polypeptide
  XENP018784 1G6_H1_L1.42_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNRVAWYQQKPGQSPRLLINYASHRYTGVPDRFTGSGYGTEFTLTISSLQSEDFAVYFCQQDYSSPRTFGGGTKVEIK

SEQ ID NO: 8871 - protein, 122 aa, Artificial Sequence; identical to SEQ ID NO: 6246
  Description of Artificial Sequence: Synthetic polypeptide
  VH of XENP018784

SEQ ID NO: 8872 - protein, 107 aa, Artificial Sequence
  Description of Artificial Sequence: Synthetic polypeptide
  VL of XENP018784
SIVMTQSPATLSVSPGERATLSCRASQSVSNRVAWYQQKPGQSPRLLINYASHRYTGVPDRFTGSGYGTEFTLTISSLQSEDFAVYFCQQDYSSPRTFGGGTKVEIK

SEQ ID NO: 8873 - protein, 5 aa, Artificial Sequence
  Description of Artificial Sequence: Synthetic peptide
  XENP018784 vhCDR1
NYWMN

SEQ ID NO: 8874 - protein, 19 aa, Artificial Sequence
  Description of Artificial Sequence: Synthetic peptide
  XENP018784 vhCDR2
EIRLKSNNYATHYAEPVKG

SEQ ID NO: 8875 - protein, 11 aa, Artificial Sequence
  Description of Artificial Sequence: Synthetic peptide
  XENP018784 vhCDR3
YYGNYGGYFDV

SEQ ID NO: 8876 - protein, 11 aa, Artificial Sequence
  Description of Artificial Sequence: Synthetic peptide
  XENP018784 vlCDR1
RASQSVSNRVA

SEQ ID NO: 8877 - protein, 7 aa, Artificial Sequence
  Description of Artificial Sequence: Synthetic peptide
  XENP018784 vlCDR2
YASHRYT

SEQ ID NO: 8878 - protein, 9 aa, Artificial Sequence
  Description of Artificial Sequence: Synthetic peptide
  XENP018784 vlCDR3
QQDYSSPRT

SEQ ID NO: 8879 - protein, 249 aa, Artificial Sequence
  Description of Artificial Sequence: Synthetic polypeptide
  XENP018785 1G6_H1_L1.43_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNLVAWYQQKPGQSPRLLINYASHRYTGVPDRFTGSGYGTEFTLTISSLQSEDFAVYFCQQDYSSPRTFGGGTKVEIK

SEQ ID NO: 8880 - protein, 122 aa, Artificial Sequence; identical to SEQ ID NO: 6246
  Description of Artificial Sequence: Synthetic polypeptide
  VH of XENP018785

SEQ ID NO: 8881 - protein, 107 aa, Artificial Sequence
  Description of Artificial Sequence: Synthetic polypeptide
  VL of XENP018785
SIVMTQSPATLSVSPGERATLSCRASQSVSNLVAWYQQKPGQSPRLLINYASHRYTGVPDRFTGSGYGTEFTLTISSLQSEDFAVYFCQQDYSSPRTFGGGTKVEIK

SEQ ID NO: 8882 - protein, 5 aa, Artificial Sequence
  Description of Artificial Sequence: Synthetic peptide
  XENP018785 vhCDR1
NYWMN

SEQ ID NO: 8883 - protein, 19 aa, Artificial Sequence
  Description of Artificial Sequence: Synthetic peptide
  XENP018785 vhCDR2
EIRLKSNNYATHYAEPVKG

SEQ ID NO: 8884 - protein, 11 aa, Artificial Sequence
  Description of Artificial Sequence: Synthetic peptide
  XENP018785 vhCDR3
YYGNYGGYFDV

SEQ ID NO: 8885 - protein, 11 aa, Artificial Sequence
  Description of Artificial Sequence: Synthetic peptide
  XENP018785 vlCDR1
RASQSVSNLVA

SEQ ID NO: 8886 - protein, 7 aa, Artificial Sequence
  Description of Artificial Sequence: Synthetic peptide
  XENP018785 vlCDR2
YASHRYT

SEQ ID NO: 8887 - protein, 9 aa, Artificial Sequence
  Description of Artificial Sequence: Synthetic peptide
  XENP018785 vlCDR3
QQDYSSPRT

SEQ ID NO: 8888 - protein, 249 aa, Artificial Sequence
  Description of Artificial Sequence: Synthetic polypeptide
  XENP018786 1G6_H1_L1.44_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNTVAWYQQKPGQSPRLLINYASHRYTGVPDRFTGSGYGTEFTLTISSLQSEDFAVYFCQQDYSSPRTFGGGTKVEIK

SEQ ID NO: 8889 - protein, 122 aa, Artificial Sequence; identical to SEQ ID NO: 6246
  Description of Artificial Sequence: Synthetic polypeptide
  VH of XENP018786

SEQ ID NO: 8890 - protein, 107 aa, Artificial Sequence
  Description of Artificial Sequence: Synthetic polypeptide
  VL of XENP018786
SIVMTQSPATLSVSPGERATLSCRASQSVSNTVAWYQQKPGQSPRLLINYASHRYTGVPDRFTGSGYGTEFTLTISSLQSEDFAVYFCQQDYSSPRTFGGGTKVEIK

SEQ ID NO: 8891 - protein, 5 aa, Artificial Sequence
  Description of Artificial Sequence: Synthetic peptide
  XENP018786 vhCDR1
NYWMN

SEQ ID NO: 8892 - protein, 19 aa, Artificial Sequence
  Description of Artificial Sequence: Synthetic peptide
  XENP018786 vhCDR2
EIRLKSNNYATHYAEPVKG

SEQ ID NO: 8893 - protein, 11 aa, Artificial Sequence
  Description of Artificial Sequence: Synthetic peptide
  XENP018786 vhCDR3
YYGNYGGYFDV

SEQ ID NO: 8894 - protein, 11 aa, Artificial Sequence
  Description of Artificial Sequence: Synthetic peptide
  XENP018786 vlCDR1
RASQSVSNTVA

SEQ ID NO: 8895 - protein, 7 aa, Artificial Sequence
  Description of Artificial Sequence: Synthetic peptide
  XENP018786 vlCDR2
YASHRYT

SEQ ID NO: 8896 - protein, 9 aa, Artificial Sequence
  Description of Artificial Sequence: Synthetic peptide
  XENP018786 vlCDR3
QQDYSSPRT

SEQ ID NO: 8897 - protein, 249 aa, Artificial Sequence
  Description of Artificial Sequence: Synthetic polypeptide
  XENP018787 1G6_H1_L1.45_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNGVAWYQQKPGQSPRLLINYASHRYTGVPDRFTGSGYGTEFTLTISSLQSEDFAVYFCQQDYSSPRTFGGGTKVEIK

SEQ ID NO: 8898 - protein, 122 aa, Artificial Sequence; identical to SEQ ID NO: 6246
  Description of Artificial Sequence: Synthetic polypeptide
  VH of XENP018787

SEQ ID NO: 8899 - protein, 107 aa, Artificial Sequence
  Description of Artificial Sequence: Synthetic polypeptide
  VL of XENP018787
SIVMTQSPATLSVSPGERATLSCRASQSVSNGVAWYQQKPGQSPRLLINYASHRYTGVPDRFTGSGYGTEFTLTISSLQSEDFAVYFCQQDYSSPRTFGGGTKVEIK

SEQ ID NO: 8900 - protein, 5 aa, Artificial Sequence
  Description of Artificial Sequence: Synthetic peptide
  XENP018787 vhCDR1
NYWMN

SEQ ID NO: 8901 - protein, 19 aa, Artificial Sequence
  Description of Artificial Sequence: Synthetic peptide
  XENP018787 vhCDR2
EIRLKSNNYATHYAEPVKG

SEQ ID NO: 8902 - protein, 11 aa, Artificial Sequence
  Description of Artificial Sequence: Synthetic peptide
  XENP018787 vhCDR3
YYGNYGGYFDV

SEQ ID NO: 8903 - protein, 11 aa, Artificial Sequence
  Description of Artificial Sequence: Synthetic peptide
  XENP018787 vlCDR1
RASQSVSNGVA

SEQ ID NO: 8904 - protein, 7 aa, Artificial Sequence
  Description of Artificial Sequence: Synthetic peptide
  XENP018787 vlCDR2
YASHRYT

SEQ ID NO: 8905 - protein, 9 aa, Artificial Sequence
  Description of Artificial Sequence: Synthetic peptide
  XENP018787 vlCDR3
QQDYSSPRT

SEQ ID NO: 8906 - protein, 249 aa, Artificial Sequence
  Description of Artificial Sequence: Synthetic polypeptide
  XENP018788 1G6_H1_L1.46_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNYVAWYQQKPGQSPRLLINYASHRYTGVPDRFTGSGYGTEFTLTISSLQSEDFAVYFCQQDYSSPRTFGGGTKVEIK

SEQ ID NO: 8907 - protein, 122 aa, Artificial Sequence; identical to SEQ ID NO: 6246
  Description of Artificial Sequence: Synthetic polypeptide
  VH of XENP018788

SEQ ID NO: 8908 - protein, 107 aa, Artificial Sequence
  Description of Artificial Sequence: Synthetic polypeptide
  VL of XENP018788
SIVMTQSPATLSVSPGERATLSCRASQSVSNYVAWYQQKPGQSPRLLINYASHRYTGVPDRFTGSGYGTEFTLTISSLQSEDFAVYFCQQDYSSPRTFGGGTKVEIK

SEQ ID NO: 8909 - protein, 5 aa, Artificial Sequence
  Description of Artificial Sequence: Synthetic peptide
  XENP018788 vhCDR1
NYWMN

SEQ ID NO: 8910 - protein, 19 aa, Artificial Sequence
  Description of Artificial Sequence: Synthetic peptide
  XENP018788 vhCDR2
EIRLKSNNYATHYAEPVKG

SEQ ID NO: 8911 - protein, 11 aa, Artificial Sequence
  Description of Artificial Sequence: Synthetic peptide
  XENP018788 vhCDR3
YYGNYGGYFDV

SEQ ID NO: 8912 - protein, 11 aa, Artificial Sequence
  Description of Artificial Sequence: Synthetic peptide
  XENP018788 vlCDR1
RASQSVSNYVA

SEQ ID NO: 8913 - protein, 7 aa, Artificial Sequence
  Description of Artificial Sequence: Synthetic peptide
  XENP018788 vlCDR2
YASHRYT

SEQ ID NO: 8914 - protein, 9 aa, Artificial Sequence
  Description of Artificial Sequence: Synthetic peptide
  XENP018788 vlCDR3
QQDYSSPRT

SEQ ID NO: 8915 - protein, 249 aa, Artificial Sequence
  Description of Artificial Sequence: Synthetic polypeptide
  XENP018789 1G6_H1_L1.47_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDLAWYQQKPGQSPRLLINYASHRYTGVPDRFTGSGYGTEFTLTISSLQSEDFAVYFCQQDYSSPRTFGGGTKVEIK

SEQ ID NO: 8916 - protein, 122 aa, Artificial Sequence; identical to SEQ ID NO: 6246
  Description of Artificial Sequence: Synthetic polypeptide
  VH of XENP018789

SEQ ID NO: 8917 - protein, 107 aa, Artificial Sequence
  Description of Artificial Sequence: Synthetic polypeptide
  VL of XENP018789
SIVMTQSPATLSVSPGERATLSCRASQSVSNDLAWYQQKPGQSPRLLINYASHRYTGVPDRFTGSGYGTEFTLTISSLQSEDFAVYFCQQDYSSPRTFGGGTKVEIK

SEQ ID NO: 8918 - protein, 5 aa, Artificial Sequence
  Description of Artificial Sequence: Synthetic peptide
  XENP018789 vhCDR1
NYWMN

SEQ ID NO: 8919 - protein, 19 aa, Artificial Sequence
  Description of Artificial Sequence: Synthetic peptide
  XENP018789 vhCDR2
EIRLKSNNYATHYAEPVKG

SEQ ID NO: 8920 - protein, 11 aa, Artificial Sequence
  Description of Artificial Sequence: Synthetic peptide
  XENP018789 vhCDR3
YYGNYGGYFDV

SEQ ID NO: 8921 - protein, 11 aa, Artificial Sequence
  Description of Artificial Sequence: Synthetic peptide
  XENP018789 vlCDR1
RASQSVSNDLA

SEQ ID NO: 8922 - protein, 7 aa, Artificial Sequence
  Description of Artificial Sequence: Synthetic peptide
  XENP018789 vlCDR2
YASHRYT

SEQ ID NO: 8923 - protein, 9 aa, Artificial Sequence
  Description of Artificial Sequence: Synthetic peptide
  XENP018789 vlCDR3
QQDYSSPRT

SEQ ID NO: 8924 - protein, 249 aa, Artificial Sequence
  Description of Artificial Sequence: Synthetic polypeptide
  XENP018790 1G6_H1_L1.48_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVSWYQQKPGQSPRLLINYASHRYTGVPDRFTGSGYGTEFTLTISSLQSEDFAVYFCQQDYSSPRTFGGGTKVEIK

SEQ ID NO: 8925 - protein, 122 aa, Artificial Sequence; identical to SEQ ID NO: 6246
  Description of Artificial Sequence: Synthetic polypeptide
  VH of XENP018790

SEQ ID NO: 8926 - protein, 107 aa, Artificial Sequence
  Description of Artificial Sequence: Synthetic polypeptide
  VL of XENP018790
SIVMTQSPATLSVSPGERATLSCRASQSVSNDVSWYQQKPGQSPRLLINYASHRYTGVPDRFTGSGYGTEFTLTISSLQSEDFAVYFCQQDYSSPRTFGGGTKVEIK

SEQ ID NO: 8927 - protein, 5 aa, Artificial Sequence
  Description of Artificial Sequence: Synthetic peptide
  XENP018790 vhCDR1
NYWMN

SEQ ID NO: 8928 - protein, 19 aa, Artificial Sequence
  Description of Artificial Sequence: Synthetic peptide
  XENP018790 vhCDR2
EIRLKSNNYATHYAEPVKG

SEQ ID NO: 8929 - protein, 11 aa, Artificial Sequence
  Description of Artificial Sequence: Synthetic peptide
  XENP018790 vhCDR3
YYGNYGGYFDV

SEQ ID NO: 8930 - protein, 11 aa, Artificial Sequence
  Description of Artificial Sequence: Synthetic peptide
  XENP018790 vlCDR1
RASQSVSNDVS

SEQ ID NO: 8931 - protein, 7 aa, Artificial Sequence
  Description of Artificial Sequence: Synthetic peptide
  XENP018790 vlCDR2
YASHRYT

SEQ ID NO: 8932 - protein, 9 aa, Artificial Sequence
  Description of Artificial Sequence: Synthetic peptide
  XENP018790 vlCDR3
QQDYSSPRT

SEQ ID NO: 8933 - protein, 249 aa, Artificial Sequence
  Description of Artificial Sequence: Synthetic polypeptide
  XENP018791 1G6_H1_L1.49_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVTWYQQKPGQSPRLLINYASHRYTGVPDRFTGSGYGTEFTLTISSLQSEDFAVYFCQQDYSSPRTFGGGTKVEIK

SEQ ID NO: 8934 - protein, 122 aa, Artificial Sequence; identical to SEQ ID NO: 6246
  Description of Artificial Sequence: Synthetic polypeptide
  VH of XENP018791

SEQ ID NO: 8935 - protein, 107 aa, Artificial Sequence
  Description of Artificial Sequence: Synthetic polypeptide
  VL of XENP018791
SIVMTQSPATLSVSPGERATLSCRASQSVSNDVTWYQQKPGQSPRLLINYASHRYTGVPDRFTGSGYGTEFTLTISSLQSEDFAVYFCQQDYSSPRTFGGGTKVEIK

SEQ ID NO: 8936 - protein, 5 aa, Artificial Sequence
  Description of Artificial Sequence: Synthetic peptide
  XENP018791 vhCDR1
NYWMN

SEQ ID NO: 8937 - protein, 19 aa, Artificial Sequence
  Description of Artificial Sequence: Synthetic peptide
  XENP018791 vhCDR2
EIRLKSNNYATHYAEPVKG

SEQ ID NO: 8938 - protein, 11 aa, Artificial Sequence
  Description of Artificial Sequence: Synthetic peptide
  XENP018791 vhCDR3
YYGNYGGYFDV

SEQ ID NO: 8939 - protein, 11 aa, Artificial Sequence
  Description of Artificial Sequence: Synthetic peptide
  XENP018791 vlCDR1
RASQSVSNDVT

SEQ ID NO: 8940 - protein, 7 aa, Artificial Sequence
  Description of Artificial Sequence: Synthetic peptide
  XENP018791 vlCDR2
YASHRYT

SEQ ID NO: 8941 - protein, 9 aa, Artificial Sequence
  Description of Artificial Sequence: Synthetic peptide
  XENP018791 vlCDR3
QQDYSSPRT

SEQ ID NO: 8942 - protein, 249 aa, Artificial Sequence
  Description of Artificial Sequence: Synthetic polypeptide
  XENP018792 1G6_H1_L1.50_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQAPRLLINYASHRYTGVPDRFTGSGYGTEFTLTISSLQSEDFAVYFCQQDYSSPRTFGGGTKVEIK

SEQ ID NO: 8943 - protein, 122 aa, Artificial Sequence; identical to SEQ ID NO: 6246
  Description of Artificial Sequence: Synthetic polypeptide
  VH of XENP018792

SEQ ID NO: 8944 - protein, 107 aa, Artificial Sequence
  Description of Artificial Sequence: Synthetic polypeptide
  VL of XENP018792
SIVMTQSPATLSVSPGERATLSCRASQSVSNDVAWYQQKPGQAPRLLINYASHRYTGVPDRFTGSGYGTEFTLTISSLQSEDFAVYFCQQDYSSPRTFGGGTKVEIK

SEQ ID NO: 8945 - protein, 5 aa, Artificial Sequence
  Description of Artificial Sequence: Synthetic peptide
  XENP018792 vhCDR1
NYWMN

SEQ ID NO: 8946 - protein, 19 aa, Artificial Sequence
  Description of Artificial Sequence: Synthetic peptide
  XENP018792 vhCDR2
EIRLKSNNYATHYAEPVKG

SEQ ID NO: 8947 - protein, 11 aa, Artificial Sequence
  Description of Artificial Sequence: Synthetic peptide
  XENP018792 vhCDR3
YYGNYGGYFDV

SEQ ID NO: 8948 - protein, 11 aa, Artificial Sequence
  Description of Artificial Sequence: Synthetic peptide
  XENP018792 vlCDR1
RASQSVSNDVA

SEQ ID NO: 8949 - protein, 7 aa, Artificial Sequence
  Description of Artificial Sequence: Synthetic peptide
  XENP018792 vlCDR2
YASHRYT

SEQ ID NO: 8950 - protein, 9 aa, Artificial Sequence
  Description of Artificial Sequence: Synthetic peptide
  XENP018792 vlCDR3
QQDYSSPRT

SEQ ID NO: 8951 - protein, 249 aa, Artificial Sequence
  Description of Artificial Sequence: Synthetic polypeptide
  XENP018793 1G6_H1_L1.51_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPKLLINYASHRYTGVPDRFTGSGYGTEFTLTISSLQSEDFAVYFCQQDYSSPRTFGGGTKVEIK

SEQ ID NO: 8952 - protein, 122 aa, Artificial Sequence; identical to SEQ ID NO: 6246
  Description of Artificial Sequence: Synthetic polypeptide
  VH of XENP018793

SEQ ID NO: 8953 - protein, 107 aa, Artificial Sequence
  Description of Artificial Sequence: Synthetic polypeptide
  VL of XENP018793
SIVMTQSPATLSVSPGERATLSCRASQSVSNDVAWYQQKPGQSPKLLINYASHRYTGVPDRFTGSGYGTEFTLTISSLQSEDFAVYFCQQDYSSPRTFGGGTKVEIK

SEQ ID NO: 8954 - protein, 5 aa, Artificial Sequence
  Description of Artificial Sequence: Synthetic peptide
  XENP018793 vhCDR1
NYWMN

SEQ ID NO: 8955 - protein, 19 aa, Artificial Sequence
  Description of Artificial Sequence: Synthetic peptide
  XENP018793 vhCDR2
EIRLKSNNYATHYAEPVKG

SEQ ID NO: 8956 - protein, 11 aa, Artificial Sequence
  Description of Artificial Sequence: Synthetic peptide
  XENP018793 vhCDR3
YYGNYGGYFDV

SEQ ID NO: 8957 - protein, 11 aa, Artificial Sequence
  Description of Artificial Sequence: Synthetic peptide
  XENP018793 vlCDR1
RASQSVSNDVA

SEQ ID NO: 8958 - protein, 7 aa, Artificial Sequence
  Description of Artificial Sequence: Synthetic peptide
  XENP018793 vlCDR2
YASHRYT

SEQ ID NO: 8959 - protein, 9 aa, Artificial Sequence
  Description of Artificial Sequence: Synthetic peptide
  XENP018793 vlCDR3
QQDYSSPRT

SEQ ID NO: 8960 - protein, 249 aa, Artificial Sequence
  Description of Artificial Sequence: Synthetic polypeptide
  XENP018794 1G6_H1_L1.52_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPQLLINYASHRYTGVPDRFTGSGYGTEFTLTISSLQSEDFAVYFCQQDYSSPRTFGGGTKVEIK

SEQ ID NO: 8961 - protein, 122 aa, Artificial Sequence; identical to SEQ ID NO: 6246
  Description of Artificial Sequence: Synthetic polypeptide
  VH of XENP018794

SEQ ID NO: 8962 - protein, 107 aa, Artificial Sequence
  Description of Artificial Sequence: Synthetic polypeptide
  VL of XENP018794
SIVMTQSPATLSVSPGERATLSCRASQSVSNDVAWYQQKPGQSPQLLINYASHRYTGVPDRFTGSGYGTEFTLTISSLQSEDFAVYFCQQDYSSPRTFGGGTKVEIK

SEQ ID NO: 8963 - protein, 5 aa, Artificial Sequence
  Description of Artificial Sequence: Synthetic peptide
  XENP018794 vhCDR1
NYWMN

SEQ ID NO: 8964 - protein, 19 aa, Artificial Sequence
  Description of Artificial Sequence: Synthetic peptide
  XENP018794 vhCDR2
EIRLKSNNYATHYAEPVKG

SEQ ID NO: 8965 - protein, 11 aa, Artificial Sequence
  Description of Artificial Sequence: Synthetic peptide
  XENP018794 vhCDR3
YYGNYGGYFDV

SEQ ID NO: 8966 - protein, 11 aa, Artificial Sequence
  Description of Artificial Sequence: Synthetic peptide
  XENP018794 vlCDR1
RASQSVSNDVA

SEQ ID NO: 8967 - protein, 7 aa, Artificial Sequence
  Description of Artificial Sequence: Synthetic peptide
  XENP018794 vlCDR2
YASHRYT

SEQ ID NO: 8968 - protein, 9 aa, Artificial Sequence
  Description of Artificial Sequence: Synthetic peptide
  XENP018794 vlCDR3
QQDYSSPRT

SEQ ID NO: 8969 - protein, 249 aa, Artificial Sequence
  Description of Artificial Sequence: Synthetic polypeptide
  XENP018795 1G6_H1_L1.53_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPILLINYASHRYTGVPDRFTGSGYGTEFTLTISSLQSEDFAVYFCQQDYSSPRTFGGGTKVEIK

SEQ ID NO: 8970 - protein, 122 aa, Artificial Sequence; identical to SEQ ID NO: 6246
  Description of Artificial Sequence: Synthetic polypeptide
  VH of XENP018795

SEQ ID NO: 8971 - protein, 107 aa, Artificial Sequence
  Description of Artificial Sequence: Synthetic polypeptide
  VL of XENP018795
SIVMTQSPATLSVSPGERATLSCRASQSVSNDVAWYQQKPGQSPILLINYASHRYTGVPDRFTGSGYGTEFTLTISSLQSEDFAVYFCQQDYSSPRTFGGGTKVEIK

SEQ ID NO: 8972 - protein, 5 aa, Artificial Sequence
  Description of Artificial Sequence: Synthetic peptide
  XENP018795 vhCDR1
NYWMN

SEQ ID NO: 8973 - protein, 19 aa, Artificial Sequence
  Description of Artificial Sequence: Synthetic peptide
  XENP018795 vhCDR2
EIRLKSNNYATHYAEPVKG

SEQ ID NO: 8974 - protein, 11 aa, Artificial Sequence
  Description of Artificial Sequence: Synthetic peptide
  XENP018795 vhCDR3
YYGNYGGYFDV

SEQ ID NO: 8975 - protein, 11 aa, Artificial Sequence
  Description of Artificial Sequence: Synthetic peptide
  XENP018795 vlCDR1
RASQSVSNDVA

SEQ ID NO: 8976 - protein, 7 aa, Artificial Sequence
  Description of Artificial Sequence: Synthetic peptide
  XENP018795 vlCDR2
YASHRYT

SEQ ID NO: 8977 - protein, 9 aa, Artificial Sequence
  Description of Artificial Sequence: Synthetic peptide
  XENP018795 vlCDR3
QQDYSSPRT

SEQ ID NO: 8978 - protein, 249 aa, Artificial Sequence
  Description of Artificial Sequence: Synthetic polypeptide
  XENP018796 1G6_H1_L1.54_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLIYYASHRYTGVPDRFTGSGYGTEFTLTISSLQSEDFAVYFCQQDYSSPRTFGGGTKVEIK

SEQ ID NO: 8979 - protein, 122 aa, Artificial Sequence; identical to SEQ ID NO: 6246
  Description of Artificial Sequence: Synthetic polypeptide
  VH of XENP018796

SEQ ID NO: 8980 - protein, 107 aa, Artificial Sequence
  Description of Artificial Sequence: Synthetic polypeptide
  VL of XENP018796
SIVMTQSPATLSVSPGERATLSCRASQSVSNDVAWYQQKPGQSPRLLIYYASHRYTGVPDRFTGSGYGTEFTLTISSLQSEDFAVYFCQQDYSSPRTFGGGTKVEIK

SEQ ID NO: 8981 - protein, 5 aa, Artificial Sequence
  Description of Artificial Sequence: Synthetic peptide
  XENP018796 vhCDR1
NYWMN

SEQ ID NO: 8982 - protein, 19 aa, Artificial Sequence
  Description of Artificial Sequence: Synthetic peptide
  XENP018796 vhCDR2
EIRLKSNNYATHYAEPVKG

SEQ ID NO: 8983 - protein, 11 aa, Artificial Sequence
  Description of Artificial Sequence: Synthetic peptide
  XENP018796 vhCDR3
YYGNYGGYFDV

SEQ ID NO: 8984 - protein, 11 aa, Artificial Sequence
  Description of Artificial Sequence: Synthetic peptide
  XENP018796 vlCDR1
RASQSVSNDVA

SEQ ID NO: 8985 - protein, 7 aa, Artificial Sequence
  Description of Artificial Sequence: Synthetic peptide
  XENP018796 vlCDR2
YASHRYT

SEQ ID NO: 8986 - protein, 9 aa, Artificial Sequence
  Description of Artificial Sequence: Synthetic peptide
  XENP018796 vlCDR3
QQDYSSPRT

SEQ ID NO: 8987 - protein, 249 aa, Artificial Sequence
  Description of Artificial Sequence: Synthetic polypeptide
  XENP018801 1G6_H1_L1.55_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINFASHRYTGVPDRFTGSGYGTEFTLTISSLQSEDFAVYFCQQDYSSPRTFGGGTKVEIK

SEQ ID NO: 8988 - protein, 122 aa, Artificial Sequence; identical to SEQ ID NO: 6246
  Description of Artificial Sequence: Synthetic polypeptide
  VH of XENP018801

SEQ ID NO: 8989 - protein, 107 aa, Artificial Sequence
  Description of Artificial Sequence: Synthetic polypeptide
  VL of XENP018801
SIVMTQSPATLSVSPGERATLSCRASQSVSNDVAWYQQKPGQSPRLLINFASHRYTGVPDRFTGSGYGTEFTLTISSLQSEDFAVYFCQQDYSSPRTFGGGTKVEIK

SEQ ID NO: 8990 - protein, 5 aa, Artificial Sequence
  Description of Artificial Sequence: Synthetic peptide
  XENP018801 vhCDR1
NYWMN

SEQ ID NO: 8991 - protein, 19 aa, Artificial Sequence
  Description of Artificial Sequence: Synthetic peptide
  XENP018801 vhCDR2
EIRLKSNNYATHYAEPVKG

SEQ ID NO: 8992 - protein, 11 aa, Artificial Sequence
  Description of Artificial Sequence: Synthetic peptide
  XENP018801 vhCDR3
YYGNYGGYFDV

SEQ ID NO: 8993 - protein, 11 aa, Artificial Sequence
  Description of Artificial Sequence: Synthetic peptide
  XENP018801 vlCDR1
RASQSVSNDVA

SEQ ID NO: 8994 - protein, 7 aa, Artificial Sequence
  Description of Artificial Sequence: Synthetic peptide
  XENP018801 vlCDR2
FASHRYT

SEQ ID NO: 8995 - protein, 9 aa, Artificial Sequence
  Description of Artificial Sequence: Synthetic peptide
  XENP018801 vlCDR3
QQDYSSPRT

SEQ ID NO: 8996 - protein, 249 aa, Artificial Sequence
  Description of Artificial Sequence: Synthetic polypeptide
  XENP018802 1G6_H1_L1.56_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINHASHRYTGVPDRFTGSGYGTEFTLTISSLQSEDFAVYFCQQDYSSPRTFGGGTKVEIK

SEQ ID NO: 8997 - protein, 122 aa, Artificial Sequence; identical to SEQ ID NO: 6246
  Description of Artificial Sequence: Synthetic polypeptide
  VH of XENP018802

SEQ ID NO: 8998 - protein, 107 aa, Artificial Sequence
  Description of Artificial Sequence: Synthetic polypeptide
  VL of XENP018802
SIVMTQSPATLSVSPGERATLSCRASQSVSNDVAWYQQKPGQSPRLLINHASHRYTGVPDRFTGSGYGTEFTLTISSLQSEDFAVYFCQQDYSSPRTFGGGTKVEIK

SEQ ID NO: 8999 - protein, 5 aa, Artificial Sequence
  Description of Artificial Sequence: Synthetic peptide
  XENP018802 vhCDR1
NYWMN

SEQ ID NO: 9000 - protein, 19 aa, Artificial Sequence
  Description of Artificial Sequence: Synthetic peptide
  XENP018802 vhCDR2
EIRLKSNNYATHYAEPVKG

SEQ ID NO: 9001 - protein, 11 aa, Artificial Sequence
  Description of Artificial Sequence: Synthetic peptide
  XENP018802 vhCDR3
YYGNYGGYFDV

SEQ ID NO: 9002 - protein, 11 aa, Artificial Sequence
  Description of Artificial Sequence: Synthetic peptide
  XENP018802 vlCDR1
RASQSVSNDVA

SEQ ID NO: 9003 - protein, 7 aa, Artificial Sequence
  Description of Artificial Sequence: Synthetic peptide
  XENP018802 vlCDR2
HASHRYT

SEQ ID NO: 9004 - protein, 9 aa, Artificial Sequence
  Description of Artificial Sequence: Synthetic peptide
  XENP018802 vlCDR3
QQDYSSPRT

SEQ ID NO: 9005 - protein, 249 aa, Artificial Sequence
  Description of Artificial Sequence: Synthetic polypeptide
  XENP018803 1G6_H1_L1.57_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINLASHRYTGVPDRFTGSGYGTEFTLTISSLQSEDFAVYFCQQDYSSPRTFGGGTKVEIK

SEQ ID NO: 9006 - protein, 122 aa, Artificial Sequence; identical to SEQ ID NO: 6246
  Description of Artificial Sequence: Synthetic polypeptide
  VH of XENP018803

SEQ ID NO: 9007 - protein, 107 aa, Artificial Sequence
  Description of Artificial Sequence: Synthetic polypeptide
  VL of XENP018803
SIVMTQSPATLSVSPGERATLSCRASQSVSNDVAWYQQKPGQSPRLLINLASHRYTGVPDRFTGSGYGTEFTLTISSLQSEDFAVYFCQQDYSSPRTFGGGTKVEIK

SEQ ID NO: 9008 - protein, 5 aa, Artificial Sequence
  Description of Artificial Sequence: Synthetic peptide
  XENP018803 vhCDR1
NYWMN

SEQ ID NO: 9009 - protein, 19 aa, Artificial Sequence
  Description of Artificial Sequence: Synthetic peptide
  XENP018803 vhCDR2
EIRLKSNNYATHYAEPVKG

SEQ ID NO: 9010 - protein, 11 aa, Artificial Sequence
  Description of Artificial Sequence: Synthetic peptide
  XENP018803 vhCDR3
YYGNYGGYFDV

SEQ ID NO: 9011 - protein, 11 aa, Artificial Sequence
  Description of Artificial Sequence: Synthetic peptide
  XENP018803 vlCDR1
RASQSVSNDVA

SEQ ID NO: 9012 - protein, 7 aa, Artificial Sequence
  Description of Artificial Sequence: Synthetic peptide
  XENP018803 vlCDR2
LASHRYT

SEQ ID NO: 9013 - protein, 9 aa, Artificial Sequence
  Description of Artificial Sequence: Synthetic peptide
  XENP018803 vlCDR3
QQDYSSPRT

SEQ ID NO: 9014 - protein, 249 aa, Artificial Sequence
  Description of Artificial Sequence: Synthetic polypeptide
  XENP018804 1G6_H1_L1.58_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINWASHRYTGVPDRFTGSGYGTEFTLTISSLQSEDFAVYFCQQDYSSPRTFGGGTKVEIK

SEQ ID NO: 9015 - protein, 122 aa, Artificial Sequence; identical to SEQ ID NO: 6246
  Description of Artificial Sequence: Synthetic polypeptide
  VH of XENP018804

SEQ ID NO: 9016 - protein, 107 aa, Artificial Sequence
  Description of Artificial Sequence: Synthetic polypeptide
  VL of XENP018804
SIVMTQSPATLSVSPGERATLSCRASQSVSNDVAWYQQKPGQSPRLLINWASHRYTGVPDRFTGSGYGTEFTLTISSLQSEDFAVYFCQQDYSSPRTFGGGTKVEIK

SEQ ID NO: 9017 - protein, 5 aa, Artificial Sequence
  Description of Artificial Sequence: Synthetic peptide
  XENP018804 vhCDR1
NYWMN

SEQ ID NO: 9018 - protein, 19 aa, Artificial Sequence
  Description of Artificial Sequence: Synthetic peptide
  XENP018804 vhCDR2
EIRLKSNNYATHYAEPVKG

SEQ ID NO: 9019 - protein, 11 aa, Artificial Sequence
  Description of Artificial Sequence: Synthetic peptide
  XENP018804 vhCDR3
YYGNYGGYFDV

SEQ ID NO: 9020 - protein, 11 aa, Artificial Sequence
  Description of Artificial Sequence: Synthetic peptide
  XENP018804 vlCDR1
RASQSVSNDVA

SEQ ID NO: 9021 - protein, 7 aa, Artificial Sequence
  Description of Artificial Sequence: Synthetic peptide
  XENP018804 vlCDR2
WASHRYT

SEQ ID NO: 9022 - protein, 9 aa, Artificial Sequence
  Description of Artificial Sequence: Synthetic peptide
  XENP018804 vlCDR3
QQDYSSPRT

SEQ ID NO: 9023 - protein, 249 aa, Artificial Sequence
  Description of Artificial Sequence: Synthetic polypeptide
  XENP018805 1G6_H1_L1.59_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINVASHRYTGVPDRFTGSGYGTEFTLTISSLQSEDFAVYFCQQDYSSPRTFGGGTKVEIK

SEQ ID NO: 9024 - protein, 122 aa, Artificial Sequence; identical to SEQ ID NO: 6246
  Description of Artificial Sequence: Synthetic polypeptide
  VH of XENP018805

SEQ ID NO: 9025 - protein, 107 aa, Artificial Sequence
  Description of Artificial Sequence: Synthetic polypeptide
  VL of XENP018805
SIVMTQSPATLSVSPGERATLSCRASQSVSNDVAWYQQKPGQSPRLLINVASHRYTGVPDRFTGSGYGTEFTLTISSLQSEDFAVYFCQQDYSSPRTFGGGTKVEIK

SEQ ID NO: 9026 - protein, 5 aa, Artificial Sequence
  Description of Artificial Sequence: Synthetic peptide
  XENP018805 vhCDR1
NYWMN

SEQ ID NO: 9027 - protein, 19 aa, Artificial Sequence
  Description of Artificial Sequence: Synthetic peptide
  XENP018805 vhCDR2
EIRLKSNNYATHYAEPVKG

SEQ ID NO: 9028 - protein, 11 aa, Artificial Sequence
  Description of Artificial Sequence: Synthetic peptide
  XENP018805 vhCDR3
YYGNYGGYFDV

SEQ ID NO: 9029 - protein, 11 aa, Artificial Sequence
  Description of Artificial Sequence: Synthetic peptide
  XENP018805 vlCDR1
RASQSVSNDVA

SEQ ID NO: 9030 - protein, 7 aa, Artificial Sequence
  Description of Artificial Sequence: Synthetic peptide
  XENP018805 vlCDR2
VASHRYT

SEQ ID NO: 9031 - protein, 9 aa, Artificial Sequence
  Description of Artificial Sequence: Synthetic peptide
  XENP018805 vlCDR3
QQDYSSPRT

SEQ ID NO: 9032 - protein, 249 aa, Artificial Sequence
  Description of Artificial Sequence: Synthetic polypeptide
  XENP018806 1G6_H1_L1.60_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINAASHRYTGVPDRFTGSGYGTEFTLTISSLQSEDFAVYFCQQDYSSPRTFGGGTKVEIK

SEQ ID NO: 9033 - protein, 122 aa, Artificial Sequence; identical to SEQ ID NO: 6246
  Description of Artificial Sequence: Synthetic polypeptide
  VH of XENP018806

SEQ ID NO: 9034 - protein, 107 aa, Artificial Sequence
  Description of Artificial Sequence: Synthetic polypeptide
  VL of XENP018806
SIVMTQSPATLSVSPGERATLSCRASQSVSNDVAWYQQKPGQSPRLLINAASHRYTGVPDRFTGSGYGTEFTLTISSLQSEDFAVYFCQQDYSSPRTFGGGTKVEIK

SEQ ID NO: 9035 - protein, 5 aa, Artificial Sequence
  Description of Artificial Sequence: Synthetic peptide
  XENP018806 vhCDR1
NYWMN

SEQ ID NO: 9036 - protein, 19 aa, Artificial Sequence
  Description of Artificial Sequence: Synthetic peptide
  XENP018806 vhCDR2
EIRLKSNNYATHYAEPVKG

SEQ ID NO: 9037 - protein, 11 aa, Artificial Sequence
  Description of Artificial Sequence: Synthetic peptide
  XENP018806 vhCDR3
YYGNYGGYFDV

SEQ ID NO: 9038 - protein, 11 aa, Artificial Sequence
  Description of Artificial Sequence: Synthetic peptide
  XENP018806 vlCDR1
RASQSVSNDVA

SEQ ID NO: 9039 - protein, 7 aa, Artificial Sequence
  Description of Artificial Sequence: Synthetic peptide
  XENP018806 vlCDR2
AASHRYT

SEQ ID NO: 9040 - protein, 9 aa, Artificial Sequence
  Description of Artificial Sequence: Synthetic peptide
  XENP018806 vlCDR3
QQDYSSPRT

SEQ ID NO: 9041 - protein, 249 aa, Artificial Sequence
  Description of Artificial Sequence: Synthetic polypeptide
  XENP018807 1G6_H1_L1.61_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINQASHRYTGVPDRFTGSGYGTEFTLTISSLQSEDFAVYFCQQDYSSPRTFGGGTKVEIK

SEQ ID NO: 9042 - protein, 122 aa, Artificial Sequence; identical to SEQ ID NO: 6246
  Description of Artificial Sequence: Synthetic polypeptide
  VH of XENP018807

SEQ ID NO: 9043 - protein, 107 aa, Artificial Sequence
  Description of Artificial Sequence: Synthetic polypeptide
  VL of XENP018807
SIVMTQSPATLSVSPGERATLSCRASQSVSNDVAWYQQKPGQSPRLLINQASHRYTGVPDRFTGSGYGTEFTLTISSLQSEDFAVYFCQQDYSSPRTFGGGTKVEIK

SEQ ID NO: 9044 - protein, 5 aa, Artificial Sequence
  Description of Artificial Sequence: Synthetic peptide
  XENP018807 vhCDR1
NYWMN

SEQ ID NO: 9045 - protein, 19 aa, Artificial Sequence
  Description of Artificial Sequence: Synthetic peptide
  XENP018807 vhCDR2
EIRLKSNNYATHYAEPVKG

SEQ ID NO: 9046 - protein, 11 aa, Artificial Sequence
  Description of Artificial Sequence: Synthetic peptide
  XENP018807 vhCDR3
YYGNYGGYFDV

SEQ ID NO: 9047 - protein, 11 aa, Artificial Sequence
  Description of Artificial Sequence: Synthetic peptide
  XENP018807 vlCDR1
RASQSVSNDVA

SEQ ID NO: 9048 - protein, 7 aa, Artificial Sequence
  Description of Artificial Sequence: Synthetic peptide
  XENP018807 vlCDR2
QASHRYT

SEQ ID NO: 9049 - protein, 9 aa, Artificial Sequence
  Description of Artificial Sequence: Synthetic peptide
  XENP018807 vlCDR3
QQDYSSPRT

SEQ ID NO: 9050 - protein, 249 aa, Artificial Sequence
  Description of Artificial Sequence: Synthetic polypeptide
  XENP018808 1G6_H1_L1.62_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINDASHRYTGVPDRFTGSGYGTEFTLTISSLQSEDFAVYFCQQDYSSPRTFGGGTKVEIK

SEQ ID NO: 9051 - protein, 122 aa, Artificial Sequence; identical to SEQ ID NO: 6246
  Description of Artificial Sequence: Synthetic polypeptide
  VH of XENP018808

SEQ ID NO: 9052 - protein, 107 aa, Artificial Sequence
  Description of Artificial Sequence: Synthetic polypeptide
  VL of XENP018808
SIVMTQSPATLSVSPGERATLSCRASQSVSNDVAWYQQKPGQSPRLLINDASHRYTGVPDRFTGSGYGTEFTLTISSLQSEDFAVYFCQQDYSSPRTFGGGTKVEIK

SEQ ID NO: 9053 - protein, 5 aa, Artificial Sequence
  Description of Artificial Sequence: Synthetic peptide
  XENP018808 vhCDR1
NYWMN

SEQ ID NO: 9054 - protein, 19 aa, Artificial Sequence
  Description of Artificial Sequence: Synthetic peptide
  XENP018808 vhCDR2
EIRLKSNNYATHYAEPVKG

SEQ ID NO: 9055 - protein, 11 aa, Artificial Sequence
  Description of Artificial Sequence: Synthetic peptide
  XENP018808 vhCDR3
YYGNYGGYFDV

SEQ ID NO: 9056 - protein, 11 aa, Artificial Sequence
  Description of Artificial Sequence: Synthetic peptide
  XENP018808 vlCDR1
RASQSVSNDVA

SEQ ID NO: 9057 - protein, 7 aa, Artificial Sequence
  Description of Artificial Sequence: Synthetic peptide
  XENP018808 vlCDR2
DASHRYT

SEQ ID NO: 9058 - protein, 9 aa, Artificial Sequence
  Description of Artificial Sequence: Synthetic peptide
  XENP018808 vlCDR3
QQDYSSPRT

SEQ ID NO: 9059 - protein, 249 aa, Artificial Sequence
  Description of Artificial Sequence: Synthetic polypeptide
  XENP018809 1G6_H1_L1.63_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINKASHRYTGVPDRFTGSGYGTEFTLTISSLQSEDFAVYFCQQDYSSPRTFGGGTKVEIK

SEQ ID NO: 9060 - protein, 122 aa, Artificial Sequence; identical to SEQ ID NO: 6246
  Description of Artificial Sequence: Synthetic polypeptide
  VH of XENP018809

SEQ ID NO: 9061 - protein, 107 aa, Artificial Sequence
  Description of Artificial Sequence: Synthetic polypeptide
  VL of XENP018809
SIVMTQSPATLSVSPGERATLSCRASQSVSNDVAWYQQKPGQSPRLLINKASHRYTGVPDRFTGSGYGTEFTLTISSLQSEDFAVYFCQQDYSSPRTFGGGTKVEIK

SEQ ID NO: 9062 - protein, 5 aa, Artificial Sequence
  Description of Artificial Sequence: Synthetic peptide
  XENP018809 vhCDR1
NYWMN

SEQ ID NO: 9063 - protein, 19 aa, Artificial Sequence
  Description of Artificial Sequence: Synthetic peptide
  XENP018809 vhCDR2
EIRLKSNNYATHYAEPVKG

SEQ ID NO: 9064 - protein, 11 aa, Artificial Sequence
  Description of Artificial Sequence: Synthetic peptide
  XENP018809 vhCDR3
YYGNYGGYFDV

SEQ ID NO: 9065 - protein, 11 aa, Artificial Sequence
  Description of Artificial Sequence: Synthetic peptide
  XENP018809 vlCDR1
RASQSVSNDVA

SEQ ID NO: 9066 - protein, 7 aa, Artificial Sequence
  Description of Artificial Sequence: Synthetic peptide
  XENP018809 vlCDR2
KASHRYT

SEQ ID NO: 9067 - protein, 9 aa, Artificial Sequence
  Description of Artificial Sequence: Synthetic peptide
  XENP018809 vlCDR3
QQDYSSPRT

SEQ ID NO: 9068 - protein, 249 aa, Artificial Sequence
  Description of Artificial Sequence: Synthetic polypeptide
  XENP018810 1G6_H1_L1.64_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASYRYTGVPDRFTGSGYGTEFTLTISSLQSEDFAVYFCQQDYSSPRTFGGGTKVEIK

SEQ ID NO: 9069 - protein, 122 aa, Artificial Sequence; identical to SEQ ID NO: 6246
  Description of Artificial Sequence: Synthetic polypeptide
  VH of XENP018810

SEQ ID NO: 9070 - protein, 107 aa, Artificial Sequence
  Description of Artificial Sequence: Synthetic polypeptide
  VL of XENP018810
SIVMTQSPATLSVSPGERATLSCRASQSVSNDVAWYQQKPGQSPRLLINYASYRYTGVPDRFTGSGYGTEFTLTISSLQSEDFAVYFCQQDYSSPRTFGGGTKVEIK

SEQ ID NO: 9071 - protein, 5 aa, Artificial Sequence
  Description of Artificial Sequence: Synthetic peptide
  XENP018810 vhCDR1
NYWMN

SEQ ID NO: 9072 - protein, 19 aa, Artificial Sequence
  Description of Artificial Sequence: Synthetic peptide
  XENP018810 vhCDR2
EIRLKSNNYATHYAEPVKG

SEQ ID NO: 9073 - protein, 11 aa, Artificial Sequence
  Description of Artificial Sequence: Synthetic peptide
  XENP018810 vhCDR3
YYGNYGGYFDV

SEQ ID NO: 9074 - protein, 11 aa, Artificial Sequence
  Description of Artificial Sequence: Synthetic peptide
  XENP018810 vlCDR1
RASQSVSNDVA

SEQ ID NO: 9075 - protein, 7 aa, Artificial Sequence
  Description of Artificial Sequence: Synthetic peptide
  XENP018810 vlCDR2
YASYRYT

SEQ ID NO: 9076 - protein, 9 aa, Artificial Sequence
  Description of Artificial Sequence: Synthetic peptide
  XENP018810 vlCDR3
QQDYSSPRT

SEQ ID NO: 9077 - protein, 249 aa, Artificial Sequence
  Description of Artificial Sequence: Synthetic polypeptide
  XENP018811 1G6_H1_L1.65_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASQRYTGVPDRFTGSGYGTEFTLTISSLQSEDFAVYFCQQDYSSPRTFGGGTKVEIK

SEQ ID NO: 9078 - protein, 122 aa, Artificial Sequence; identical to SEQ ID NO: 6246
  Description of Artificial Sequence: Synthetic polypeptide
  VH of XENP018811

SEQ ID NO: 9079 - protein, 107 aa, Artificial Sequence
  Description of Artificial Sequence: Synthetic polypeptide
  VL of XENP018811
SIVMTQSPATLSVSPGERATLSCRASQSVSNDVAWYQQKPGQSPRLLINYASQRYTGVPDRFTGSGYGTEFTLTISSLQSEDFAVYFCQQDYSSPRTFGGGTKVEIK

SEQ ID NO: 9080 - protein, 5 aa, Artificial Sequence
  Description of Artificial Sequence: Synthetic peptide
  XENP018811 vhCDR1
NYWMN

SEQ ID NO: 9081 - protein, 19 aa, Artificial Sequence
  Description of Artificial Sequence: Synthetic peptide
  XENP018811 vhCDR2
EIRLKSNNYATHYAEPVKG

SEQ ID NO: 9082 - protein, 11 aa, Artificial Sequence
  Description of Artificial Sequence: Synthetic peptide
  XENP018811 vhCDR3
YYGNYGGYFDV

SEQ ID NO: 9083 - protein, 11 aa, Artificial Sequence
  Description of Artificial Sequence: Synthetic peptide
  XENP018811 vlCDR1
RASQSVSNDVA

SEQ ID NO: 9084 - protein, 7 aa, Artificial Sequence
  Description of Artificial Sequence: Synthetic peptide
  XENP018811 vlCDR2
YASQRYT

SEQ ID NO: 9085 - protein, 9 aa, Artificial Sequence
  Description of Artificial Sequence: Synthetic peptide
  XENP018811 vlCDR3
QQDYSSPRT

SEQ ID NO: 9086 - protein, 249 aa, Artificial Sequence
  Description of Artificial Sequence: Synthetic polypeptide
  XENP018812 1G6_H1_L1.66_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASDRYTGVPDRFTGSGYGTEFTLTISSLQSEDFAVYFCQQDYSSPRTFGGGTKVEIK

SEQ ID NO: 9087 - protein, 122 aa, Artificial Sequence; identical to SEQ ID NO: 6246
  Description of Artificial Sequence: Synthetic polypeptide
  VH of XENP018812

SEQ ID NO: 9088 - protein, 107 aa, Artificial Sequence
  Description of Artificial Sequence: Synthetic polypeptide
  VL of XENP018812
SIVMTQSPATLSVSPGERATLSCRASQSVSNDVAWYQQKPGQSPRLLINYASDRYTGVPDRFTGSGYGTEFTLTISSLQSEDFAVYFCQQDYSSPRTFGGGTKVEIK

SEQ ID NO: 9089 - protein, 5 aa, Artificial Sequence
  Description of Artificial Sequence: Synthetic peptide
  XENP018812 vhCDR1
NYWMN

SEQ ID NO: 9090 - protein, 19 aa, Artificial Sequence
  Description of Artificial Sequence: Synthetic peptide
  XENP018812 vhCDR2
EIRLKSNNYATHYAEPVKG

SEQ ID NO: 9091 - protein, 11 aa, Artificial Sequence
  Description of Artificial Sequence: Synthetic peptide
  XENP018812 vhCDR3
YYGNYGGYFDV

SEQ ID NO: 9092 - protein, 11 aa, Artificial Sequence
  Description of Artificial Sequence: Synthetic peptide
  XENP018812 vlCDR1
RASQSVSNDVA

SEQ ID NO: 9093 - protein, 7 aa, Artificial Sequence
  Description of Artificial Sequence: Synthetic peptide
  XENP018812 vlCDR2
YASDRYT

SEQ ID NO: 9094 - protein, 9 aa, Artificial Sequence
  Description of Artificial Sequence: Synthetic peptide
  XENP018812 vlCDR3
QQDYSSPRT

SEQ ID NO: 9095 - protein, 249 aa, Artificial Sequence
  Description of Artificial Sequence: Synthetic polypeptide
  XENP018813 1G6_H1_L1.67_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTGVPDRFTGSGYGTEFTLTISSLQSEDFAVYFCQQDYSSPRTFGGGTKVEIK

SEQ ID NO: 9096 - protein, 122 aa, Artificial Sequence; identical to SEQ ID NO: 6246
  Description of Artificial Sequence: Synthetic polypeptide
  VH of XENP018813

SEQ ID NO: 9097 - protein, 107 aa, Artificial Sequence
  Description of Artificial Sequence: Synthetic polypeptide
  VL of XENP018813
SIVMTQSPATLSVSPGERATLSCRASQSVSNDVAWYQQKPGQSPRLLINYASWRYTGVPDRFTGSGYGTEFTLTISSLQSEDFAVYFCQQDYSSPRTFGGGTKVEIK

SEQ ID NO: 9098 - protein, 5 aa, Artificial Sequence
  Description of Artificial Sequence: Synthetic peptide
  XENP018813 vhCDR1
NYWMN

SEQ ID NO: 9099 - protein, 19 aa, Artificial Sequence
  Description of Artificial Sequence: Synthetic peptide
  XENP018813 vhCDR2
EIRLKSNNYATHYAEPVKG

SEQ ID NO: 9100 - protein, 11 aa, Artificial Sequence
  Description of Artificial Sequence: Synthetic peptide
  XENP018813 vhCDR3
YYGNYGGYFDV

SEQ ID NO: 9101 - protein, 11 aa, Artificial Sequence
  Description of Artificial Sequence: Synthetic peptide
  XENP018813 vlCDR1
RASQSVSNDVA

SEQ ID NO: 9102 - protein, 7 aa, Artificial Sequence
  Description of Artificial Sequence: Synthetic peptide
  XENP018813 vlCDR2
YASWRYT

SEQ ID NO: 9103 - protein, 9 aa, Artificial Sequence
  Description of Artificial Sequence: Synthetic peptide
  XENP018813 vlCDR3
QQDYSSPRT

SEQ ID NO: 9104 - protein, 249 aa, Artificial Sequence
  Description of Artificial Sequence: Synthetic polypeptide
  XENP018814 1G6_H1_L1.68_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASARYTGVPDRFTGSGYGTEFTLTISSLQSEDFAVYFCQQDYSSPRTFGGGTKVEIK

SEQ ID NO: 9105 - protein, 122 aa, Artificial Sequence; identical to SEQ ID NO: 6246
  Description of Artificial Sequence: Synthetic polypeptide
  VH of XENP018814

SEQ ID NO: 9106 - protein, 107 aa, Artificial Sequence
  Description of Artificial Sequence: Synthetic polypeptide
  VL of XENP018814
SIVMTQSPATLSVSPGERATLSCRASQSVSNDVAWYQQKPGQSPRLLINYASARYTGVPDRFTGSGYGTEFTLTISSLQSEDFAVYFCQQDYSSPRTFGGGTKVEIK

SEQ ID NO: 9107 - protein, 5 aa, Artificial Sequence
  Description of Artificial Sequence: Synthetic peptide
  XENP018814 vhCDR1
NYWMN

SEQ ID NO: 9108 - protein, 19 aa, Artificial Sequence
  Description of Artificial Sequence: Synthetic peptide
  XENP018814 vhCDR2
EIRLKSNNYATHYAEPVKG

SEQ ID NO: 9109 - protein, 11 aa, Artificial Sequence
  Description of Artificial Sequence: Synthetic peptide
  XENP018814 vhCDR3
YYGNYGGYFDV

SEQ ID NO: 9110 - protein, 11 aa, Artificial Sequence
  Description of Artificial Sequence: Synthetic peptide
  XENP018814 vlCDR1
RASQSVSNDVA

SEQ ID NO: 9111 - protein, 7 aa, Artificial Sequence
  Description of Artificial Sequence: Synthetic peptide
  XENP018814 vlCDR2
YASARYT

SEQ ID NO: 9112 - protein, 9 aa, Artificial Sequence
  Description of Artificial Sequence: Synthetic peptide
  XENP018814 vlCDR3
QQDYSSPRT

SEQ ID NO: 9113 - protein, 249 aa, Artificial Sequence
  Description of Artificial Sequence: Synthetic polypeptide
  XENP018815 1G6_H1_L1.69_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASTRYTGVPDRFTGSGYGTEFTLTISSLQSEDFAVYFCQQDYSSPRTFGGGTKVEIK

SEQ ID NO: 9114 - protein, 122 aa, Artificial Sequence; identical to SEQ ID NO: 6246
  Description of Artificial Sequence: Synthetic polypeptide
  VH of XENP018815

SEQ ID NO: 9115 - protein, 107 aa, Artificial Sequence
  Description of Artificial Sequence: Synthetic polypeptide
  VL of XENP018815
SIVMTQSPATLSVSPGERATLSCRASQSVSNDVAWYQQKPGQSPRLLINYASTRYTGVPDRFTGSGYGTEFTLTISSLQSEDFAVYFCQQDYSSPRTFGGGTKVEIK

SEQ ID NO: 9116 - protein, 5 aa, Artificial Sequence
  Description of Artificial Sequence: Synthetic peptide
  XENP018815 vhCDR1
NYWMN

SEQ ID NO: 9117 - protein, 19 aa, Artificial Sequence
  Description of Artificial Sequence: Synthetic peptide
  XENP018815 vhCDR2
EIRLKSNNYATHYAEPVKG

SEQ ID NO: 9118 - protein, 11 aa, Artificial Sequence
  Description of Artificial Sequence: Synthetic peptide
  XENP018815 vhCDR3
YYGNYGGYFDV

SEQ ID NO: 9119 - protein, 11 aa, Artificial Sequence
  Description of Artificial Sequence: Synthetic peptide
  XENP018815 vlCDR1
RASQSVSNDVA

SEQ ID NO: 9120 - protein, 7 aa, Artificial Sequence
  Description of Artificial Sequence: Synthetic peptide
  XENP018815 vlCDR2
YASTRYT

SEQ ID NO: 9121 - protein, 9 aa, Artificial Sequence
  Description of Artificial Sequence: Synthetic peptide
  XENP018815 vlCDR3
QQDYSSPRT

SEQ ID NO: 9122 - protein, 249 aa, Artificial Sequence
  Description of Artificial Sequence: Synthetic polypeptide
  XENP018816 1G6_H1_L1.70_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASKRYTGVPDRFTGSGYGTEFTLTISSLQSEDFAVYFCQQDYSSPRTFGGGTKVEIK

SEQ ID NO: 9123 - protein, 122 aa, Artificial Sequence; identical to SEQ ID NO: 6246
  Description of Artificial Sequence: Synthetic polypeptide
  VH of XENP018816

SEQ ID NO: 9124 - protein, 107 aa, Artificial Sequence
  Description of Artificial Sequence: Synthetic polypeptide
  VL of XENP018816
SIVMTQSPATLSVSPGERATLSCRASQSVSNDVAWYQQKPGQSPRLLINYASKRYTGVPDRFTGSGYGTEFTLTISSLQSEDFAVYFCQQDYSSPRTFGGGTKVEIK

SEQ ID NO: 9125 - protein, 5 aa, Artificial Sequence
  Description of Artificial Sequence: Synthetic peptide
  XENP018816 vhCDR1
NYWMN

SEQ ID NO: 9126 - protein, 19 aa, Artificial Sequence
  Description of Artificial Sequence: Synthetic peptide
  XENP018816 vhCDR2
EIRLKSNNYATHYAEPVKG

SEQ ID NO: 9127 - protein, 11 aa, Artificial Sequence
  Description of Artificial Sequence: Synthetic peptide
  XENP018816 vhCDR3
YYGNYGGYFDV

SEQ ID NO: 9128 - protein, 11 aa, Artificial Sequence
  Description of Artificial Sequence: Synthetic peptide
  XENP018816 vlCDR1
RASQSVSNDVA

SEQ ID NO: 9129 - protein, 7 aa, Artificial Sequence
  Description of Artificial Sequence: Synthetic peptide
  XENP018816 vlCDR2
YASKRYT

SEQ ID NO: 9130 - protein, 9 aa, Artificial Sequence
  Description of Artificial Sequence: Synthetic peptide
  XENP018816 vlCDR3
QQDYSSPRT

SEQ ID NO: 9131 - protein, 249 aa, Artificial Sequence
  Description of Artificial Sequence: Synthetic polypeptide
  XENP018817 1G6_H1_L1.71_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASGRYTGVPDRFTGSGYGTEFTLTISSLQSEDFAVYFCQQDYSSPRTFGGGTKVEIK

SEQ ID NO: 9132 - protein, 122 aa, Artificial Sequence; identical to SEQ ID NO: 6246
  Description of Artificial Sequence: Synthetic polypeptide
  VH of XENP018817

SEQ ID NO: 9133 - protein, 107 aa, Artificial Sequence
  Description of Artificial Sequence: Synthetic polypeptide
  VL of XENP018817
SIVMTQSPATLSVSPGERATLSCRASQSVSNDVAWYQQKPGQSPRLLINYASGRYTGVPDRFTGSGYGTEFTLTISSLQSEDFAVYFCQQDYSSPRTFGGGTKVEIK

SEQ ID NO: 9134 - protein, 5 aa, Artificial Sequence
  Description of Artificial Sequence: Synthetic peptide
  XENP018817 vhCDR1
NYWMN

SEQ ID NO: 9135 - protein, 19 aa, Artificial Sequence
  Description of Artificial Sequence: Synthetic peptide
  XENP018817 vhCDR2
EIRLKSNNYATHYAEPVKG

SEQ ID NO: 9136 - protein, 11 aa, Artificial Sequence
  Description of Artificial Sequence: Synthetic peptide
  XENP018817 vhCDR3
YYGNYGGYFDV

SEQ ID NO: 9137 - protein, 11 aa, Artificial Sequence
  Description of Artificial Sequence: Synthetic peptide
  XENP018817 vlCDR1
RASQSVSNDVA

SEQ ID NO: 9138 - protein, 7 aa, Artificial Sequence
  Description of Artificial Sequence: Synthetic peptide
  XENP018817 vlCDR2
YASGRYT

SEQ ID NO: 9139 - protein, 9 aa, Artificial Sequence
  Description of Artificial Sequence: Synthetic peptide
  XENP018817 vlCDR3
QQDYSSPRT

SEQ ID NO: 9140 - protein, 249 aa, Artificial Sequence
  Description of Artificial Sequence: Synthetic polypeptide
  XENP018818 1G6_H1_L1.72_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASLRYTGVPDRFTGSGYGTEFTLTISSLQSEDFAVYFCQQDYSSPRTFGGGTKVEIK

SEQ ID NO: 9141 - protein, 122 aa, Artificial Sequence; identical to SEQ ID NO: 6246
  Description of Artificial Sequence: Synthetic polypeptide
  VH of XENP018818

SEQ ID NO: 9142 - protein, 107 aa, Artificial Sequence
  Description of Artificial Sequence: Synthetic polypeptide
  VL of XENP018818
SIVMTQSPATLSVSPGERATLSCRASQSVSNDVAWYQQKPGQSPRLLINYASLRYTGVPDRFTGSGYGTEFTLTISSLQSEDFAVYFCQQDYSSPRTFGGGTKVEIK

SEQ ID NO: 9143 - protein, 5 aa, Artificial Sequence
  Description of Artificial Sequence: Synthetic peptide
  XENP018818 vhCDR1
NYWMN

SEQ ID NO: 9144 - protein, 19 aa, Artificial Sequence
  Description of Artificial Sequence: Synthetic peptide
  XENP018818 vhCDR2
EIRLKSNNYATHYAEPVKG

SEQ ID NO: 9145 - protein, 11 aa, Artificial Sequence
  Description of Artificial Sequence: Synthetic peptide
  XENP018818 vhCDR3
YYGNYGGYFDV

SEQ ID NO: 9146 - protein, 11 aa, Artificial Sequence
  Description of Artificial Sequence: Synthetic peptide
  XENP018818 vlCDR1
RASQSVSNDVA

SEQ ID NO: 9147 - protein, 7 aa, Artificial Sequence
  Description of Artificial Sequence: Synthetic peptide
  XENP018818 vlCDR2
YASLRYT

SEQ ID NO: 9148 - protein, 9 aa, Artificial Sequence
  Description of Artificial Sequence: Synthetic peptide
  XENP018818 vlCDR3
QQDYSSPRT

SEQ ID NO: 9149 - protein, 249 aa, Artificial Sequence
  Description of Artificial Sequence: Synthetic polypeptide
  XENP018819 1G6_H1_L1.73_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHLYTGVPDRFTGSGYGTEFTLTISSLQSEDFAVYFCQQDYSSPRTFGGGTKVEIK

SEQ ID NO: 9150 - protein, 122 aa, Artificial Sequence; identical to SEQ ID NO: 6246
  Description of Artificial Sequence: Synthetic polypeptide
  VH of XENP018819

SEQ ID NO: 9151 - protein, 107 aa, Artificial Sequence
  Description of Artificial Sequence: Synthetic polypeptide
  VL of XENP018819
SIVMTQSPATLSVSPGERATLSCRASQSVSNDVAWYQQKPGQSPRLLINYASHLYTGVPDRFTGSGYGTEFTLTISSLQSEDFAVYFCQQDYSSPRTFGGGTKVEIK

SEQ ID NO: 9152 - protein, 5 aa, Artificial Sequence
  Description of Artificial Sequence: Synthetic peptide
  XENP018819 vhCDR1
NYWMN

SEQ ID NO: 9153 - protein, 19 aa, Artificial Sequence
  Description of Artificial Sequence: Synthetic peptide
  XENP018819 vhCDR2
EIRLKSNNYATHYAEPVKG

SEQ ID NO: 9154 - protein, 11 aa, Artificial Sequence
  Description of Artificial Sequence: Synthetic peptide
  XENP018819 vhCDR3
YYGNYGGYFDV

SEQ ID NO: 9155 - protein, 11 aa, Artificial Sequence
  Description of Artificial Sequence: Synthetic peptide
  XENP018819 vlCDR1
RASQSVSNDVA

SEQ ID NO: 9156 - protein, 7 aa, Artificial Sequence
  Description of Artificial Sequence: Synthetic peptide
  XENP018819 vlCDR2
YASHLYT

SEQ ID NO: 9157 - protein, 9 aa, Artificial Sequence
  Description of Artificial Sequence: Synthetic peptide
  XENP018819 vlCDR3
QQDYSSPRT

SEQ ID NO: 9158 - protein, 249 aa, Artificial Sequence
  Description of Artificial Sequence: Synthetic polypeptide
  XENP018820 1G6_H1_L1.74_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHWYTGVPDRFTGSGYGTEFTLTISSLQSEDFAVYFCQQDYSSPRTFGGGTKVEIK

SEQ ID NO: 9159 - protein, 122 aa, Artificial Sequence; identical to SEQ ID NO: 6246
  Description of Artificial Sequence: Synthetic polypeptide
  VH of XENP018820

SEQ ID NO: 9160 - protein, 107 aa, Artificial Sequence
  Description of Artificial Sequence: Synthetic polypeptide
  VL of XENP018820
SIVMTQSPATLSVSPGERATLSCRASQSVSNDVAWYQQKPGQSPRLLINYASHWYTGVPDRFTGSGYGTEFTLTISSLQSEDFAVYFCQQDYSSPRTFGGGTKVEIK

SEQ ID NO: 9161 - protein, 5 aa, Artificial Sequence
  Description of Artificial Sequence: Synthetic peptide
  XENP018820 vhCDR1
NYWMN

SEQ ID NO: 9162 - protein, 19 aa, Artificial Sequence
  Description of Artificial Sequence: Synthetic peptide
  XENP018820 vhCDR2
EIRLKSNNYATHYAEPVKG

SEQ ID NO: 9163 - protein, 11 aa, Artificial Sequence
  Description of Artificial Sequence: Synthetic peptide
  XENP018820 vhCDR3
YYGNYGGYFDV

SEQ ID NO: 9164 - protein, 11 aa, Artificial Sequence
  Description of Artificial Sequence: Synthetic peptide
  XENP018820 vlCDR1
RASQSVSNDVA

SEQ ID NO: 9165 - protein, 7 aa, Artificial Sequence
  Description of Artificial Sequence: Synthetic peptide
  XENP018820 vlCDR2
YASHWYT

SEQ ID NO: 9166 - protein, 9 aa, Artificial Sequence
  Description of Artificial Sequence: Synthetic peptide
  XENP018820 vlCDR3
QQDYSSPRT

SEQ ID NO: 9167 - protein, 249 aa, Artificial Sequence
  Description of Artificial Sequence: Synthetic polypeptide
  XENP018821 1G6_H1_L1.75_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHSYTGVPDRFTGSGYGTEFTLTISSLQSEDFAVYFCQQDYSSPRTFGGGTKVEIK

SEQ ID NO: 9168 - protein, 122 aa, Artificial Sequence; identical to SEQ ID NO: 6246
  Description of Artificial Sequence: Synthetic polypeptide
  VH of XENP018821

SEQ ID NO: 9169 - protein, 107 aa, Artificial Sequence
  Description of Artificial Sequence: Synthetic polypeptide
  VL of XENP018821
SIVMTQSPATLSVSPGERATLSCRASQSVSNDVAWYQQKPGQSPRLLINYASHSYTGVPDRFTGSGYGTEFTLTISSLQSEDFAVYFCQQDYSSPRTFGGGTKVEIK

SEQ ID NO: 9170 - protein, 5 aa, Artificial Sequence
  Description of Artificial Sequence: Synthetic peptide
  XENP018821 vhCDR1
NYWMN

SEQ ID NO: 9171 - protein, 19 aa, Artificial Sequence
  Description of Artificial Sequence: Synthetic peptide
  XENP018821 vhCDR2
EIRLKSNNYATHYAEPVKG

SEQ ID NO: 9172 - protein, 11 aa, Artificial Sequence
  Description of Artificial Sequence: Synthetic peptide
  XENP018821 vhCDR3
YYGNYGGYFDV

SEQ ID NO: 9173 - protein, 11 aa, Artificial Sequence
  Description of Artificial Sequence: Synthetic peptide
  XENP018821 vlCDR1
RASQSVSNDVA

SEQ ID NO: 9174 - protein, 7 aa, Artificial Sequence
  Description of Artificial Sequence: Synthetic peptide
  XENP018821 vlCDR2
YASHSYT

SEQ ID NO: 9175 - protein, 9 aa, Artificial Sequence
  Description of Artificial Sequence: Synthetic peptide
  XENP018821 vlCDR3
QQDYSSPRT

SEQ ID NO: 9176 - protein, 249 aa, Artificial Sequence
  Description of Artificial Sequence: Synthetic polypeptide
  XENP018822 1G6_H1_L1.76_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRFTGVPDRFTGSGYGTEFTLTISSLQSEDFAVYFCQQDYSSPRTFGGGTKVEIK

SEQ ID NO: 9177 - protein, 122 aa, Artificial Sequence; identical to SEQ ID NO: 6246
  Description of Artificial Sequence: Synthetic polypeptide
  VH of XENP018822

SEQ ID NO: 9178 - protein, 107 aa, Artificial Sequence
  Description of Artificial Sequence: Synthetic polypeptide
  VL of XENP018822
SIVMTQSPATLSVSPGERATLSCRASQSVSNDVAWYQQKPGQSPRLLINYASHRFTGVPDRFTGSGYGTEFTLTISSLQSEDFAVYFCQQDYSSPRTFGGGTKVEIK

SEQ ID NO: 9179 - protein, 5 aa, Artificial Sequence
  Description of Artificial Sequence: Synthetic peptide
  XENP018822 vhCDR1
NYWMN

SEQ ID NO: 9180 - protein, 19 aa, Artificial Sequence
  Description of Artificial Sequence: Synthetic peptide
  XENP018822 vhCDR2
EIRLKSNNYATHYAEPVKG

SEQ ID NO: 9181 - protein, 11 aa, Artificial Sequence
  Description of Artificial Sequence: Synthetic peptide
  XENP018822 vhCDR3
YYGNYGGYFDV

SEQ ID NO: 9182 - protein, 11 aa, Artificial Sequence
  Description of Artificial Sequence: Synthetic peptide
  XENP018822 vlCDR1
RASQSVSNDVA

SEQ ID NO: 9183 - protein, 7 aa, Artificial Sequence
  Description of Artificial Sequence: Synthetic peptide
  XENP018822 vlCDR2
YASHRFT

SEQ ID NO: 9184 - protein, 9 aa, Artificial Sequence
  Description of Artificial Sequence: Synthetic peptide
  XENP018822 vlCDR3
QQDYSSPRT

SEQ ID NO: 9185 - protein, 249 aa, Artificial Sequence
  Description of Artificial Sequence: Synthetic polypeptide
  XENP018823 1G6_H1_L1.77_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRHTGVPDRFTGSGYGTEFTLTISSLQSEDFAVYFCQQDYSSPRTFGGGTKVEIK

SEQ ID NO: 9186 - protein, 122 aa, Artificial Sequence; identical to SEQ ID NO: 6246
  Description of Artificial Sequence: Synthetic polypeptide
  VH of XENP018823

SEQ ID NO: 9187 - protein, 107 aa, Artificial Sequence
  Description of Artificial Sequence: Synthetic polypeptide
  VL of XENP018823
SIVMTQSPATLSVSPGERATLSCRASQSVSNDVAWYQQKPGQSPRLLINYASHRHTGVPDRFTGSGYGTEFTLTISSLQSEDFAVYFCQQDYSSPRTFGGGTKVEIK

SEQ ID NO: 9188 - protein, 5 aa, Artificial Sequence
  Description of Artificial Sequence: Synthetic peptide
  XENP018823 vhCDR1
NYWMN

SEQ ID NO: 9189 - protein, 19 aa, Artificial Sequence
  Description of Artificial Sequence: Synthetic peptide
  XENP018823 vhCDR2
EIRLKSNNYATHYAEPVKG

SEQ ID NO: 9190 - protein, 11 aa, Artificial Sequence
  Description of Artificial Sequence: Synthetic peptide
  XENP018823 vhCDR3
YYGNYGGYFDV

SEQ ID NO: 9191 - protein, 11 aa, Artificial Sequence
  Description of Artificial Sequence: Synthetic peptide
  XENP018823 vlCDR1
RASQSVSNDVA

SEQ ID NO: 9192 - protein, 7 aa, Artificial Sequence
  Description of Artificial Sequence: Synthetic peptide
  XENP018823 vlCDR2
YASHRHT

SEQ ID NO: 9193 - protein, 9 aa, Artificial Sequence
  Description of Artificial Sequence: Synthetic peptide
  XENP018823 vlCDR3
QQDYSSPRT

SEQ ID NO: 9194 - protein, 249 aa, Artificial Sequence
  Description of Artificial Sequence: Synthetic polypeptide
  XENP018824 1G6_H1_L1.78_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRLTGVPDRFTGSGYGTEFTLTISSLQSEDFAVYFCQQDYSSPRTFGGGTKVEIK

SEQ ID NO: 9195 - protein, 122 aa, Artificial Sequence; identical to SEQ ID NO: 6246
  Description of Artificial Sequence: Synthetic polypeptide
  VH of XENP018824

SEQ ID NO: 9196 - protein, 107 aa, Artificial Sequence
  Description of Artificial Sequence: Synthetic polypeptide
  VL of XENP018824
SIVMTQSPATLSVSPGERATLSCRASQSVSNDVAWYQQKPGQSPRLLINYASHRLTGVPDRFTGSGYGTEFTLTISSLQSEDFAVYFCQQDYSSPRTFGGGTKVEIK

SEQ ID NO: 9197 - protein, 5 aa, Artificial Sequence
  Description of Artificial Sequence: Synthetic peptide
  XENP018824 vhCDR1
NYWMN

SEQ ID NO: 9198 - protein, 19 aa, Artificial Sequence
  Description of Artificial Sequence: Synthetic peptide
  XENP018824 vhCDR2
EIRLKSNNYATHYAEPVKG

SEQ ID NO: 9199 - protein, 11 aa, Artificial Sequence
  Description of Artificial Sequence: Synthetic peptide
  XENP018824 vhCDR3
YYGNYGGYFDV

SEQ ID NO: 9200 - protein, 11 aa, Artificial Sequence
  Description of Artificial Sequence: Synthetic peptide
  XENP018824 vlCDR1
RASQSVSNDVA

SEQ ID NO: 9201 - protein, 7 aa, Artificial Sequence
  Description of Artificial Sequence: Synthetic peptide
  XENP018824 vlCDR2
YASHRLT

SEQ ID NO: 9202 - protein, 9 aa, Artificial Sequence
  Description of Artificial Sequence: Synthetic peptide
  XENP018824 vlCDR3
QQDYSSPRT

SEQ ID NO: 9203 - protein, 249 aa, Artificial Sequence
  Description of Artificial Sequence: Synthetic polypeptide
  XENP018825 1G6_H1_L1.79_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRWTGVPDRFTGSGYGTEFTLTISSLQSEDFAVYFCQQDYSSPRTFGGGTKVEIK

SEQ ID NO: 9204 - protein, 122 aa, Artificial Sequence; identical to SEQ ID NO: 6246
  Description of Artificial Sequence: Synthetic polypeptide
  VH of XENP018825

SEQ ID NO: 9205 - protein, 107 aa, Artificial Sequence
  Description of Artificial Sequence: Synthetic polypeptide
  VL of XENP018825
SIVMTQSPATLSVSPGERATLSCRASQSVSNDVAWYQQKPGQSPRLLINYASHRWTGVPDRFTGSGYGTEFTLTISSLQSEDFAVYFCQQDYSSPRTFGGGTKVEIK

SEQ ID NO: 9206 - protein, 5 aa, Artificial Sequence
  Description of Artificial Sequence: Synthetic peptide
  XENP018825 vhCDR1
NYWMN

SEQ ID NO: 9207 - protein, 19 aa, Artificial Sequence
  Description of Artificial Sequence: Synthetic peptide
  XENP018825 vhCDR2
EIRLKSNNYATHYAEPVKG

SEQ ID NO: 9208 - protein, 11 aa, Artificial Sequence
  Description of Artificial Sequence: Synthetic peptide
  XENP018825 vhCDR3
YYGNYGGYFDV

SEQ ID NO: 9209 - protein, 11 aa, Artificial Sequence
  Description of Artificial Sequence: Synthetic peptide
  XENP018825 vlCDR1
RASQSVSNDVA

SEQ ID NO: 9210 - protein, 7 aa, Artificial Sequence
  Description of Artificial Sequence: Synthetic peptide
  XENP018825 vlCDR2
YASHRWT

SEQ ID NO: 9211 - protein, 9 aa, Artificial Sequence
  Description of Artificial Sequence: Synthetic peptide
  XENP018825 vlCDR3
QQDYSSPRT

SEQ ID NO: 9212 - protein, 249 aa, Artificial Sequence
  Description of Artificial Sequence: Synthetic polypeptide
  XENP018826 1G6_H1_L1.80_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRVTGVPDRFTGSGYGTEFTLTISSLQSEDFAVYFCQQDYSSPRTFGGGTKVEIK

SEQ ID NO: 9213 - protein, 122 aa, Artificial Sequence; identical to SEQ ID NO: 6246
  Description of Artificial Sequence: Synthetic polypeptide
  VH of XENP018826

SEQ ID NO: 9214 - protein, 107 aa, Artificial Sequence
  Description of Artificial Sequence: Synthetic polypeptide
  VL of XENP018826
SIVMTQSPATLSVSPGERATLSCRASQSVSNDVAWYQQKPGQSPRLLINYASHRVTGVPDRFTGSGYGTEFTLTISSLQSEDFAVYFCQQDYSSPRTFGGGTKVEIK

SEQ ID NO: 9215 - protein, 5 aa, Artificial Sequence
  Description of Artificial Sequence: Synthetic peptide
  XENP018826 vhCDR1
NYWMN

SEQ ID NO: 9216 - protein, 19 aa, Artificial Sequence
  Description of Artificial Sequence: Synthetic peptide
  XENP018826 vhCDR2
EIRLKSNNYATHYAEPVKG

SEQ ID NO: 9217 - protein, 11 aa, Artificial Sequence
  Description of Artificial Sequence: Synthetic peptide
  XENP018826 vhCDR3
YYGNYGGYFDV

SEQ ID NO: 9218 - protein, 11 aa, Artificial Sequence
  Description of Artificial Sequence: Synthetic peptide
  XENP018826 vlCDR1
RASQSVSNDVA

SEQ ID NO: 9219 - protein, 7 aa, Artificial Sequence
  Description of Artificial Sequence: Synthetic peptide
  XENP018826 vlCDR2
YASHRVT

SEQ ID NO: 9220 - protein, 9 aa, Artificial Sequence
  Description of Artificial Sequence: Synthetic peptide
  XENP018826 vlCDR3
QQDYSSPRT

SEQ ID NO: 9221 - protein, 249 aa, Artificial Sequence
  Description of Artificial Sequence: Synthetic polypeptide
  XENP018827 1G6_H1_L1.81_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRATGVPDRFTGSGYGTEFTLTISSLQSEDFAVYFCQQDYSSPRTFGGGTKVEIK

SEQ ID NO: 9222 - protein, 122 aa, Artificial Sequence; identical to SEQ ID NO: 6246
  Description of Artificial Sequence: Synthetic polypeptide
  VH of XENP018827

SEQ ID NO: 9223 - protein, 107 aa, Artificial Sequence
  Description of Artificial Sequence: Synthetic polypeptide
  VL of XENP018827
SIVMTQSPATLSVSPGERATLSCRASQSVSNDVAWYQQKPGQSPRLLINYASHRATGVPDRFTGSGYGTEFTLTISSLQSEDFAVYFCQQDYSSPRTFGGGTKVEIK

SEQ ID NO: 9224 - protein, 5 aa, Artificial Sequence
  Description of Artificial Sequence: Synthetic peptide
  XENP018827 vhCDR1
NYWMN

SEQ ID NO: 9225 - protein, 19 aa, Artificial Sequence
  Description of Artificial Sequence: Synthetic peptide
  XENP018827 vhCDR2
EIRLKSNNYATHYAEPVKG

SEQ ID NO: 9226 - protein, 11 aa, Artificial Sequence
  Description of Artificial Sequence: Synthetic peptide
  XENP018827 vhCDR3
YYGNYGGYFDV

SEQ ID NO: 9227 - protein, 11 aa, Artificial Sequence
  Description of Artificial Sequence: Synthetic peptide
  XENP018827 vlCDR1
RASQSVSNDVA

SEQ ID NO: 9228 - protein, 7 aa, Artificial Sequence
  Description of Artificial Sequence: Synthetic peptide
  XENP018827 vlCDR2
YASHRAT

SEQ ID NO: 9229 - protein, 9 aa, Artificial Sequence
  Description of Artificial Sequence: Synthetic peptide
  XENP018827 vlCDR3
QQDYSSPRT

SEQ ID NO: 9230 - protein, 249 aa, Artificial Sequence
  Description of Artificial Sequence: Synthetic polypeptide
  XENP018828 1G6_H1_L1.82_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRQTGVPDRFTGSGYGTEFTLTISSLQSEDFAVYFCQQDYSSPRTFGGGTKVEIK

SEQ ID NO: 9231 - protein, 122 aa, Artificial Sequence; identical to SEQ ID NO: 6246
  Description of Artificial Sequence: Synthetic polypeptide
  VH of XENP018828

SEQ ID NO: 9232 - protein, 107 aa, Artificial Sequence
  Description of Artificial Sequence: Synthetic polypeptide
  VL of XENP018828
SIVMTQSPATLSVSPGERATLSCRASQSVSNDVAWYQQKPGQSPRLLINYASHRQTGVPDRFTGSGYGTEFTLTISSLQSEDFAVYFCQQDYSSPRTFGGGTKVEIK

SEQ ID NO: 9233 - protein, 5 aa, Artificial Sequence
  Description of Artificial Sequence: Synthetic peptide
  XENP018828 vhCDR1
NYWMN

SEQ ID NO: 9234 - protein, 19 aa, Artificial Sequence
  Description of Artificial Sequence: Synthetic peptide
  XENP018828 vhCDR2
EIRLKSNNYATHYAEPVKG

SEQ ID NO: 9235 - protein, 11 aa, Artificial Sequence
  Description of Artificial Sequence: Synthetic peptide
  XENP018828 vhCDR3
YYGNYGGYFDV

SEQ ID NO: 9236 - protein, 11 aa, Artificial Sequence
  Description of Artificial Sequence: Synthetic peptide
  XENP018828 vlCDR1
RASQSVSNDVA

SEQ ID NO: 9237 - protein, 7 aa, Artificial Sequence
  Description of Artificial Sequence: Synthetic peptide
  XENP018828 vlCDR2
YASHRQT

SEQ ID NO: 9238 - protein, 9 aa, Artificial Sequence
  Description of Artificial Sequence: Synthetic peptide
  XENP018828 vlCDR3
QQDYSSPRT

SEQ ID NO: 9239 - protein, 249 aa, Artificial Sequence
  Description of Artificial Sequence: Synthetic polypeptide
  XENP018829 1G6_H1_L1.83_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRDTGVPDRFTGSGYGTEFTLTISSLQSEDFAVYFCQQDYSSPRTFGGGTKVEIK

SEQ ID NO: 9240 - protein, 122 aa, Artificial Sequence; identical to SEQ ID NO: 6246
  Description of Artificial Sequence: Synthetic polypeptide
  VH of XENP018829

SEQ ID NO: 9241 - protein, 107 aa, Artificial Sequence
  Description of Artificial Sequence: Synthetic polypeptide
  VL of XENP018829
SIVMTQSPATLSVSPGERATLSCRASQSVSNDVAWYQQKPGQSPRLLINYASHRDTGVPDRFTGSGYGTEFTLTISSLQSEDFAVYFCQQDYSSPRTFGGGTKVEIK

SEQ ID NO: 9242 - protein, 5 aa, Artificial Sequence
  Description of Artificial Sequence: Synthetic peptide
  XENP018829 vhCDR1
NYWMN

SEQ ID NO: 9243 - protein, 19 aa, Artificial Sequence
  Description of Artificial Sequence: Synthetic peptide
  XENP018829 vhCDR2
EIRLKSNNYATHYAEPVKG

SEQ ID NO: 9244 - protein, 11 aa, Artificial Sequence
  Description of Artificial Sequence: Synthetic peptide
  XENP018829 vhCDR3
YYGNYGGYFDV

SEQ ID NO: 9245 - protein, 11 aa, Artificial Sequence
  Description of Artificial Sequence: Synthetic peptide
  XENP018829 vlCDR1
RASQSVSNDVA

SEQ ID NO: 9246 - protein, 7 aa, Artificial Sequence
  Description of Artificial Sequence: Synthetic peptide
  XENP018829 vlCDR2
YASHRDT

SEQ ID NO: 9247 - protein, 9 aa, Artificial Sequence
  Description of Artificial Sequence: Synthetic peptide
  XENP018829 vlCDR3
QQDYSSPRT

SEQ ID NO: 9248 - protein, 249 aa, Artificial Sequence
  Description of Artificial Sequence: Synthetic polypeptide
  XENP018830 1G6_H1_L1.84_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRKTGVPDRFTGSGYGTEFTLTISSLQSEDFAVYFCQQDYSSPRTFGGGTKVEIK

SEQ ID NO: 9249 - protein, 122 aa, Artificial Sequence; identical to SEQ ID NO: 6246
  Description of Artificial Sequence: Synthetic polypeptide
  VH of XENP018830

SEQ ID NO: 9250 - protein, 107 aa, Artificial Sequence
  Description of Artificial Sequence: Synthetic polypeptide
  VL of XENP018830
SIVMTQSPATLSVSPGERATLSCRASQSVSNDVAWYQQKPGQSPRLLINYASHRKTGVPDRFTGSGYGTEFTLTISSLQSEDFAVYFCQQDYSSPRTFGGGTKVEIK

SEQ ID NO: 9251 - protein, 5 aa, Artificial Sequence
  Description of Artificial Sequence: Synthetic peptide
  XENP018830 vhCDR1
NYWMN

SEQ ID NO: 9252 - protein, 19 aa, Artificial Sequence
  Description of Artificial Sequence: Synthetic peptide
  XENP018830 vhCDR2
EIRLKSNNYATHYAEPVKG

SEQ ID NO: 9253 - protein, 11 aa, Artificial Sequence
  Description of Artificial Sequence: Synthetic peptide
  XENP018830 vhCDR3
YYGNYGGYFDV

SEQ ID NO: 9254 - protein, 11 aa, Artificial Sequence
  Description of Artificial Sequence: Synthetic peptide
  XENP018830 vlCDR1
RASQSVSNDVA

SEQ ID NO: 9255 - protein, 7 aa, Artificial Sequence
  Description of Artificial Sequence: Synthetic peptide
  XENP018830 vlCDR2
YASHRKT

SEQ ID NO: 9256 - protein, 9 aa, Artificial Sequence
  Description of Artificial Sequence: Synthetic peptide
  XENP018830 vlCDR3
QQDYSSPRT

SEQ ID NO: 9257 - protein, 249 aa, Artificial Sequence
  Description of Artificial Sequence: Synthetic polypeptide
  XENP018831 1G6_H1_L1.85_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYVGVPDRFTGSGYGTEFTLTISSLQSEDFAVYFCQQDYSSPRTFGGGTKVEIK

SEQ ID NO: 9258 - protein, 122 aa, Artificial Sequence; identical to SEQ ID NO: 6246
  Description of Artificial Sequence: Synthetic polypeptide
  VH of XENP018831

SEQ ID NO: 9259 - protein, 107 aa, Artificial Sequence
  Description of Artificial Sequence: Synthetic polypeptide
  VL of XENP018831
SIVMTQSPATLSVSPGERATLSCRASQSVSNDVAWYQQKPGQSPRLLINYASHRYVGVPDRFTGSGYGTEFTLTISSLQSEDFAVYFCQQDYSSPRTFGGGTKVEIK

SEQ ID NO: 9260 - protein, 5 aa, Artificial Sequence
  Description of Artificial Sequence: Synthetic peptide
  XENP018831 vhCDR1
NYWMN

SEQ ID NO: 9261 - protein, 19 aa, Artificial Sequence
  Description of Artificial Sequence: Synthetic peptide
  XENP018831 vhCDR2
EIRLKSNNYATHYAEPVKG

SEQ ID NO: 9262 - protein, 11 aa, Artificial Sequence
  Description of Artificial Sequence: Synthetic peptide
  XENP018831 vhCDR3
YYGNYGGYFDV

SEQ ID NO: 9263 - protein, 11 aa, Artificial Sequence
  Description of Artificial Sequence: Synthetic peptide
  XENP018831 vlCDR1
RASQSVSNDVA

SEQ ID NO: 9264 - protein, 7 aa, Artificial Sequence
  Description of Artificial Sequence: Synthetic peptide
  XENP018831 vlCDR2
YASHRYV

SEQ ID NO: 9265 - protein, 9 aa, Artificial Sequence
  Description of Artificial Sequence: Synthetic peptide
  XENP018831 vlCDR3
QQDYSSPRT

SEQ ID NO: 9266 - protein, 249 aa, Artificial Sequence
  Description of Artificial Sequence: Synthetic polypeptide
  XENP018832 1G6_H1_L1.86_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYSGVPDRFTGSGYGTEFTLTISSLQSEDFAVYFCQQDYSSPRTFGGGTKVEIK

SEQ ID NO: 9267 - protein, 122 aa, Artificial Sequence; identical to SEQ ID NO: 6246
  Description of Artificial Sequence: Synthetic polypeptide
  VH of XENP018832

SEQ ID NO: 9268 - protein, 107 aa, Artificial Sequence
  Description of Artificial Sequence: Synthetic polypeptide
  VL of XENP018832
SIVMTQSPATLSVSPGERATLSCRASQSVSNDVAWYQQKPGQSPRLLINYASHRYSGVPDRFTGSGYGTEFTLTISSLQSEDFAVYFCQQDYSSPRTFGGGTKVEIK

SEQ ID NO: 9269 - protein, 5 aa, Artificial Sequence
  Description of Artificial Sequence: Synthetic peptide
  XENP018832 vhCDR1
NYWMN

SEQ ID NO: 9270 - protein, 19 aa, Artificial Sequence
  Description of Artificial Sequence: Synthetic peptide
  XENP018832 vhCDR2
EIRLKSNNYATHYAEPVKG

SEQ ID NO: 9271 - protein, 11 aa, Artificial Sequence
  Description of Artificial Sequence: Synthetic peptide
  XENP018832 vhCDR3
YYGNYGGYFDV

SEQ ID NO: 9272 - protein, 11 aa, Artificial Sequence
  Description of Artificial Sequence: Synthetic peptide
  XENP018832 vlCDR1
RASQSVSNDVA

SEQ ID NO: 9273 - protein, 7 aa, Artificial Sequence
  Description of Artificial Sequence: Synthetic peptide
  XENP018832 vlCDR2
YASHRYS

SEQ ID NO: 9274 - protein, 9 aa, Artificial Sequence
  Description of Artificial Sequence: Synthetic peptide
  XENP018832 vlCDR3
QQDYSSPRT

SEQ ID NO: 9275 - protein, 249 aa, Artificial Sequence
  Description of Artificial Sequence: Synthetic polypeptide
  XENP018833 1G6_H1_L1.87_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYAGVPDRFTGSGYGTEFTLTISSLQSEDFAVYFCQQDYSSPRTFGGGTKVEIK

SEQ ID NO: 9276 - protein, 122 aa, Artificial Sequence; identical to SEQ ID NO: 6246
  Description of Artificial Sequence: Synthetic polypeptide
  VH of XENP018833

SEQ ID NO: 9277 - protein, 107 aa, Artificial Sequence
  Description of Artificial Sequence: Synthetic polypeptide
  VL of XENP018833
SIVMTQSPATLSVSPGERATLSCRASQSVSNDVAWYQQKPGQSPRLLINYASHRYAGVPDRFTGSGYGTEFTLTISSLQSEDFAVYFCQQDYSSPRTFGGGTKVEIK

SEQ ID NO: 9278 - protein, 5 aa, Artificial Sequence
  Description of Artificial Sequence: Synthetic peptide
  XENP018833 vhCDR1
NYWMN

SEQ ID NO: 9279 - protein, 19 aa, Artificial Sequence
  Description of Artificial Sequence: Synthetic peptide
  XENP018833 vhCDR2
EIRLKSNNYATHYAEPVKG

SEQ ID NO: 9280 - protein, 11 aa, Artificial Sequence
  Description of Artificial Sequence: Synthetic peptide
  XENP018833 vhCDR3
YYGNYGGYFDV

SEQ ID NO: 9281 - protein, 11 aa, Artificial Sequence
  Description of Artificial Sequence: Synthetic peptide
  XENP018833 vlCDR1
RASQSVSNDVA

SEQ ID NO: 9282 - protein, 7 aa, Artificial Sequence
  Description of Artificial Sequence: Synthetic peptide
  XENP018833 vlCDR2
YASHRYA

SEQ ID NO: 9283 - protein, 9 aa, Artificial Sequence
  Description of Artificial Sequence: Synthetic peptide
  XENP018833 vlCDR3
QQDYSSPRT

SEQ ID NO: 9284 - protein, 249 aa, Artificial Sequence
  Description of Artificial Sequence: Synthetic polypeptide
  XENP018834 1G6_H1_L1.88_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYIGVPDRFTGSGYGTEFTLTISSLQSEDFAVYFCQQDYSSPRTFGGGTKVEIK

SEQ ID NO: 9285 - protein, 122 aa, Artificial Sequence; identical to SEQ ID NO: 6246
  Description of Artificial Sequence: Synthetic polypeptide
  VH of XENP018834

SEQ ID NO: 9286 - protein, 107 aa, Artificial Sequence
  Description of Artificial Sequence: Synthetic polypeptide
  VL of XENP018834
SIVMTQSPATLSVSPGERATLSCRASQSVSNDVAWYQQKPGQSPRLLINYASHRYIGVPDRFTGSGYGTEFTLTISSLQSEDFAVYFCQQDYSSPRTFGGGTKVEIK

SEQ ID NO: 9287 - protein, 5 aa, Artificial Sequence
  Description of Artificial Sequence: Synthetic peptide
  XENP018834 vhCDR1
NYWMN

SEQ ID NO: 9288 - protein, 19 aa, Artificial Sequence
  Description of Artificial Sequence: Synthetic peptide
  XENP018834 vhCDR2
EIRLKSNNYATHYAEPVKG

SEQ ID NO: 9289 - protein, 11 aa, Artificial Sequence
  Description of Artificial Sequence: Synthetic peptide
  XENP018834 vhCDR3
YYGNYGGYFDV

SEQ ID NO: 9290 - protein, 11 aa, Artificial Sequence
  Description of Artificial Sequence: Synthetic peptide
  XENP018834 vlCDR1
RASQSVSNDVA

SEQ ID NO: 9291 - protein, 7 aa, Artificial Sequence
  Description of Artificial Sequence: Synthetic peptide
  XENP018834 vlCDR2
YASHRYI

SEQ ID NO: 9292 - protein, 9 aa, Artificial Sequence
  Description of Artificial Sequence: Synthetic peptide
  XENP018834 vlCDR3
QQDYSSPRT

SEQ ID NO: 9293 - protein, 249 aa, Artificial Sequence
  Description of Artificial Sequence: Synthetic polypeptide
  XENP018835 1G6_H1_L1.89_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYQGVPDRFTGSGYGTEFTLTISSLQSEDFAVYFCQQDYSSPRTFGGGTKVEIK

SEQ ID NO: 9294 - protein, 122 aa, Artificial Sequence; identical to SEQ ID NO: 6246
  Description of Artificial Sequence: Synthetic polypeptide
  VH of XENP018835

SEQ ID NO: 9295 - protein, 107 aa, Artificial Sequence
  Description of Artificial Sequence: Synthetic polypeptide
  VL of XENP018835
SIVMTQSPATLSVSPGERATLSCRASQSVSNDVAWYQQKPGQSPRLLINYASHRYQGVPDRFTGSGYGTEFTLTISSLQSEDFAVYFCQQDYSSPRTFGGGTKVEIK

SEQ ID NO: 9296 - protein, 5 aa, Artificial Sequence
  Description of Artificial Sequence: Synthetic peptide
  XENP018835 vhCDR1
NYWMN

SEQ ID NO: 9297 - protein, 19 aa, Artificial Sequence
  Description of Artificial Sequence: Synthetic peptide
  XENP018835 vhCDR2
EIRLKSNNYATHYAEPVKG

SEQ ID NO: 9298 - protein, 11 aa, Artificial Sequence
  Description of Artificial Sequence: Synthetic peptide
  XENP018835 vhCDR3
YYGNYGGYFDV

SEQ ID NO: 9299 - protein, 11 aa, Artificial Sequence
  Description of Artificial Sequence: Synthetic peptide
  XENP018835 vlCDR1
RASQSVSNDVA

SEQ ID NO: 9300 - protein, 7 aa, Artificial Sequence
  Description of Artificial Sequence: Synthetic peptide
  XENP018835 vlCDR2
YASHRYQ

SEQ ID NO: 9301 - protein, 9 aa, Artificial Sequence
  Description of Artificial Sequence: Synthetic peptide
  XENP018835 vlCDR3
QQDYSSPRT

SEQ ID NO: 9302 - protein, 249 aa, Artificial Sequence
  Description of Artificial Sequence: Synthetic polypeptide
  XENP018836 1G6_H1_L1.90_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYHGVPDRFTGSGYGTEFTLTISSLQSEDFAVYFCQQDYSSPRTFGGGTKVEIK

SEQ ID NO: 9303 - protein, 122 aa, Artificial Sequence; identical to SEQ ID NO: 6246
  Description of Artificial Sequence: Synthetic polypeptide
  VH of XENP018836

SEQ ID NO: 9304 - protein, 107 aa, Artificial Sequence
  Description of Artificial Sequence: Synthetic polypeptide
  VL of XENP018836
SIVMTQSPATLSVSPGERATLSCRASQSVSNDVAWYQQKPGQSPRLLINYASHRYHGVPDRFTGSGYGTEFTLTISSLQSEDFAVYFCQQDYSSPRTFGGGTKVEIK

SEQ ID NO: 9305 - protein, 5 aa, Artificial Sequence
  Description of Artificial Sequence: Synthetic peptide
  XENP018836 vhCDR1
NYWMN

SEQ ID NO: 9306 - protein, 19 aa, Artificial Sequence
  Description of Artificial Sequence: Synthetic peptide
  XENP018836 vhCDR2
EIRLKSNNYATHYAEPVKG

SEQ ID NO: 9307 - protein, 11 aa, Artificial Sequence
  Description of Artificial Sequence: Synthetic peptide
  XENP018836 vhCDR3
YYGNYGGYFDV

SEQ ID NO: 9308 - protein, 11 aa, Artificial Sequence
  Description of Artificial Sequence: Synthetic peptide
  XENP018836 vlCDR1
RASQSVSNDVA

SEQ ID NO: 9309 - protein, 7 aa, Artificial Sequence
  Description of Artificial Sequence: Synthetic peptide
  XENP018836 vlCDR2
YASHRYH

SEQ ID NO: 9310 - protein, 9 aa, Artificial Sequence
  Description of Artificial Sequence: Synthetic peptide
  XENP018836 vlCDR3
QQDYSSPRT

SEQ ID NO: 9311 - protein, 249 aa, Artificial Sequence
  Description of Artificial Sequence: Synthetic polypeptide
  XENP018837 1G6_H1_L1.91_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYDGVPDRFTGSGYGTEFTLTISSLQSEDFAVYFCQQDYSSPRTFGGGTKVEIK

SEQ ID NO: 9312 - protein, 122 aa, Artificial Sequence; identical to SEQ ID NO: 6246
  Description of Artificial Sequence: Synthetic polypeptide
  VH of XENP018837

SEQ ID NO: 9313 - protein, 107 aa, Artificial Sequence
  Description of Artificial Sequence: Synthetic polypeptide
  VL of XENP018837
SIVMTQSPATLSVSPGERATLSCRASQSVSNDVAWYQQKPGQSPRLLINYASHRYDGVPDRFTGSGYGTEFTLTISSLQSEDFAVYFCQQDYSSPRTFGGGTKVEIK

SEQ ID NO: 9314 - protein, 5 aa, Artificial Sequence
  Description of Artificial Sequence: Synthetic peptide
  XENP018837 vhCDR1
NYWMN

SEQ ID NO: 9315 - protein, 19 aa, Artificial Sequence
  Description of Artificial Sequence: Synthetic peptide
  XENP018837 vhCDR2
EIRLKSNNYATHYAEPVKG

SEQ ID NO: 9316 - protein, 11 aa, Artificial Sequence
  Description of Artificial Sequence: Synthetic peptide
  XENP018837 vhCDR3
YYGNYGGYFDV

SEQ ID NO: 9317 - protein, 11 aa, Artificial Sequence
  Description of Artificial Sequence: Synthetic peptide
  XENP018837 vlCDR1
RASQSVSNDVA

SEQ ID NO: 9318 - protein, 7 aa, Artificial Sequence
  Description of Artificial Sequence: Synthetic peptide
  XENP018837 vlCDR2
YASHRYD

SEQ ID NO: 9319 - protein, 9 aa, Artificial Sequence
  Description of Artificial Sequence: Synthetic peptide
  XENP018837 vlCDR3
QQDYSSPRT

SEQ ID NO: 9320 - protein, 249 aa, Artificial Sequence
  Description of Artificial Sequence: Synthetic polypeptide
  XENP018838 1G6_H1_L1.92_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYKGVPDRFTGSGYGTEFTLTISSLQSEDFAVYFCQQDYSSPRTFGGGTKVEIK

SEQ ID NO: 9321 - protein, 122 aa, Artificial Sequence; identical to SEQ ID NO: 6246
  Description of Artificial Sequence: Synthetic polypeptide
  VH of XENP018838

SEQ ID NO: 9322 - protein, 107 aa, Artificial Sequence
  Description of Artificial Sequence: Synthetic polypeptide
  VL of XENP018838
SIVMTQSPATLSVSPGERATLSCRASQSVSNDVAWYQQKPGQSPRLLINYASHRYKGVPDRFTGSGYGTEFTLTISSLQSEDFAVYFCQQDYSSPRTFGGGTKVEIK

SEQ ID NO: 9323 - protein, 5 aa, Artificial Sequence
  Description of Artificial Sequence: Synthetic peptide
  XENP018838 vhCDR1
NYWMN

SEQ ID NO: 9324 - protein, 19 aa, Artificial Sequence
  Description of Artificial Sequence: Synthetic peptide
  XENP018838 vhCDR2
EIRLKSNNYATHYAEPVKG

SEQ ID NO: 9325 - protein, 11 aa, Artificial Sequence
  Description of Artificial Sequence: Synthetic peptide
  XENP018838 vhCDR3
YYGNYGGYFDV

SEQ ID NO: 9326 - protein, 11 aa, Artificial Sequence
  Description of Artificial Sequence: Synthetic peptide
  XENP018838 vlCDR1
RASQSVSNDVA

SEQ ID NO: 9327 - protein, 7 aa, Artificial Sequence
  Description of Artificial Sequence: Synthetic peptide
  XENP018838 vlCDR2
YASHRYK

SEQ ID NO: 9328 - protein, 9 aa, Artificial Sequence
  Description of Artificial Sequence: Synthetic peptide
  XENP018838 vlCDR3
QQDYSSPRT

SEQ ID NO: 9329 - protein, 249 aa, Artificial Sequence
  Description of Artificial Sequence: Synthetic polypeptide
  XENP018839 1G6_H1_L1.93_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYYGVPDRFTGSGYGTEFTLTISSLQSEDFAVYFCQQDYSSPRTFGGGTKVEIK

SEQ ID NO: 9330 - protein, 122 aa, Artificial Sequence; identical to SEQ ID NO: 6246
  Description of Artificial Sequence: Synthetic polypeptide
  VH of XENP018839

SEQ ID NO: 9331 - protein, 107 aa, Artificial Sequence
  Description of Artificial Sequence: Synthetic polypeptide
  VL of XENP018839
SIVMTQSPATLSVSPGERATLSCRASQSVSNDVAWYQQKPGQSPRLLINYASHRYYGVPDRFTGSGYGTEFTLTISSLQSEDFAVYFCQQDYSSPRTFGGGTKVEIK

SEQ ID NO: 9332 - protein, 5 aa, Artificial Sequence
  Description of Artificial Sequence: Synthetic peptide
  XENP018839 vhCDR1
NYWMN

SEQ ID NO: 9333 - protein, 19 aa, Artificial Sequence
  Description of Artificial Sequence: Synthetic peptide
  XENP018839 vhCDR2
EIRLKSNNYATHYAEPVKG

SEQ ID NO: 9334 - protein, 11 aa, Artificial Sequence
  Description of Artificial Sequence: Synthetic peptide
  XENP018839 vhCDR3
YYGNYGGYFDV

SEQ ID NO: 9335 - protein, 11 aa, Artificial Sequence
  Description of Artificial Sequence: Synthetic peptide
  XENP018839 vlCDR1
RASQSVSNDVA

SEQ ID NO: 9336 - protein, 7 aa, Artificial Sequence
  Description of Artificial Sequence: Synthetic peptide
  XENP018839 vlCDR2
YASHRYY

SEQ ID NO: 9337 - protein, 9 aa, Artificial Sequence
  Description of Artificial Sequence: Synthetic peptide
  XENP018839 vlCDR3
QQDYSSPRT

SEQ ID NO: 9338 - protein, 249 aa, Artificial Sequence
  Description of Artificial Sequence: Synthetic polypeptide
  XENP018840 1G6_H1_L1.94_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTSVPDRFTGSGYGTEFTLTISSLQSEDFAVYFCQQDYSSPRTFGGGTKVEIK

SEQ ID NO: 9339 - protein, 122 aa, Artificial Sequence; identical to SEQ ID NO: 6246
  Description of Artificial Sequence: Synthetic polypeptide
  VH of XENP018840

SEQ ID NO: 9340 - protein, 107 aa, Artificial Sequence
  Description of Artificial Sequence: Synthetic polypeptide
  VL of XENP018840
SIVMTQSPATLSVSPGERATLSCRASQSVSNDVAWYQQKPGQSPRLLINYASHRYTSVPDRFTGSGYGTEFTLTISSLQSEDFAVYFCQQDYSSPRTFGGGTKVEIK

SEQ ID NO: 9341 - protein, 5 aa, Artificial Sequence
  Description of Artificial Sequence: Synthetic peptide
  XENP018840 vhCDR1
NYWMN

SEQ ID NO: 9342 - protein, 19 aa, Artificial Sequence
  Description of Artificial Sequence: Synthetic peptide
  XENP018840 vhCDR2
EIRLKSNNYATHYAEPVKG

SEQ ID NO: 9343 - protein, 11 aa, Artificial Sequence
  Description of Artificial Sequence: Synthetic peptide
  XENP018840 vhCDR3
YYGNYGGYFDV

SEQ ID NO: 9344 - protein, 11 aa, Artificial Sequence
  Description of Artificial Sequence: Synthetic peptide
  XENP018840 vlCDR1
RASQSVSNDVA

SEQ ID NO: 9345 - protein, 7 aa, Artificial Sequence
  Description of Artificial Sequence: Synthetic peptide
  XENP018840 vlCDR2
YASHRYT

SEQ ID NO: 9346 - protein, 9 aa, Artificial Sequence
  Description of Artificial Sequence: Synthetic peptide
  XENP018840 vlCDR3
QQDYSSPRT

SEQ ID NO: 9347 - protein, 249 aa, Artificial Sequence
  Description of Artificial Sequence: Synthetic polypeptide
  XENP018841 1G6_H1_L1.95_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGIPDRFTGSGYGTEFTLTISSLQSEDFAVYFCQQDYSSPRTFGGGTKVEIK

SEQ ID NO: 9348 - protein, 122 aa, Artificial Sequence; identical to SEQ ID NO: 6246
  Description of Artificial Sequence: Synthetic polypeptide
  VH of XENP018841

SEQ ID NO: 9349 - protein, 107 aa, Artificial Sequence
  Description of Artificial Sequence: Synthetic polypeptide
  VL of XENP018841
SIVMTQSPATLSVSPGERATLSCRASQSVSNDVAWYQQKPGQSPRLLINYASHRYTGIPDRFTGSGYGTEFTLTISSLQSEDFAVYFCQQDYSSPRTFGGGTKVEIK

SEQ ID NO: 9350 - protein, 5 aa, Artificial Sequence
  Description of Artificial Sequence: Synthetic peptide
  XENP018841 vhCDR1
NYWMN

SEQ ID NO: 9351 - protein, 19 aa, Artificial Sequence
  Description of Artificial Sequence: Synthetic peptide
  XENP018841 vhCDR2
EIRLKSNNYATHYAEPVKG

SEQ ID NO: 9352 - protein, 11 aa, Artificial Sequence
  Description of Artificial Sequence: Synthetic peptide
  XENP018841 vhCDR3
YYGNYGGYFDV

SEQ ID NO: 9353 - protein, 11 aa, Artificial Sequence
  Description of Artificial Sequence: Synthetic peptide
  XENP018841 vlCDR1
RASQSVSNDVA

SEQ ID NO: 9354 - protein, 7 aa, Artificial Sequence
  Description of Artificial Sequence: Synthetic peptide
  XENP018841 vlCDR2
YASHRYT

SEQ ID NO: 9355 - protein, 9 aa, Artificial Sequence
  Description of Artificial Sequence: Synthetic peptide
  XENP018841 vlCDR3
QQDYSSPRT

SEQ ID NO: 9356 - protein, 249 aa, Artificial Sequence
  Description of Artificial Sequence: Synthetic polypeptide
  XENP018842 1G6_H1_L1.96_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPARFTGSGYGTEFTLTISSLQSEDFAVYFCQQDYSSPRTFGGGTKVEIK

SEQ ID NO: 9357 - protein, 122 aa, Artificial Sequence; identical to SEQ ID NO: 6246
  Description of Artificial Sequence: Synthetic polypeptide
  VH of XENP018842

SEQ ID NO: 9358 - protein, 107 aa, Artificial Sequence
  Description of Artificial Sequence: Synthetic polypeptide
  VL of XENP018842
SIVMTQSPATLSVSPGERATLSCRASQSVSNDVAWYQQKPGQSPRLLINYASHRYTGVPARFTGSGYGTEFTLTISSLQSEDFAVYFCQQDYSSPRTFGGGTKVEIK

SEQ ID NO: 9359 - protein, 5 aa, Artificial Sequence
  Description of Artificial Sequence: Synthetic peptide
  XENP018842 vhCDR1
NYWMN

SEQ ID NO: 9360 - protein, 19 aa, Artificial Sequence
  Description of Artificial Sequence: Synthetic peptide
  XENP018842 vhCDR2
EIRLKSNNYATHYAEPVKG

SEQ ID NO: 9361 - protein, 11 aa, Artificial Sequence
  Description of Artificial Sequence: Synthetic peptide
  XENP018842 vhCDR3
YYGNYGGYFDV

SEQ ID NO: 9362 - protein, 11 aa, Artificial Sequence
  Description of Artificial Sequence: Synthetic peptide
  XENP018842 vlCDR1
RASQSVSNDVA

SEQ ID NO: 9363 - protein, 7 aa, Artificial Sequence
  Description of Artificial Sequence: Synthetic peptide
  XENP018842 vlCDR2
YASHRYT

SEQ ID NO: 9364 - protein, 9 aa, Artificial Sequence
  Description of Artificial Sequence: Synthetic peptide
  XENP018842 vlCDR3
QQDYSSPRT

SEQ ID NO: 9365 - protein, 249 aa, Artificial Sequence
  Description of Artificial Sequence: Synthetic polypeptide
  XENP018843 1G6_H1_L1.97_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFSGSGYGTEFTLTISSLQSEDFAVYFCQQDYSSPRTFGGGTKVEIK

SEQ ID NO: 9366 - protein, 122 aa, Artificial Sequence; identical to SEQ ID NO: 6246
  Description of Artificial Sequence: Synthetic polypeptide
  VH of XENP018843

SEQ ID NO: 9367 - protein, 107 aa, Artificial Sequence
  Description of Artificial Sequence: Synthetic polypeptide
  VL of XENP018843
SIVMTQSPATLSVSPGERATLSCRASQSVSNDVAWYQQKPGQSPRLLINYASHRYTGVPDRFSGSGYGTEFTLTISSLQSEDFAVYFCQQDYSSPRTFGGGTKVEIK

SEQ ID NO: 9368 - protein, 5 aa, Artificial Sequence
  Description of Artificial Sequence: Synthetic peptide
  XENP018843 vhCDR1
NYWMN

SEQ ID NO: 9369 - protein, 19 aa, Artificial Sequence
  Description of Artificial Sequence: Synthetic peptide
  XENP018843 vhCDR2
EIRLKSNNYATHYAEPVKG

SEQ ID NO: 9370 - protein, 11 aa, Artificial Sequence
  Description of Artificial Sequence: Synthetic peptide
  XENP018843 vhCDR3
YYGNYGGYFDV

SEQ ID NO: 9371 - protein, 11 aa, Artificial Sequence
  Description of Artificial Sequence: Synthetic peptide
  XENP018843 vlCDR1
RASQSVSNDVA

SEQ ID NO: 9372 - protein, 7 aa, Artificial Sequence
  Description of Artificial Sequence: Synthetic peptide
  XENP018843 vlCDR2
YASHRYT

SEQ ID NO: 9373 - protein, 9 aa, Artificial Sequence
  Description of Artificial Sequence: Synthetic peptide
  XENP018843 vlCDR3
QQDYSSPRT

SEQ ID NO: 9374 - protein, 249 aa, Artificial Sequence
  Description of Artificial Sequence: Synthetic polypeptide
  XENP018844 1G6_H1_L1.98_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGSGTEFTLTISSLQSEDFAVYFCQQDYSSPRTFGGGTKVEIK

SEQ ID NO: 9375 - protein, 122 aa, Artificial Sequence; identical to SEQ ID NO: 6246
  Description of Artificial Sequence: Synthetic polypeptide
  VH of XENP018844

SEQ ID NO: 9376 - protein, 107 aa, Artificial Sequence
  Description of Artificial Sequence: Synthetic polypeptide
  VL of XENP018844
SIVMTQSPATLSVSPGERATLSCRASQSVSNDVAWYQQKPGQSPRLLINYASHRYTGVPDRFTGSGSGTEFTLTISSLQSEDFAVYFCQQDYSSPRTFGGGTKVEIK

SEQ ID NO: 9377 - protein, 5 aa, Artificial Sequence
  Description of Artificial Sequence: Synthetic peptide
  XENP018844 vhCDR1
NYWMN

SEQ ID NO: 9378 - protein, 19 aa, Artificial Sequence
  Description of Artificial Sequence: Synthetic peptide
  XENP018844 vhCDR2
EIRLKSNNYATHYAEPVKG

SEQ ID NO: 9379 - protein, 11 aa, Artificial Sequence
  Description of Artificial Sequence: Synthetic peptide
  XENP018844 vhCDR3
YYGNYGGYFDV

SEQ ID NO: 9380 - protein, 11 aa, Artificial Sequence
  Description of Artificial Sequence: Synthetic peptide
  XENP018844 vlCDR1
RASQSVSNDVA

SEQ ID NO: 9381 - protein, 7 aa, Artificial Sequence
  Description of Artificial Sequence: Synthetic peptide
  XENP018844 vlCDR2
YASHRYT

SEQ ID NO: 9382 - protein, 9 aa, Artificial Sequence
  Description of Artificial Sequence: Synthetic peptide
  XENP018844 vlCDR3
QQDYSSPRT

SEQ ID NO: 9383 - protein, 249 aa, Artificial Sequence
  Description of Artificial Sequence: Synthetic polypeptide
  XENP018845 1G6_H1_L1.99_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGPGTEFTLTISSLQSEDFAVYFCQQDYSSPRTFGGGTKVEIK

SEQ ID NO: 9384 - protein, 122 aa, Artificial Sequence; identical to SEQ ID NO: 6246
  Description of Artificial Sequence: Synthetic polypeptide
  VH of XENP018845

SEQ ID NO: 9385 - protein, 107 aa, Artificial Sequence
  Description of Artificial Sequence: Synthetic polypeptide
  VL of XENP018845
SIVMTQSPATLSVSPGERATLSCRASQSVSNDVAWYQQKPGQSPRLLINYASHRYTGVPDRFTGSGPGTEFTLTISSLQSEDFAVYFCQQDYSSPRTFGGGTKVEIK

SEQ ID NO: 9386 - protein, 5 aa, Artificial Sequence
  Description of Artificial Sequence: Synthetic peptide
  XENP018845 vhCDR1
NYWMN

SEQ ID NO: 9387 - protein, 19 aa, Artificial Sequence
  Description of Artificial Sequence: Synthetic peptide
  XENP018845 vhCDR2
EIRLKSNNYATHYAEPVKG

SEQ ID NO: 9388 - protein, 11 aa, Artificial Sequence
  Description of Artificial Sequence: Synthetic peptide
  XENP018845 vhCDR3
YYGNYGGYFDV

SEQ ID NO: 9389 - protein, 11 aa, Artificial Sequence
  Description of Artificial Sequence: Synthetic peptide
  XENP018845 vlCDR1
RASQSVSNDVA

SEQ ID NO: 9390 - protein, 7 aa, Artificial Sequence
  Description of Artificial Sequence: Synthetic peptide
  XENP018845 vlCDR2
YASHRYT

SEQ ID NO: 9391 - protein, 9 aa, Artificial Sequence
  Description of Artificial Sequence: Synthetic peptide
  XENP018845 vlCDR3
QQDYSSPRT

SEQ ID NO: 9392 - protein, 249 aa, Artificial Sequence
  Description of Artificial Sequence: Synthetic polypeptide
  XENP018846 1G6_H1_L1.100_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTDFTLTISSLQSEDFAVYFCQQDYSSPRTFGGGTKVEIK

SEQ ID NO: 9393 - protein, 122 aa, Artificial Sequence; identical to SEQ ID NO: 6246
  Description of Artificial Sequence: Synthetic polypeptide
  VH of XENP018846

SEQ ID NO: 9394 - protein, 107 aa, Artificial Sequence
  Description of Artificial Sequence: Synthetic polypeptide
  VL of XENP018846
SIVMTQSPATLSVSPGERATLSCRASQSVSNDVAWYQQKPGQSPRLLINYASHRYTGVPDRFTGSGYGTDFTLTISSLQSEDFAVYFCQQDYSSPRTFGGGTKVEIK

SEQ ID NO: 9395 - protein, 5 aa, Artificial Sequence
  Description of Artificial Sequence: Synthetic peptide
  XENP018846 vhCDR1
NYWMN

SEQ ID NO: 9396 - protein, 19 aa, Artificial Sequence
  Description of Artificial Sequence: Synthetic peptide
  XENP018846 vhCDR2
EIRLKSNNYATHYAEPVKG

SEQ ID NO: 9397 - protein, 11 aa, Artificial Sequence
  Description of Artificial Sequence: Synthetic peptide
  XENP018846 vhCDR3
YYGNYGGYFDV

SEQ ID NO: 9398 - protein, 11 aa, Artificial Sequence
  Description of Artificial Sequence: Synthetic peptide
  XENP018846 vlCDR1
RASQSVSNDVA

SEQ ID NO: 9399 - protein, 7 aa, Artificial Sequence
  Description of Artificial Sequence: Synthetic peptide
  XENP018846 vlCDR2
YASHRYT

SEQ ID NO: 9400 - protein, 9 aa, Artificial Sequence
  Description of Artificial Sequence: Synthetic peptide
  XENP018846 vlCDR3
QQDYSSPRT

SEQ ID NO: 9401 - protein, 249 aa, Artificial Sequence
  Description of Artificial Sequence: Synthetic polypeptide
  XENP018847 1G6_H1_L1.101_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTFTISSLQSEDFAVYFCQQDYSSPRTFGGGTKVEIK

SEQ ID NO: 9402 - protein, 122 aa, Artificial Sequence; identical to SEQ ID NO: 6246
  Description of Artificial Sequence: Synthetic polypeptide
  VH of XENP018847

SEQ ID NO: 9403 - protein, 107 aa, Artificial Sequence
  Description of Artificial Sequence: Synthetic polypeptide
  VL of XENP018847
SIVMTQSPATLSVSPGERATLSCRASQSVSNDVAWYQQKPGQSPRLLINYASHRYTGVPDRFTGSGYGTEFTFTISSLQSEDFAVYFCQQDYSSPRTFGGGTKVEIK

SEQ ID NO: 9404 - protein, 5 aa, Artificial Sequence
  Description of Artificial Sequence: Synthetic peptide
  XENP018847 vhCDR1
NYWMN

SEQ ID NO: 9405 - protein, 19 aa, Artificial Sequence
  Description of Artificial Sequence: Synthetic peptide
  XENP018847 vhCDR2
EIRLKSNNYATHYAEPVKG

SEQ ID NO: 9406 - protein, 11 aa, Artificial Sequence
  Description of Artificial Sequence: Synthetic peptide
  XENP018847 vhCDR3
YYGNYGGYFDV

SEQ ID NO: 9407 - protein, 11 aa, Artificial Sequence
  Description of Artificial Sequence: Synthetic peptide
  XENP018847 vlCDR1
RASQSVSNDVA

SEQ ID NO: 9408 - protein, 7 aa, Artificial Sequence
  Description of Artificial Sequence: Synthetic peptide
  XENP018847 vlCDR2
YASHRYT

SEQ ID NO: 9409 - protein, 9 aa, Artificial Sequence
  Description of Artificial Sequence: Synthetic peptide
  XENP018847 vlCDR3
QQDYSSPRT

SEQ ID NO: 9410 - protein, 249 aa, Artificial Sequence
  Description of Artificial Sequence: Synthetic polypeptide
  XENP018848 1G6_H1_L1.102_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISTLQSEDFAVYFCQQDYSSPRTFGGGTKVEIK

SEQ ID NO: 9411 - protein, 122 aa, Artificial Sequence; identical to SEQ ID NO: 6246
  Description of Artificial Sequence: Synthetic polypeptide
  VH of XENP018848

SEQ ID NO: 9412 - protein, 107 aa, Artificial Sequence
  Description of Artificial Sequence: Synthetic polypeptide
  VL of XENP018848
SIVMTQSPATLSVSPGERATLSCRASQSVSNDVAWYQQKPGQSPRLLINYASHRYTGVPDRFTGSGYGTEFTLTISTLQSEDFAVYFCQQDYSSPRTFGGGTKVEIK

SEQ ID NO: 9413 - protein, 5 aa, Artificial Sequence
  Description of Artificial Sequence: Synthetic peptide
  XENP018848 vhCDR1
NYWMN

SEQ ID NO: 9414 - protein, 19 aa, Artificial Sequence
  Description of Artificial Sequence: Synthetic peptide
  XENP018848 vhCDR2
EIRLKSNNYATHYAEPVKG

SEQ ID NO: 9415 - protein, 11 aa, Artificial Sequence
  Description of Artificial Sequence: Synthetic peptide
  XENP018848 vhCDR3
YYGNYGGYFDV

SEQ ID NO: 9416 - protein, 11 aa, Artificial Sequence
  Description of Artificial Sequence: Synthetic peptide
  XENP018848 vlCDR1
RASQSVSNDVA

SEQ ID NO: 9417 - protein, 7 aa, Artificial Sequence
  Description of Artificial Sequence: Synthetic peptide
  XENP018848 vlCDR2
YASHRYT

SEQ ID NO: 9418 - protein, 9 aa, Artificial Sequence
  Description of Artificial Sequence: Synthetic peptide
  XENP018848 vlCDR3
QQDYSSPRT

SEQ ID NO: 9419 - protein, 249 aa, Artificial Sequence
  Description of Artificial Sequence: Synthetic polypeptide
  XENP018849 1G6_H1_L1.103_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSVQSEDFAVYFCQQDYSSPRTFGGGTKVEIK

SEQ ID NO: 9420 - protein, 122 aa, Artificial Sequence; identical to SEQ ID NO: 6246
  Description of Artificial Sequence: Synthetic polypeptide
  VH of XENP018849

SEQ ID NO: 9421 - protein, 107 aa, Artificial Sequence
  Description of Artificial Sequence: Synthetic polypeptide
  VL of XENP018849
SIVMTQSPATLSVSPGERATLSCRASQSVSNDVAWYQQKPGQSPRLLINYASHRYTGVPDRFTGSGYGTEFTLTISSVQSEDFAVYFCQQDYSSPRTFGGGTKVEIK

SEQ ID NO: 9422 - protein, 5 aa, Artificial Sequence
  Description of Artificial Sequence: Synthetic peptide
  XENP018849 vhCDR1
NYWMN

SEQ ID NO: 9423 - protein, 19 aa, Artificial Sequence
  Description of Artificial Sequence: Synthetic peptide
  XENP018849 vhCDR2
EIRLKSNNYATHYAEPVKG

SEQ ID NO: 9424 - protein, 11 aa, Artificial Sequence
  Description of Artificial Sequence: Synthetic peptide
  XENP018849 vhCDR3
YYGNYGGYFDV

SEQ ID NO: 9425 - protein, 11 aa, Artificial Sequence
  Description of Artificial Sequence: Synthetic peptide
  XENP018849 vlCDR1
RASQSVSNDVA

SEQ ID NO: 9426 - protein, 7 aa, Artificial Sequence
  Description of Artificial Sequence: Synthetic peptide
  XENP018849 vlCDR2
YASHRYT

SEQ ID NO: 9427 - protein, 9 aa, Artificial Sequence
  Description of Artificial Sequence: Synthetic peptide
  XENP018849 vlCDR3
QQDYSSPRT

SEQ ID NO: 9428 - protein, 249 aa, Artificial Sequence
  Description of Artificial Sequence: Synthetic polypeptide
  XENP018850 1G6_H1_L1.104_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQAEDFAVYFCQQDYSSPRTFGGGTKVEIK

SEQ ID NO: 9429 - protein, 122 aa, Artificial Sequence; identical to SEQ ID NO: 6246
  Description of Artificial Sequence: Synthetic polypeptide
  VH of XENP018850

SEQ ID NO: 9430 - protein, 107 aa, Artificial Sequence
  Description of Artificial Sequence: Synthetic polypeptide
  VL of XENP018850
SIVMTQSPATLSVSPGERATLSCRASQSVSNDVAWYQQKPGQSPRLLINYASHRYTGVPDRFTGSGYGTEFTLTISSLQAEDFAVYFCQQDYSSPRTFGGGTKVEIK

SEQ ID NO: 9431 - protein, 5 aa, Artificial Sequence
  Description of Artificial Sequence: Synthetic peptide
  XENP018850 vhCDR1
NYWMN

SEQ ID NO: 9432 - protein, 19 aa, Artificial Sequence
  Description of Artificial Sequence: Synthetic peptide
  XENP018850 vhCDR2
EIRLKSNNYATHYAEPVKG

SEQ ID NO: 9433 - protein, 11 aa, Artificial Sequence
  Description of Artificial Sequence: Synthetic peptide
  XENP018850 vhCDR3
YYGNYGGYFDV

SEQ ID NO: 9434 - protein, 11 aa, Artificial Sequence
  Description of Artificial Sequence: Synthetic peptide
  XENP018850 vlCDR1
RASQSVSNDVA

SEQ ID NO: 9435 - protein, 7 aa, Artificial Sequence
  Description of Artificial Sequence: Synthetic peptide
  XENP018850 vlCDR2
YASHRYT

SEQ ID NO: 9436 - protein, 9 aa, Artificial Sequence
  Description of Artificial Sequence: Synthetic peptide
  XENP018850 vlCDR3
QQDYSSPRT

SEQ ID NO: 9437 - protein, 249 aa, Artificial Sequence
  Description of Artificial Sequence: Synthetic polypeptide
  XENP018851 1G6_H1_L1.105_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDLAVYFCQQDYSSPRTFGGGTKVEIK

SEQ ID NO: 9438 - protein, 122 aa, Artificial Sequence; identical to SEQ ID NO: 6246
  Description of Artificial Sequence: Synthetic polypeptide
  VH of XENP018851

SEQ ID NO: 9439 - protein, 107 aa, Artificial Sequence
  Description of Artificial Sequence: Synthetic polypeptide
  VL of XENP018851
SIVMTQSPATLSVSPGERATLSCRASQSVSNDVAWYQQKPGQSPRLLINYASHRYTGVPDRFTGSGYGTEFTLTISSLQSEDLAVYFCQQDYSSPRTFGGGTKVEIK

SEQ ID NO: 9440 - protein, 5 aa, Artificial Sequence
  Description of Artificial Sequence: Synthetic peptide
  XENP018851 vhCDR1
NYWMN

SEQ ID NO: 9441 - protein, 19 aa, Artificial Sequence
  Description of Artificial Sequence: Synthetic peptide
  XENP018851 vhCDR2
EIRLKSNNYATHYAEPVKG

SEQ ID NO: 9442 - protein, 11 aa, Artificial Sequence
  Description of Artificial Sequence: Synthetic peptide
  XENP018851 vhCDR3
YYGNYGGYFDV

SEQ ID NO: 9443 - protein, 11 aa, Artificial Sequence
  Description of Artificial Sequence: Synthetic peptide
  XENP018851 vlCDR1
RASQSVSNDVA

SEQ ID NO: 9444 - protein, 7 aa, Artificial Sequence
  Description of Artificial Sequence: Synthetic peptide
  XENP018851 vlCDR2
YASHRYT

SEQ ID NO: 9445 - protein, 9 aa, Artificial Sequence
  Description of Artificial Sequence: Synthetic peptide
  XENP018851 vlCDR3
QQDYSSPRT

SEQ ID NO: 9446 - protein, 249 aa, Artificial Sequence
  Description of Artificial Sequence: Synthetic polypeptide
  XENP018852 1G6_H1_L1.106_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYYCQQDYSSPRTFGGGTKVEIK

SEQ ID NO: 9447 - protein, 122 aa, Artificial Sequence; identical to SEQ ID NO: 6246
  Description of Artificial Sequence: Synthetic polypeptide
  VH of XENP018852

SEQ ID NO: 9448 - protein, 107 aa, Artificial Sequence
  Description of Artificial Sequence: Synthetic polypeptide
  VL of XENP018852
SIVMTQSPATLSVSPGERATLSCRASQSVSNDVAWYQQKPGQSPRLLINYASHRYTGVPDRFTGSGYGTEFTLTISSLQSEDFAVYYCQQDYSSPRTFGGGTKVEIK

SEQ ID NO: 9449 - protein, 5 aa, Artificial Sequence
  Description of Artificial Sequence: Synthetic peptide
  XENP018852 vhCDR1
NYWMN

SEQ ID NO: 9450 - protein, 19 aa, Artificial Sequence
  Description of Artificial Sequence: Synthetic peptide
  XENP018852 vhCDR2
EIRLKSNNYATHYAEPVKG

SEQ ID NO: 9451 - protein, 11 aa, Artificial Sequence
  Description of Artificial Sequence: Synthetic peptide
  XENP018852 vhCDR3
YYGNYGGYFDV

SEQ ID NO: 9452 - protein, 11 aa, Artificial Sequence
  Description of Artificial Sequence: Synthetic peptide
  XENP018852 vlCDR1
RASQSVSNDVA

SEQ ID NO: 9453 - protein, 7 aa, Artificial Sequence
  Description of Artificial Sequence: Synthetic peptide
  XENP018852 vlCDR2
YASHRYT

SEQ ID NO: 9454 - protein, 9 aa, Artificial Sequence
  Description of Artificial Sequence: Synthetic peptide
  XENP018852 vlCDR3
QQDYSSPRT

SEQ ID NO: 9455 - protein, 249 aa, Artificial Sequence
  Description of Artificial Sequence: Synthetic polypeptide
  XENP018853 1G6_H1_L1.107_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQQYSSPRTFGGGTKVEIK

SEQ ID NO: 9456 - protein, 122 aa, Artificial Sequence; identical to SEQ ID NO: 6246
  Description of Artificial Sequence: Synthetic polypeptide
  VH of XENP018853

SEQ ID NO: 9457 - protein, 107 aa, Artificial Sequence
  Description of Artificial Sequence: Synthetic polypeptide
  VL of XENP018853
SIVMTQSPATLSVSPGERATLSCRASQSVSNDVAWYQQKPGQSPRLLINYASHRYTGVPDRFTGSGYGTEFTLTISSLQSEDFAVYFCQQQYSSPRTFGGGTKVEIK

SEQ ID NO: 9458 - protein, 5 aa, Artificial Sequence
  Description of Artificial Sequence: Synthetic peptide
  XENP018853 vhCDR1
NYWMN

SEQ ID NO: 9459 - protein, 19 aa, Artificial Sequence
  Description of Artificial Sequence: Synthetic peptide
  XENP018853 vhCDR2
EIRLKSNNYATHYAEPVKG

SEQ ID NO: 9460 - protein, 11 aa, Artificial Sequence
  Description of Artificial Sequence: Synthetic peptide
  XENP018853 vhCDR3
YYGNYGGYFDV

SEQ ID NO: 9461 - protein, 11 aa, Artificial Sequence
  Description of Artificial Sequence: Synthetic peptide
  XENP018853 vlCDR1
RASQSVSNDVA

SEQ ID NO: 9462 - protein, 7 aa, Artificial Sequence
  Description of Artificial Sequence: Synthetic peptide
  XENP018853 vlCDR2
YASHRYT

SEQ ID NO: 9463 - protein, 9 aa, Artificial Sequence
  Description of Artificial Sequence: Synthetic peptide
  XENP018853 vlCDR3
QQQYSSPRT

SEQ ID NO: 9464 - protein, 249 aa, Artificial Sequence
  Description of Artificial Sequence: Synthetic polypeptide
  XENP018854 1G6_H1_L1.108_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQEYSSPRTFGGGTKVEIK

SEQ ID NO: 9465 - protein, 122 aa, Artificial Sequence; identical to SEQ ID NO: 6246
  Description of Artificial Sequence: Synthetic polypeptide
  VH of XENP018854

SEQ ID NO: 9466 - protein, 107 aa, Artificial Sequence
  Description of Artificial Sequence: Synthetic polypeptide
  VL of XENP018854
SIVMTQSPATLSVSPGERATLSCRASQSVSNDVAWYQQKPGQSPRLLINYASHRYTGVPDRFTGSGYGTEFTLTISSLQSEDFAVYFCQQEYSSPRTFGGGTKVEIK

SEQ ID NO: 9467 - protein, 5 aa, Artificial Sequence
  Description of Artificial Sequence: Synthetic peptide
  XENP018854 vhCDR1
NYWMN

SEQ ID NO: 9468 - protein, 19 aa, Artificial Sequence
  Description of Artificial Sequence: Synthetic peptide
  XENP018854 vhCDR2
EIRLKSNNYATHYAEPVKG

SEQ ID NO: 9469 - protein, 11 aa, Artificial Sequence
  Description of Artificial Sequence: Synthetic peptide
  XENP018854 vhCDR3
YYGNYGGYFDV

SEQ ID NO: 9470 - protein, 11 aa, Artificial Sequence
  Description of Artificial Sequence: Synthetic peptide
  XENP018854 vlCDR1
RASQSVSNDVA

SEQ ID NO: 9471 - protein, 7 aa, Artificial Sequence
  Description of Artificial Sequence: Synthetic peptide
  XENP018854 vlCDR2
YASHRYT

SEQ ID NO: 9472 - protein, 9 aa, Artificial Sequence
  Description of Artificial Sequence: Synthetic peptide
  XENP018854 vlCDR3
QQEYSSPRT

SEQ ID NO: 9473 - protein, 249 aa, Artificial Sequence
  Description of Artificial Sequence: Synthetic polypeptide
  XENP018855 1G6_H1_L1.109_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQHYSSPRTFGGGTKVEIK

SEQ ID NO: 9474 - protein, 122 aa, Artificial Sequence; identical to SEQ ID NO: 6246
  Description of Artificial Sequence: Synthetic polypeptide
  VH of XENP018855

SEQ ID NO: 9475 - protein, 107 aa, Artificial Sequence
  Description of Artificial Sequence: Synthetic polypeptide
  VL of XENP018855
SIVMTQSPATLSVSPGERATLSCRASQSVSNDVAWYQQKPGQSPRLLINYASHRYTGVPDRFTGSGYGTEFTLTISSLQSEDFAVYFCQQHYSSPRTFGGGTKVEIK

SEQ ID NO: 9476 - protein, 5 aa, Artificial Sequence
  Description of Artificial Sequence: Synthetic peptide
  XENP018855 vhCDR1
NYWMN

SEQ ID NO: 9477 - protein, 19 aa, Artificial Sequence
  Description of Artificial Sequence: Synthetic peptide
  XENP018855 vhCDR2
EIRLKSNNYATHYAEPVKG

SEQ ID NO: 9478 - protein, 11 aa, Artificial Sequence
  Description of Artificial Sequence: Synthetic peptide
  XENP018855 vhCDR3
YYGNYGGYFDV

SEQ ID NO: 9479 - protein, 11 aa, Artificial Sequence
  Description of Artificial Sequence: Synthetic peptide
  XENP018855 vlCDR1
RASQSVSNDVA

SEQ ID NO: 9480 - protein, 7 aa, Artificial Sequence
  Description of Artificial Sequence: Synthetic peptide
  XENP018855 vlCDR2
YASHRYT

SEQ ID NO: 9481 - protein, 9 aa, Artificial Sequence
  Description of Artificial Sequence: Synthetic peptide
  XENP018855 vlCDR3
QQHYSSPRT

SEQ ID NO: 9482 - protein, 249 aa, Artificial Sequence
  Description of Artificial Sequence: Synthetic polypeptide
  XENP018856 1G6_H1_L1.110_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQSYSSPRTFGGGTKVEIK

SEQ ID NO: 9483 - protein, 122 aa, Artificial Sequence; identical to SEQ ID NO: 6246
  Description of Artificial Sequence: Synthetic polypeptide
  VH of XENP018856

SEQ ID NO: 9484 - protein, 107 aa, Artificial Sequence
  Description of Artificial Sequence: Synthetic polypeptide
  VL of XENP018856
SIVMTQSPATLSVSPGERATLSCRASQSVSNDVAWYQQKPGQSPRLLINYASHRYTGVPDRFTGSGYGTEFTLTISSLQSEDFAVYFCQQSYSSPRTFGGGTKVEIK

SEQ ID NO: 9485 - protein, 5 aa, Artificial Sequence
  Description of Artificial Sequence: Synthetic peptide
  XENP018856 vhCDR1
NYWMN

SEQ ID NO: 9486 - protein, 19 aa, Artificial Sequence
  Description of Artificial Sequence: Synthetic peptide
  XENP018856 vhCDR2
EIRLKSNNYATHYAEPVKG

SEQ ID NO: 9487 - protein, 11 aa, Artificial Sequence
  Description of Artificial Sequence: Synthetic peptide
  XENP018856 vhCDR3
YYGNYGGYFDV

SEQ ID NO: 9488 - protein, 11 aa, Artificial Sequence
  Description of Artificial Sequence: Synthetic peptide
  XENP018856 vlCDR1
RASQSVSNDVA

SEQ ID NO: 9489 - protein, 7 aa, Artificial Sequence
  Description of Artificial Sequence: Synthetic peptide
  XENP018856 vlCDR2
YASHRYT

SEQ ID NO: 9490 - protein, 9 aa, Artificial Sequence
  Description of Artificial Sequence: Synthetic peptide
  XENP018856 vlCDR3
QQSYSSPRT

SEQ ID NO: 9491 - protein, 249 aa, Artificial Sequence
  Description of Artificial Sequence: Synthetic polypeptide
  XENP018857 1G6_H1_L1.111_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQRYSSPRTFGGGTKVEIK

SEQ ID NO: 9492 - protein, 122 aa, Artificial Sequence; identical to SEQ ID NO: 6246
  Description of Artificial Sequence: Synthetic polypeptide
  VH of XENP018857

SEQ ID NO: 9493 - protein, 107 aa, Artificial Sequence
  Description of Artificial Sequence: Synthetic polypeptide
  VL of XENP018857
SIVMTQSPATLSVSPGERATLSCRASQSVSNDVAWYQQKPGQSPRLLINYASHRYTGVPDRFTGSGYGTEFTLTISSLQSEDFAVYFCQQRYSSPRTFGGGTKVEIK

SEQ ID NO: 9494 - protein, 5 aa, Artificial Sequence
  Description of Artificial Sequence: Synthetic peptide
  XENP018857 vhCDR1
NYWMN

SEQ ID NO: 9495 - protein, 19 aa, Artificial Sequence
  Description of Artificial Sequence: Synthetic peptide
  XENP018857 vhCDR2
EIRLKSNNYATHYAEPVKG

SEQ ID NO: 9496 - protein, 11 aa, Artificial Sequence
  Description of Artificial Sequence: Synthetic peptide
  XENP018857 vhCDR3
YYGNYGGYFDV

SEQ ID NO: 9497 - protein, 11 aa, Artificial Sequence
  Description of Artificial Sequence: Synthetic peptide
  XENP018857 vlCDR1
RASQSVSNDVA

SEQ ID NO: 9498 - protein, 7 aa, Artificial Sequence
  Description of Artificial Sequence: Synthetic peptide
  XENP018857 vlCDR2
YASHRYT

SEQ ID NO: 9499 - protein, 9 aa, Artificial Sequence
  Description of Artificial Sequence: Synthetic peptide
  XENP018857 vlCDR3
QQRYSSPRT

SEQ ID NO: 9500 - protein, 249 aa, Artificial Sequence
  Description of Artificial Sequence: Synthetic polypeptide
  XENP018858 1G6_H1_L1.112_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQLYSSPRTFGGGTKVEIK

SEQ ID NO: 9501 - protein, 122 aa, Artificial Sequence; identical to SEQ ID NO: 6246
  Description of Artificial Sequence: Synthetic polypeptide
  VH of XENP018858

SEQ ID NO: 9502 - protein, 107 aa, Artificial Sequence
  Description of Artificial Sequence: Synthetic polypeptide
  VL of XENP018858
SIVMTQSPATLSVSPGERATLSCRASQSVSNDVAWYQQKPGQSPRLLINYASHRYTGVPDRFTGSGYGTEFTLTISSLQSEDFAVYFCQQLYSSPRTFGGGTKVEIK

SEQ ID NO: 9503 - protein, 5 aa, Artificial Sequence
  Description of Artificial Sequence: Synthetic peptide
  XENP018858 vhCDR1
NYWMN

SEQ ID NO: 9504 - protein, 19 aa, Artificial Sequence
  Description of Artificial Sequence: Synthetic peptide
  XENP018858 vhCDR2
EIRLKSNNYATHYAEPVKG

SEQ ID NO: 9505 - protein, 11 aa, Artificial Sequence
  Description of Artificial Sequence: Synthetic peptide
  XENP018858 vhCDR3
YYGNYGGYFDV

SEQ ID NO: 9506 - protein, 11 aa, Artificial Sequence
  Description of Artificial Sequence: Synthetic peptide
  XENP018858 vlCDR1
RASQSVSNDVA

SEQ ID NO: 9507 - protein, 7 aa, Artificial Sequence
  Description of Artificial Sequence: Synthetic peptide
  XENP018858 vlCDR2
YASHRYT

SEQ ID NO: 9508 - protein, 9 aa, Artificial Sequence
  Description of Artificial Sequence: Synthetic peptide
  XENP018858 vlCDR3
QQLYSSPRT

SEQ ID NO: 9509 - protein, 249 aa, Artificial Sequence
  Description of Artificial Sequence: Synthetic polypeptide
  XENP018859 1G6_H1_L1.113_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQTYSSPRTFGGGTKVEIK

SEQ ID NO: 9510 - protein, 122 aa, Artificial Sequence; identical to SEQ ID NO: 6246
  Description of Artificial Sequence: Synthetic polypeptide
  VH of XENP018859

SEQ ID NO: 9511 - protein, 107 aa, Artificial Sequence
  Description of Artificial Sequence: Synthetic polypeptide
  VL of XENP018859
SIVMTQSPATLSVSPGERATLSCRASQSVSNDVAWYQQKPGQSPRLLINYASHRYTGVPDRFTGSGYGTEFTLTISSLQSEDFAVYFCQQTYSSPRTFGGGTKVEIK

SEQ ID NO: 9512 - protein, 5 aa, Artificial Sequence
  Description of Artificial Sequence: Synthetic peptide
  XENP018859 vhCDR1
NYWMN

SEQ ID NO: 9513 - protein, 19 aa, Artificial Sequence
  Description of Artificial Sequence: Synthetic peptide
  XENP018859 vhCDR2
EIRLKSNNYATHYAEPVKG

SEQ ID NO: 9514 - protein, 11 aa, Artificial Sequence
  Description of Artificial Sequence: Synthetic peptide
  XENP018859 vhCDR3
YYGNYGGYFDV

SEQ ID NO: 9515 - protein, 11 aa, Artificial Sequence
  Description of Artificial Sequence: Synthetic peptide
  XENP018859 vlCDR1
RASQSVSNDVA

SEQ ID NO: 9516 - protein, 7 aa, Artificial Sequence
  Description of Artificial Sequence: Synthetic peptide
  XENP018859 vlCDR2
YASHRYT

SEQ ID NO: 9517 - protein, 9 aa, Artificial Sequence
  Description of Artificial Sequence: Synthetic peptide
  XENP018859 vlCDR3
QQTYSSPRT

SEQ ID NO: 9518 - protein, 249 aa, Artificial Sequence
  Description of Artificial Sequence: Synthetic polypeptide
  XENP018860 1G6_H1_L1.114_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQGYSSPRTFGGGTKVEIK

SEQ ID NO: 9519 - protein, 122 aa, Artificial Sequence; identical to SEQ ID NO: 6246
  Description of Artificial Sequence: Synthetic polypeptide
  VH of XENP018860

SEQ ID NO: 9520 - protein, 107 aa, Artificial Sequence
  Description of Artificial Sequence: Synthetic polypeptide
  VL of XENP018860
SIVMTQSPATLSVSPGERATLSCRASQSVSNDVAWYQQKPGQSPRLLINYASHRYTGVPDRFTGSGYGTEFTLTISSLQSEDFAVYFCQQGYSSPRTFGGGTKVEIK

SEQ ID NO: 9521 - protein, 5 aa, Artificial Sequence
  Description of Artificial Sequence: Synthetic peptide
  XENP018860 vhCDR1
NYWMN

SEQ ID NO: 9522 - protein, 19 aa, Artificial Sequence
  Description of Artificial Sequence: Synthetic peptide
  XENP018860 vhCDR2
EIRLKSNNYATHYAEPVKG

SEQ ID NO: 9523 - protein, 11 aa, Artificial Sequence
  Description of Artificial Sequence: Synthetic peptide
  XENP018860 vhCDR3
YYGNYGGYFDV

SEQ ID NO: 9524 - protein, 11 aa, Artificial Sequence
  Description of Artificial Sequence: Synthetic peptide
  XENP018860 vlCDR1
RASQSVSNDVA

SEQ ID NO: 9525 - protein, 7 aa, Artificial Sequence
  Description of Artificial Sequence: Synthetic peptide
  XENP018860 vlCDR2
YASHRYT

SEQ ID NO: 9526 - protein, 9 aa, Artificial Sequence
  Description of Artificial Sequence: Synthetic peptide
  XENP018860 vlCDR3
QQGYSSPRT

SEQ ID NO: 9527 - protein, 249 aa, Artificial Sequence
  Description of Artificial Sequence: Synthetic polypeptide
  XENP018861 1G6_H1_L1.115_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQYYSSPRTFGGGTKVEIK

SEQ ID NO: 9528 - protein, 122 aa, Artificial Sequence; identical to SEQ ID NO: 6246
  Description of Artificial Sequence: Synthetic polypeptide
  VH of XENP018861

SEQ ID NO: 9529 - protein, 107 aa, Artificial Sequence
  Description of Artificial Sequence: Synthetic polypeptide
  VL of XENP018861
SIVMTQSPATLSVSPGERATLSCRASQSVSNDVAWYQQKPGQSPRLLINYASHRYTGVPDRFTGSGYGTEFTLTISSLQSEDFAVYFCQQYYSSPRTFGGGTKVEIK

SEQ ID NO: 9530 - protein, 5 aa, Artificial Sequence
  Description of Artificial Sequence: Synthetic peptide
  XENP018861 vhCDR1
NYWMN

SEQ ID NO: 9531 - protein, 19 aa, Artificial Sequence
  Description of Artificial Sequence: Synthetic peptide
  XENP018861 vhCDR2
EIRLKSNNYATHYAEPVKG

SEQ ID NO: 9532 - protein, 11 aa, Artificial Sequence
  Description of Artificial Sequence: Synthetic peptide
  XENP018861 vhCDR3
YYGNYGGYFDV

SEQ ID NO: 9533 - protein, 11 aa, Artificial Sequence
  Description of Artificial Sequence: Synthetic peptide
  XENP018861 vlCDR1
RASQSVSNDVA

SEQ ID NO: 9534 - protein, 7 aa, Artificial Sequence
  Description of Artificial Sequence: Synthetic peptide
  XENP018861 vlCDR2
YASHRYT

SEQ ID NO: 9535 - protein, 9 aa, Artificial Sequence
  Description of Artificial Sequence: Synthetic peptide
  XENP018861 vlCDR3
QQYYSSPRT

SEQ ID NO: 9536 - protein, 249 aa, Artificial Sequence
  Description of Artificial Sequence: Synthetic polypeptide
  XENP018862 1G6_H1_L1.116_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDFSSPRTFGGGTKVEIK

SEQ ID NO: 9537 - protein, 122 aa, Artificial Sequence; identical to SEQ ID NO: 6246
  Description of Artificial Sequence: Synthetic polypeptide
  VH of XENP018862

SEQ ID NO: 9538 - protein, 107 aa, Artificial Sequence
  Description of Artificial Sequence: Synthetic polypeptide
  VL of XENP018862
SIVMTQSPATLSVSPGERATLSCRASQSVSNDVAWYQQKPGQSPRLLINYASHRYTGVPDRFTGSGYGTEFTLTISSLQSEDFAVYFCQQDFSSPRTFGGGTKVEIK

SEQ ID NO: 9539 - protein, 5 aa, Artificial Sequence
  Description of Artificial Sequence: Synthetic peptide
  XENP018862 vhCDR1
NYWMN

SEQ ID NO: 9540 - protein, 19 aa, Artificial Sequence
  Description of Artificial Sequence: Synthetic peptide
  XENP018862 vhCDR2
EIRLKSNNYATHYAEPVKG

SEQ ID NO: 9541 - protein, 11 aa, Artificial Sequence
  Description of Artificial Sequence: Synthetic peptide
  XENP018862 vhCDR3
YYGNYGGYFDV

SEQ ID NO: 9542 - protein, 11 aa, Artificial Sequence
  Description of Artificial Sequence: Synthetic peptide
  XENP018862 vlCDR1
RASQSVSNDVA

SEQ ID NO: 9543 - protein, 7 aa, Artificial Sequence
  Description of Artificial Sequence: Synthetic peptide
  XENP018862 vlCDR2
YASHRYT

SEQ ID NO: 9544 - protein, 9 aa, Artificial Sequence
  Description of Artificial Sequence: Synthetic peptide
  XENP018862 vlCDR3
QQDFSSPRT

SEQ ID NO: 9545 - protein, 249 aa, Artificial Sequence
  Description of Artificial Sequence: Synthetic polypeptide
  XENP018863 1G6_H1_L1.117_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDHSSPRTFGGGTKVEIK

SEQ ID NO: 9546 - protein, 122 aa, Artificial Sequence; identical to SEQ ID NO: 6246
  Description of Artificial Sequence: Synthetic polypeptide
  VH of XENP018863

SEQ ID NO: 9547 - protein, 107 aa, Artificial Sequence
  Description of Artificial Sequence: Synthetic polypeptide
  VL of XENP018863
SIVMTQSPATLSVSPGERATLSCRASQSVSNDVAWYQQKPGQSPRLLINYASHRYTGVPDRFTGSGYGTEFTLTISSLQSEDFAVYFCQQDHSSPRTFGGGTKVEIK

SEQ ID NO: 9548 - protein, 5 aa, Artificial Sequence
  Description of Artificial Sequence: Synthetic peptide
  XENP018863 vhCDR1
NYWMN

SEQ ID NO: 9549 - protein, 19 aa, Artificial Sequence
  Description of Artificial Sequence: Synthetic peptide
  XENP018863 vhCDR2
EIRLKSNNYATHYAEPVKG

SEQ ID NO: 9550 - protein, 11 aa, Artificial Sequence
  Description of Artificial Sequence: Synthetic peptide
  XENP018863 vhCDR3
YYGNYGGYFDV

SEQ ID NO: 9551 - protein, 11 aa, Artificial Sequence
  Description of Artificial Sequence: Synthetic peptide
  XENP018863 vlCDR1
RASQSVSNDVA

SEQ ID NO: 9552 - protein, 7 aa, Artificial Sequence
  Description of Artificial Sequence: Synthetic peptide
  XENP018863 vlCDR2
YASHRYT

SEQ ID NO: 9553 - protein, 9 aa, Artificial Sequence
  Description of Artificial Sequence: Synthetic peptide
  XENP018863 vlCDR3
QQDHSSPRT

SEQ ID NO: 9554 - protein, 249 aa, Artificial Sequence
  Description of Artificial Sequence: Synthetic polypeptide
  XENP018864 1G6_H1_L1.118_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDLSSPRTFGGGTKVEIK

SEQ ID NO: 9555 - protein, 122 aa, Artificial Sequence; identical to SEQ ID NO: 6246
  Description of Artificial Sequence: Synthetic polypeptide
  VH of XENP018864

SEQ ID NO: 9556 - protein, 107 aa, Artificial Sequence
  Description of Artificial Sequence: Synthetic polypeptide
  VL of XENP018864
SIVMTQSPATLSVSPGERATLSCRASQSVSNDVAWYQQKPGQSPRLLINYASHRYTGVPDRFTGSGYGTEFTLTISSLQSEDFAVYFCQQDLSSPRTFGGGTKVEIK

SEQ ID NO: 9557 - protein, 5 aa, Artificial Sequence
  Description of Artificial Sequence: Synthetic peptide
  XENP018864 vhCDR1
NYWMN

SEQ ID NO: 9558 - protein, 19 aa, Artificial Sequence
  Description of Artificial Sequence: Synthetic peptide
  XENP018864 vhCDR2
EIRLKSNNYATHYAEPVKG

SEQ ID NO: 9559 - protein, 11 aa, Artificial Sequence
  Description of Artificial Sequence: Synthetic peptide
  XENP018864 vhCDR3
YYGNYGGYFDV

SEQ ID NO: 9560 - protein, 11 aa, Artificial Sequence
  Description of Artificial Sequence: Synthetic peptide
  XENP018864 vlCDR1
RASQSVSNDVA

SEQ ID NO: 9561 - protein, 7 aa, Artificial Sequence
  Description of Artificial Sequence: Synthetic peptide
  XENP018864 vlCDR2
YASHRYT

SEQ ID NO: 9562 - protein, 9 aa, Artificial Sequence
  Description of Artificial Sequence: Synthetic peptide
  XENP018864 vlCDR3
QQDLSSPRT

SEQ ID NO: 9563 - protein, 249 aa, Artificial Sequence
  Description of Artificial Sequence: Synthetic polypeptide
  XENP018865 1G6_H1_L1.119_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDWSSPRTFGGGTKVEIK

SEQ ID NO: 9564 - protein, 122 aa, Artificial Sequence; identical to SEQ ID NO: 6246
  Description of Artificial Sequence: Synthetic polypeptide
  VH of XENP018865

SEQ ID NO: 9565 - protein, 107 aa, Artificial Sequence
  Description of Artificial Sequence: Synthetic polypeptide
  VL of XENP018865
SIVMTQSPATLSVSPGERATLSCRASQSVSNDVAWYQQKPGQSPRLLINYASHRYTGVPDRFTGSGYGTEFTLTISSLQSEDFAVYFCQQDWSSPRTFGGGTKVEIK

SEQ ID NO: 9566 - protein, 5 aa, Artificial Sequence
  Description of Artificial Sequence: Synthetic peptide
  XENP018865 vhCDR1
NYWMN

SEQ ID NO: 9567 - protein, 19 aa, Artificial Sequence
  Description of Artificial Sequence: Synthetic peptide
  XENP018865 vhCDR2
EIRLKSNNYATHYAEPVKG

SEQ ID NO: 9568 - protein, 11 aa, Artificial Sequence
  Description of Artificial Sequence: Synthetic peptide
  XENP018865 vhCDR3
YYGNYGGYFDV

SEQ ID NO: 9569 - protein, 11 aa, Artificial Sequence
  Description of Artificial Sequence: Synthetic peptide
  XENP018865 vlCDR1
RASQSVSNDVA

SEQ ID NO: 9570 - protein, 7 aa, Artificial Sequence
  Description of Artificial Sequence: Synthetic peptide
  XENP018865 vlCDR2
YASHRYT

SEQ ID NO: 9571 - protein, 9 aa, Artificial Sequence
  Description of Artificial Sequence: Synthetic peptide
  XENP018865 vlCDR3
QQDWSSPRT

SEQ ID NO: 9572 - protein, 249 aa, Artificial Sequence
  Description of Artificial Sequence: Synthetic polypeptide
  XENP018866 1G6_H1_L1.120_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDVSSPRTFGGGTKVEIK

SEQ ID NO: 9573 - protein, 122 aa, Artificial Sequence; identical to SEQ ID NO: 6246
  Description of Artificial Sequence: Synthetic polypeptide
  VH of XENP018866

SEQ ID NO: 9574 - protein, 107 aa, Artificial Sequence
  Description of Artificial Sequence: Synthetic polypeptide
  VL of XENP018866
SIVMTQSPATLSVSPGERATLSCRASQSVSNDVAWYQQKPGQSPRLLINYASHRYTGVPDRFTGSGYGTEFTLTISSLQSEDFAVYFCQQDVSSPRTFGGGTKVEIK

SEQ ID NO: 9575 - protein, 5 aa, Artificial Sequence
  Description of Artificial Sequence: Synthetic peptide
  XENP018866 vhCDR1
NYWMN

SEQ ID NO: 9576 - protein, 19 aa, Artificial Sequence
  Description of Artificial Sequence: Synthetic peptide
  XENP018866 vhCDR2
EIRLKSNNYATHYAEPVKG

SEQ ID NO: 9577 - protein, 11 aa, Artificial Sequence
  Description of Artificial Sequence: Synthetic peptide
  XENP018866 vhCDR3
YYGNYGGYFDV

SEQ ID NO: 9578 - protein, 11 aa, Artificial Sequence
  Description of Artificial Sequence: Synthetic peptide
  XENP018866 vlCDR1
RASQSVSNDVA

SEQ ID NO: 9579 - protein, 7 aa, Artificial Sequence
  Description of Artificial Sequence: Synthetic peptide
  XENP018866 vlCDR2
YASHRYT

SEQ ID NO: 9580 - protein, 9 aa, Artificial Sequence
  Description of Artificial Sequence: Synthetic peptide
  XENP018866 vlCDR3
QQDVSSPRT

SEQ ID NO: 9581 - protein, 249 aa, Artificial Sequence
  Description of Artificial Sequence: Synthetic polypeptide
  XENP018867 1G6_H1_L1.121_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDASSPRTFGGGTKVEIK

SEQ ID NO: 9582 - protein, 122 aa, Artificial Sequence; identical to SEQ ID NO: 6246
  Description of Artificial Sequence: Synthetic polypeptide
  VH of XENP018867

SEQ ID NO: 9583 - protein, 107 aa, Artificial Sequence
  Description of Artificial Sequence: Synthetic polypeptide
  VL of XENP018867
SIVMTQSPATLSVSPGERATLSCRASQSVSNDVAWYQQKPGQSPRLLINYASHRYTGVPDRFTGSGYGTEFTLTISSLQSEDFAVYFCQQDASSPRTFGGGTKVEIK

SEQ ID NO: 9584 - protein, 5 aa, Artificial Sequence
  Description of Artificial Sequence: Synthetic peptide
  XENP018867 vhCDR1
NYWMN

SEQ ID NO: 9585 - protein, 19 aa, Artificial Sequence
  Description of Artificial Sequence: Synthetic peptide
  XENP018867 vhCDR2
EIRLKSNNYATHYAEPVKG

SEQ ID NO: 9586 - protein, 11 aa, Artificial Sequence
  Description of Artificial Sequence: Synthetic peptide
  XENP018867 vhCDR3
YYGNYGGYFDV

SEQ ID NO: 9587 - protein, 11 aa, Artificial Sequence
  Description of Artificial Sequence: Synthetic peptide
  XENP018867 vlCDR1
RASQSVSNDVA

SEQ ID NO: 9588 - protein, 7 aa, Artificial Sequence
  Description of Artificial Sequence: Synthetic peptide
  XENP018867 vlCDR2
YASHRYT

SEQ ID NO: 9589 - protein, 9 aa, Artificial Sequence
  Description of Artificial Sequence: Synthetic peptide
  XENP018867 vlCDR3
QQDASSPRT

SEQ ID NO: 9590 - protein, 249 aa, Artificial Sequence
  Description of Artificial Sequence: Synthetic polypeptide
  XENP018868 1G6_H1_L1.122_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDQSSPRTFGGGTKVEIK

SEQ ID NO: 9591 - protein, 122 aa, Artificial Sequence; identical to SEQ ID NO: 6246
  Description of Artificial Sequence: Synthetic polypeptide
  VH of XENP018868

SEQ ID NO: 9592 - protein, 107 aa, Artificial Sequence
  Description of Artificial Sequence: Synthetic polypeptide
  VL of XENP018868
SIVMTQSPATLSVSPGERATLSCRASQSVSNDVAWYQQKPGQSPRLLINYASHRYTGVPDRFTGSGYGTEFTLTISSLQSEDFAVYFCQQDQSSPRTFGGGTKVEIK

SEQ ID NO: 9593 - protein, 5 aa, Artificial Sequence
  Description of Artificial Sequence: Synthetic peptide
  XENP018868 vhCDR1
NYWMN

SEQ ID NO: 9594 - protein, 19 aa, Artificial Sequence
  Description of Artificial Sequence: Synthetic peptide
  XENP018868 vhCDR2
EIRLKSNNYATHYAEPVKG

SEQ ID NO: 9595 - protein, 11 aa, Artificial Sequence
  Description of Artificial Sequence: Synthetic peptide
  XENP018868 vhCDR3
YYGNYGGYFDV

SEQ ID NO: 9596 - protein, 11 aa, Artificial Sequence
  Description of Artificial Sequence: Synthetic peptide
  XENP018868 vlCDR1
RASQSVSNDVA

SEQ ID NO: 9597 - protein, 7 aa, Artificial Sequence
  Description of Artificial Sequence: Synthetic peptide
  XENP018868 vlCDR2
YASHRYT

SEQ ID NO: 9598 - protein, 9 aa, Artificial Sequence
  Description of Artificial Sequence: Synthetic peptide
  XENP018868 vlCDR3
QQDQSSPRT

SEQ ID NO: 9599 - protein, 249 aa, Artificial Sequence
  Description of Artificial Sequence: Synthetic polypeptide
  XENP018869 1G6_H1_L1.123_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDDSSPRTFGGGTKVEIK

SEQ ID NO: 9600 - protein, 122 aa, Artificial Sequence; identical to SEQ ID NO: 6246
  Description of Artificial Sequence: Synthetic polypeptide
  VH of XENP018869

SEQ ID NO: 9601 - protein, 107 aa, Artificial Sequence
  Description of Artificial Sequence: Synthetic polypeptide
  VL of XENP018869
SIVMTQSPATLSVSPGERATLSCRASQSVSNDVAWYQQKPGQSPRLLINYASHRYTGVPDRFTGSGYGTEFTLTISSLQSEDFAVYFCQQDDSSPRTFGGGTKVEIK

SEQ ID NO: 9602 - protein, 5 aa, Artificial Sequence
  Description of Artificial Sequence: Synthetic peptide
  XENP018869 vhCDR1
NYWMN

SEQ ID NO: 9603 - protein, 19 aa, Artificial Sequence
  Description of Artificial Sequence: Synthetic peptide
  XENP018869 vhCDR2
EIRLKSNNYATHYAEPVKG

SEQ ID NO: 9604 - protein, 11 aa, Artificial Sequence
  Description of Artificial Sequence: Synthetic peptide
  XENP018869 vhCDR3
YYGNYGGYFDV

SEQ ID NO: 9605 - protein, 11 aa, Artificial Sequence
  Description of Artificial Sequence: Synthetic peptide
  XENP018869 vlCDR1
RASQSVSNDVA

SEQ ID NO: 9606 - protein, 7 aa, Artificial Sequence
  Description of Artificial Sequence: Synthetic peptide
  XENP018869 vlCDR2
YASHRYT

SEQ ID NO: 9607 - protein, 9 aa, Artificial Sequence
  Description of Artificial Sequence: Synthetic peptide
  XENP018869 vlCDR3
QQDDSSPRT

SEQ ID NO: 9608 - protein, 249 aa, Artificial Sequence
  Description of Artificial Sequence: Synthetic polypeptide
  XENP018870 1G6_H1_L1.124_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDKSSPRTFGGGTKVEIK

SEQ ID NO: 9609 - protein, 122 aa, Artificial Sequence; identical to SEQ ID NO: 6246
  Description of Artificial Sequence: Synthetic polypeptide
  VH of XENP018870

SEQ ID NO: 9610 - protein, 107 aa, Artificial Sequence
  Description of Artificial Sequence: Synthetic polypeptide
  VL of XENP018870
SIVMTQSPATLSVSPGERATLSCRASQSVSNDVAWYQQKPGQSPRLLINYASHRYTGVPDRFTGSGYGTEFTLTISSLQSEDFAVYFCQQDKSSPRTFGGGTKVEIK

SEQ ID NO: 9611 - protein, 5 aa, Artificial Sequence
  Description of Artificial Sequence: Synthetic peptide
  XENP018870 vhCDR1
NYWMN

SEQ ID NO: 9612 - protein, 19 aa, Artificial Sequence
  Description of Artificial Sequence: Synthetic peptide
  XENP018870 vhCDR2
EIRLKSNNYATHYAEPVKG

SEQ ID NO: 9613 - protein, 11 aa, Artificial Sequence
  Description of Artificial Sequence: Synthetic peptide
  XENP018870 vhCDR3
YYGNYGGYFDV

SEQ ID NO: 9614 - protein, 11 aa, Artificial Sequence
  Description of Artificial Sequence: Synthetic peptide
  XENP018870 vlCDR1
RASQSVSNDVA

SEQ ID NO: 9615 - protein, 7 aa, Artificial Sequence
  Description of Artificial Sequence: Synthetic peptide
  XENP018870 vlCDR2
YASHRYT

SEQ ID NO: 9616 - protein, 9 aa, Artificial Sequence
  Description of Artificial Sequence: Synthetic peptide
  XENP018870 vlCDR3
QQDKSSPRT

SEQ ID NO: 9617 - protein, 249 aa, Artificial Sequence
  Description of Artificial Sequence: Synthetic polypeptide
  XENP018871 1G6_H1_L1.125_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDSSSPRTFGGGTKVEIK

SEQ ID NO: 9618 - protein, 122 aa, Artificial Sequence; identical to SEQ ID NO: 6246
  Description of Artificial Sequence: Synthetic polypeptide
  VH of XENP018871

SEQ ID NO: 9619 - protein, 107 aa, Artificial Sequence
  Description of Artificial Sequence: Synthetic polypeptide
  VL of XENP018871
SIVMTQSPATLSVSPGERATLSCRASQSVSNDVAWYQQKPGQSPRLLINYASHRYTGVPDRFTGSGYGTEFTLTISSLQSEDFAVYFCQQDSSSPRTFGGGTKVEIK

SEQ ID NO: 9620 - protein, 5 aa, Artificial Sequence
  Description of Artificial Sequence: Synthetic peptide
  XENP018871 vhCDR1
NYWMN

SEQ ID NO: 9621 - protein, 19 aa, Artificial Sequence
  Description of Artificial Sequence: Synthetic peptide
  XENP018871 vhCDR2
EIRLKSNNYATHYAEPVKG

SEQ ID NO: 9622 - protein, 11 aa, Artificial Sequence
  Description of Artificial Sequence: Synthetic peptide
  XENP018871 vhCDR3
YYGNYGGYFDV

SEQ ID NO: 9623 - protein, 11 aa, Artificial Sequence
  Description of Artificial Sequence: Synthetic peptide
  XENP018871 vlCDR1
RASQSVSNDVA

SEQ ID NO: 9624 - protein, 7 aa, Artificial Sequence
  Description of Artificial Sequence: Synthetic peptide
  XENP018871 vlCDR2
YASHRYT

SEQ ID NO: 9625 - protein, 9 aa, Artificial Sequence
  Description of Artificial Sequence: Synthetic peptide
  XENP018871 vlCDR3
QQDSSSPRT

SEQ ID NO: 9626 - protein, 249 aa, Artificial Sequence
  Description of Artificial Sequence: Synthetic polypeptide
  XENP018872 1G6_H1_L1.126_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDGSSPRTFGGGTKVEIK

SEQ ID NO: 9627 - protein, 122 aa, Artificial Sequence; identical to SEQ ID NO: 6246
  Description of Artificial Sequence: Synthetic polypeptide
  VH of XENP018872

SEQ ID NO: 9628 - protein, 107 aa, Artificial Sequence
  Description of Artificial Sequence: Synthetic polypeptide
  VL of XENP018872
SIVMTQSPATLSVSPGERATLSCRASQSVSNDVAWYQQKPGQSPRLLINYASHRYTGVPDRFTGSGYGTEFTLTISSLQSEDFAVYFCQQDGSSPRTFGGGTKVEIK

SEQ ID NO: 9629 - protein, 5 aa, Artificial Sequence
  Description of Artificial Sequence: Synthetic peptide
  XENP018872 vhCDR1
NYWMN

SEQ ID NO: 9630 - protein, 19 aa, Artificial Sequence
  Description of Artificial Sequence: Synthetic peptide
  XENP018872 vhCDR2
EIRLKSNNYATHYAEPVKG

SEQ ID NO: 9631 - protein, 11 aa, Artificial Sequence
  Description of Artificial Sequence: Synthetic peptide
  XENP018872 vhCDR3
YYGNYGGYFDV

SEQ ID NO: 9632 - protein, 11 aa, Artificial Sequence
  Description of Artificial Sequence: Synthetic peptide
  XENP018872 vlCDR1
RASQSVSNDVA

SEQ ID NO: 9633 - protein, 7 aa, Artificial Sequence
  Description of Artificial Sequence: Synthetic peptide
  XENP018872 vlCDR2
YASHRYT

SEQ ID NO: 9634 - protein, 9 aa, Artificial Sequence
  Description of Artificial Sequence: Synthetic peptide
  XENP018872 vlCDR3
QQDGSSPRT

SEQ ID NO: 9635 - protein, 249 aa, Artificial Sequence
  Description of Artificial Sequence: Synthetic polypeptide
  XENP018873 1G6_H1_L1.127_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYTSPRTFGGGTKVEIK

SEQ ID NO: 9636 - protein, 122 aa, Artificial Sequence; identical to SEQ ID NO: 6246
  Description of Artificial Sequence: Synthetic polypeptide
  VH of XENP018873

SEQ ID NO: 9637 - protein, 107 aa, Artificial Sequence
  Description of Artificial Sequence: Synthetic polypeptide
  VL of XENP018873
SIVMTQSPATLSVSPGERATLSCRASQSVSNDVAWYQQKPGQSPRLLINYASHRYTGVPDRFTGSGYGTEFTLTISSLQSEDFAVYFCQQDYTSPRTFGGGTKVEIK

SEQ ID NO: 9638 - protein, 5 aa, Artificial Sequence
  Description of Artificial Sequence: Synthetic peptide
  XENP018873 vhCDR1
NYWMN

SEQ ID NO: 9639 - protein, 19 aa, Artificial Sequence
  Description of Artificial Sequence: Synthetic peptide
  XENP018873 vhCDR2
EIRLKSNNYATHYAEPVKG

SEQ ID NO: 9640 - protein, 11 aa, Artificial Sequence
  Description of Artificial Sequence: Synthetic peptide
  XENP018873 vhCDR3
YYGNYGGYFDV

SEQ ID NO: 9641 - protein, 11 aa, Artificial Sequence
  Description of Artificial Sequence: Synthetic peptide
  XENP018873 vlCDR1
RASQSVSNDVA

SEQ ID NO: 9642 - protein, 7 aa, Artificial Sequence
  Description of Artificial Sequence: Synthetic peptide
  XENP018873 vlCDR2
YASHRYT

SEQ ID NO: 9643 - protein, 9 aa, Artificial Sequence
  Description of Artificial Sequence: Synthetic peptide
  XENP018873 vlCDR3
QQDYTSPRT

SEQ ID NO: 9644 - protein, 249 aa, Artificial Sequence
  Description of Artificial Sequence: Synthetic polypeptide
  XENP018874 1G6_H1_L1.128_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYASPRTFGGGTKVEIK

SEQ ID NO: 9645 - protein, 122 aa, Artificial Sequence; identical to SEQ ID NO: 6246
  Description of Artificial Sequence: Synthetic polypeptide
  VH of XENP018874

SEQ ID NO: 9646 - protein, 107 aa, Artificial Sequence
  Description of Artificial Sequence: Synthetic polypeptide
  VL of XENP018874
SIVMTQSPATLSVSPGERATLSCRASQSVSNDVAWYQQKPGQSPRLLINYASHRYTGVPDRFTGSGYGTEFTLTISSLQSEDFAVYFCQQDYASPRTFGGGTKVEIK

SEQ ID NO: 9647 - protein, 5 aa, Artificial Sequence
  Description of Artificial Sequence: Synthetic peptide
  XENP018874 vhCDR1
NYWMN

SEQ ID NO: 9648 - protein, 19 aa, Artificial Sequence
  Description of Artificial Sequence: Synthetic peptide
  XENP018874 vhCDR2
EIRLKSNNYATHYAEPVKG

SEQ ID NO: 9649 - protein, 11 aa, Artificial Sequence
  Description of Artificial Sequence: Synthetic peptide
  XENP018874 vhCDR3
YYGNYGGYFDV

SEQ ID NO: 9650 - protein, 11 aa, Artificial Sequence
  Description of Artificial Sequence: Synthetic peptide
  XENP018874 vlCDR1
RASQSVSNDVA

SEQ ID NO: 9651 - protein, 7 aa, Artificial Sequence
  Description of Artificial Sequence: Synthetic peptide
  XENP018874 vlCDR2
YASHRYT

SEQ ID NO: 9652 - protein, 9 aa, Artificial Sequence
  Description of Artificial Sequence: Synthetic peptide
  XENP018874 vlCDR3
QQDYASPRT

SEQ ID NO: 9653 - protein, 249 aa, Artificial Sequence
  Description of Artificial Sequence: Synthetic polypeptide
  XENP018875 1G6_H1_L1.129_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYQSPRTFGGGTKVEIK

SEQ ID NO: 9654 - protein, 122 aa, Artificial Sequence; identical to SEQ ID NO: 6246
  Description of Artificial Sequence: Synthetic polypeptide
  VH of XENP018875

SEQ ID NO: 9655 - protein, 107 aa, Artificial Sequence
  Description of Artificial Sequence: Synthetic polypeptide
  VL of XENP018875
SIVMTQSPATLSVSPGERATLSCRASQSVSNDVAWYQQKPGQSPRLLINYASHRYTGVPDRFTGSGYGTEFTLTISSLQSEDFAVYFCQQDYQSPRTFGGGTKVEIK

SEQ ID NO: 9656 - protein, 5 aa, Artificial Sequence
  Description of Artificial Sequence: Synthetic peptide
  XENP018875 vhCDR1
NYWMN

SEQ ID NO: 9657 - protein, 19 aa, Artificial Sequence
  Description of Artificial Sequence: Synthetic peptide
  XENP018875 vhCDR2
EIRLKSNNYATHYAEPVKG

SEQ ID NO: 9658 - protein, 11 aa, Artificial Sequence
  Description of Artificial Sequence: Synthetic peptide
  XENP018875 vhCDR3
YYGNYGGYFDV

SEQ ID NO: 9659 - protein, 11 aa, Artificial Sequence
  Description of Artificial Sequence: Synthetic peptide
  XENP018875 vlCDR1
RASQSVSNDVA

SEQ ID NO: 9660 - protein, 7 aa, Artificial Sequence
  Description of Artificial Sequence: Synthetic peptide
  XENP018875 vlCDR2
YASHRYT

SEQ ID NO: 9661 - protein, 9 aa, Artificial Sequence
  Description of Artificial Sequence: Synthetic peptide
  XENP018875 vlCDR3
QQDYQSPRT

SEQ ID NO: 9662 - protein, 249 aa, Artificial Sequence
  Description of Artificial Sequence: Synthetic polypeptide
  XENP018876 1G6_H1_L1.130_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYGSPRTFGGGTKVEIK

SEQ ID NO: 9663 - protein, 122 aa, Artificial Sequence; identical to SEQ ID NO: 6246
  Description of Artificial Sequence: Synthetic polypeptide
  VH of XENP018876

SEQ ID NO: 9664 - protein, 107 aa, Artificial Sequence
  Description of Artificial Sequence: Synthetic polypeptide
  VL of XENP018876
SIVMTQSPATLSVSPGERATLSCRASQSVSNDVAWYQQKPGQSPRLLINYASHRYTGVPDRFTGSGYGTEFTLTISSLQSEDFAVYFCQQDYGSPRTFGGGTKVEIK

SEQ ID NO: 9665 - protein, 5 aa, Artificial Sequence
  Description of Artificial Sequence: Synthetic peptide
  XENP018876 vhCDR1
NYWMN

SEQ ID NO: 9666 - protein, 19 aa, Artificial Sequence
  Description of Artificial Sequence: Synthetic peptide
  XENP018876 vhCDR2
EIRLKSNNYATHYAEPVKG

SEQ ID NO: 9667 - protein, 11 aa, Artificial Sequence
  Description of Artificial Sequence: Synthetic peptide
  XENP018876 vhCDR3
YYGNYGGYFDV

SEQ ID NO: 9668 - protein, 11 aa, Artificial Sequence
  Description of Artificial Sequence: Synthetic peptide
  XENP018876 vlCDR1
RASQSVSNDVA

SEQ ID NO: 9669 - protein, 7 aa, Artificial Sequence
  Description of Artificial Sequence: Synthetic peptide
  XENP018876 vlCDR2
YASHRYT

SEQ ID NO: 9670 - protein, 9 aa, Artificial Sequence
  Description of Artificial Sequence: Synthetic peptide
  XENP018876 vlCDR3
QQDYGSPRT

SEQ ID NO: 9671 - protein, 249 aa, Artificial Sequence
  Description of Artificial Sequence: Synthetic polypeptide
  XENP018877 1G6_H1_L1.131_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYVSPRTFGGGTKVEIK

SEQ ID NO: 9672 - protein, 122 aa, Artificial Sequence; identical to SEQ ID NO: 6246
  Description of Artificial Sequence: Synthetic polypeptide
  VH of XENP018877

SEQ ID NO: 9673 - protein, 107 aa, Artificial Sequence
  Description of Artificial Sequence: Synthetic polypeptide
  VL of XENP018877
SIVMTQSPATLSVSPGERATLSCRASQSVSNDVAWYQQKPGQSPRLLINYASHRYTGVPDRFTGSGYGTEFTLTISSLQSEDFAVYFCQQDYVSPRTFGGGTKVEIK

SEQ ID NO: 9674 - protein, 5 aa, Artificial Sequence
  Description of Artificial Sequence: Synthetic peptide
  XENP018877 vhCDR1
NYWMN

SEQ ID NO: 9675 - protein, 19 aa, Artificial Sequence
  Description of Artificial Sequence: Synthetic peptide
  XENP018877 vhCDR2
EIRLKSNNYATHYAEPVKG

SEQ ID NO: 9676 - protein, 11 aa, Artificial Sequence
  Description of Artificial Sequence: Synthetic peptide
  XENP018877 vhCDR3
YYGNYGGYFDV

SEQ ID NO: 9677 - protein, 11 aa, Artificial Sequence
  Description of Artificial Sequence: Synthetic peptide
  XENP018877 vlCDR1
RASQSVSNDVA

SEQ ID NO: 9678 - protein, 7 aa, Artificial Sequence
  Description of Artificial Sequence: Synthetic peptide
  XENP018877 vlCDR2
YASHRYT

SEQ ID NO: 9679 - protein, 9 aa, Artificial Sequence
  Description of Artificial Sequence: Synthetic peptide
  XENP018877 vlCDR3
QQDYVSPRT

SEQ ID NO: 9680 - protein, 249 aa, Artificial Sequence
  Description of Artificial Sequence: Synthetic polypeptide
  XENP018878 1G6_H1_L1.132_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYHSPRTFGGGTKVEIK

SEQ ID NO: 9681 - protein, 122 aa, Artificial Sequence; identical to SEQ ID NO: 6246
  Description of Artificial Sequence: Synthetic polypeptide
  VH of XENP018878

SEQ ID NO: 9682 - protein, 107 aa, Artificial Sequence
  Description of Artificial Sequence: Synthetic polypeptide
  VL of XENP018878
SIVMTQSPATLSVSPGERATLSCRASQSVSNDVAWYQQKPGQSPRLLINYASHRYTGVPDRFTGSGYGTEFTLTISSLQSEDFAVYFCQQDYHSPRTFGGGTKVEIK

SEQ ID NO: 9683 - protein, 5 aa, Artificial Sequence
  Description of Artificial Sequence: Synthetic peptide
  XENP018878 vhCDR1
NYWMN

SEQ ID NO: 9684 - protein, 19 aa, Artificial Sequence
  Description of Artificial Sequence: Synthetic peptide
  XENP018878 vhCDR2
EIRLKSNNYATHYAEPVKG

SEQ ID NO: 9685 - protein, 11 aa, Artificial Sequence
  Description of Artificial Sequence: Synthetic peptide
  XENP018878 vhCDR3
YYGNYGGYFDV

SEQ ID NO: 9686 - protein, 11 aa, Artificial Sequence
  Description of Artificial Sequence: Synthetic peptide
  XENP018878 vlCDR1
RASQSVSNDVA

SEQ ID NO: 9687 - protein, 7 aa, Artificial Sequence
  Description of Artificial Sequence: Synthetic peptide
  XENP018878 vlCDR2
YASHRYT

SEQ ID NO: 9688 - protein, 9 aa, Artificial Sequence
  Description of Artificial Sequence: Synthetic peptide
  XENP018878 vlCDR3
QQDYHSPRT

SEQ ID NO: 9689 - protein, 249 aa, Artificial Sequence
  Description of Artificial Sequence: Synthetic polypeptide
  XENP018879 1G6_H1_L1.133_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYDSPRTFGGGTKVEIK

SEQ ID NO: 9690 - protein, 122 aa, Artificial Sequence; identical to SEQ ID NO: 6246
  Description of Artificial Sequence: Synthetic polypeptide
  VH of XENP018879

SEQ ID NO: 9691 - protein, 107 aa, Artificial Sequence
  Description of Artificial Sequence: Synthetic polypeptide
  VL of XENP018879
SIVMTQSPATLSVSPGERATLSCRASQSVSNDVAWYQQKPGQSPRLLINYASHRYTGVPDRFTGSGYGTEFTLTISSLQSEDFAVYFCQQDYDSPRTFGGGTKVEIK

SEQ ID NO: 9692 - protein, 5 aa, Artificial Sequence
  Description of Artificial Sequence: Synthetic peptide
  XENP018879 vhCDR1
NYWMN

SEQ ID NO: 9693 - protein, 19 aa, Artificial Sequence
  Description of Artificial Sequence: Synthetic peptide
  XENP018879 vhCDR2
EIRLKSNNYATHYAEPVKG

SEQ ID NO: 9694 - protein, 11 aa, Artificial Sequence
  Description of Artificial Sequence: Synthetic peptide
  XENP018879 vhCDR3
YYGNYGGYFDV

SEQ ID NO: 9695 - protein, 11 aa, Artificial Sequence
  Description of Artificial Sequence: Synthetic peptide
  XENP018879 vlCDR1
RASQSVSNDVA

SEQ ID NO: 9696 - protein, 7 aa, Artificial Sequence
  Description of Artificial Sequence: Synthetic peptide
  XENP018879 vlCDR2
YASHRYT

SEQ ID NO: 9697 - protein, 9 aa, Artificial Sequence
  Description of Artificial Sequence: Synthetic peptide
  XENP018879 vlCDR3
QQDYDSPRT

SEQ ID NO: 9698 - protein, 249 aa, Artificial Sequence
  Description of Artificial Sequence: Synthetic polypeptide
  XENP018880 1G6_H1_L1.134_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYKSPRTFGGGTKVEIK

SEQ ID NO: 9699 - protein, 122 aa, Artificial Sequence; identical to SEQ ID NO: 6246
  Description of Artificial Sequence: Synthetic polypeptide
  VH of XENP018880

SEQ ID NO: 9700 - protein, 107 aa, Artificial Sequence
  Description of Artificial Sequence: Synthetic polypeptide
  VL of XENP018880
SIVMTQSPATLSVSPGERATLSCRASQSVSNDVAWYQQKPGQSPRLLINYASHRYTGVPDRFTGSGYGTEFTLTISSLQSEDFAVYFCQQDYKSPRTFGGGTKVEIK

SEQ ID NO: 9701 - protein, 5 aa, Artificial Sequence
  Description of Artificial Sequence: Synthetic peptide
  XENP018880 vhCDR1
NYWMN

SEQ ID NO: 9702 - protein, 19 aa, Artificial Sequence
  Description of Artificial Sequence: Synthetic peptide
  XENP018880 vhCDR2
EIRLKSNNYATHYAEPVKG

SEQ ID NO: 9703 - protein, 11 aa, Artificial Sequence
  Description of Artificial Sequence: Synthetic peptide
  XENP018880 vhCDR3
YYGNYGGYFDV

SEQ ID NO: 9704 - protein, 11 aa, Artificial Sequence
  Description of Artificial Sequence: Synthetic peptide
  XENP018880 vlCDR1
RASQSVSNDVA

SEQ ID NO: 9705 - protein, 7 aa, Artificial Sequence
  Description of Artificial Sequence: Synthetic peptide
  XENP018880 vlCDR2
YASHRYT

SEQ ID NO: 9706 - protein, 9 aa, Artificial Sequence
  Description of Artificial Sequence: Synthetic peptide
  XENP018880 vlCDR3
QQDYKSPRT

SEQ ID NO: 9707 - protein, 249 aa, Artificial Sequence
  Description of Artificial Sequence: Synthetic polypeptide
  XENP018881 1G6_H1_L1.135_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYFSPRTFGGGTKVEIK

SEQ ID NO: 9708 - protein, 122 aa, Artificial Sequence; identical to SEQ ID NO: 6246
  Description of Artificial Sequence: Synthetic polypeptide
  VH of XENP018881

SEQ ID NO: 9709 - protein, 107 aa, Artificial Sequence
  Description of Artificial Sequence: Synthetic polypeptide
  VL of XENP018881
SIVMTQSPATLSVSPGERATLSCRASQSVSNDVAWYQQKPGQSPRLLINYASHRYTGVPDRFTGSGYGTEFTLTISSLQSEDFAVYFCQQDYFSPRTFGGGTKVEIK

SEQ ID NO: 9710 - protein, 5 aa, Artificial Sequence
  Description of Artificial Sequence: Synthetic peptide
  XENP018881 vhCDR1
NYWMN

SEQ ID NO: 9711 - protein, 19 aa, Artificial Sequence
  Description of Artificial Sequence: Synthetic peptide
  XENP018881 vhCDR2
EIRLKSNNYATHYAEPVKG

SEQ ID NO: 9712 - protein, 11 aa, Artificial Sequence
  Description of Artificial Sequence: Synthetic peptide
  XENP018881 vhCDR3
YYGNYGGYFDV

SEQ ID NO: 9713 - protein, 11 aa, Artificial Sequence
  Description of Artificial Sequence: Synthetic peptide
  XENP018881 vlCDR1
RASQSVSNDVA

SEQ ID NO: 9714 - protein, 7 aa, Artificial Sequence
  Description of Artificial Sequence: Synthetic peptide
  XENP018881 vlCDR2
YASHRYT

SEQ ID NO: 9715 - protein, 9 aa, Artificial Sequence
  Description of Artificial Sequence: Synthetic peptide
  XENP018881 vlCDR3
QQDYFSPRT

SEQ ID NO: 9716 - protein, 249 aa, Artificial Sequence
  Description of Artificial Sequence: Synthetic polypeptide
  XENP018882 1G6_H1_L1.136_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSTPRTFGGGTKVEIK

SEQ ID NO: 9717 - protein, 122 aa, Artificial Sequence; identical to SEQ ID NO: 6246
  Description of Artificial Sequence: Synthetic polypeptide
  VH of XENP018882

SEQ ID NO: 9718 - protein, 107 aa, Artificial Sequence
  Description of Artificial Sequence: Synthetic polypeptide
  VL of XENP018882
SIVMTQSPATLSVSPGERATLSCRASQSVSNDVAWYQQKPGQSPRLLINYASHRYTGVPDRFTGSGYGTEFTLTISSLQSEDFAVYFCQQDYSTPRTFGGGTKVEIK

SEQ ID NO: 9719 - protein, 5 aa, Artificial Sequence
  Description of Artificial Sequence: Synthetic peptide
  XENP018882 vhCDR1
NYWMN

SEQ ID NO: 9720 - protein, 19 aa, Artificial Sequence
  Description of Artificial Sequence: Synthetic peptide
  XENP018882 vhCDR2
EIRLKSNNYATHYAEPVKG

SEQ ID NO: 9721 - protein, 11 aa, Artificial Sequence
  Description of Artificial Sequence: Synthetic peptide
  XENP018882 vhCDR3
YYGNYGGYFDV

SEQ ID NO: 9722 - protein, 11 aa, Artificial Sequence
  Description of Artificial Sequence: Synthetic peptide
  XENP018882 vlCDR1
RASQSVSNDVA

SEQ ID NO: 9723 - protein, 7 aa, Artificial Sequence
  Description of Artificial Sequence: Synthetic peptide
  XENP018882 vlCDR2
YASHRYT

SEQ ID NO: 9724 - protein, 9 aa, Artificial Sequence
  Description of Artificial Sequence: Synthetic peptide
  XENP018882 vlCDR3
QQDYSTPRT

SEQ ID NO: 9725 - protein, 249 aa, Artificial Sequence
  Description of Artificial Sequence: Synthetic polypeptide
  XENP018883 1G6_H1_L1.137_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSAPRTFGGGTKVEIK

SEQ ID NO: 9726 - protein, 122 aa, Artificial Sequence; identical to SEQ ID NO: 6246
  Description of Artificial Sequence: Synthetic polypeptide
  VH of XENP018883

SEQ ID NO: 9727 - protein, 107 aa, Artificial Sequence
  Description of Artificial Sequence: Synthetic polypeptide
  VL of XENP018883
SIVMTQSPATLSVSPGERATLSCRASQSVSNDVAWYQQKPGQSPRLLINYASHRYTGVPDRFTGSGYGTEFTLTISSLQSEDFAVYFCQQDYSAPRTFGGGTKVEIK

SEQ ID NO: 9728 - protein, 5 aa, Artificial Sequence
  Description of Artificial Sequence: Synthetic peptide
  XENP018883 vhCDR1
NYWMN

SEQ ID NO: 9729 - protein, 19 aa, Artificial Sequence
  Description of Artificial Sequence: Synthetic peptide
  XENP018883 vhCDR2
EIRLKSNNYATHYAEPVKG

SEQ ID NO: 9730 - protein, 11 aa, Artificial Sequence
  Description of Artificial Sequence: Synthetic peptide
  XENP018883 vhCDR3
YYGNYGGYFDV

SEQ ID NO: 9731 - protein, 11 aa, Artificial Sequence
  Description of Artificial Sequence: Synthetic peptide
  XENP018883 vlCDR1
RASQSVSNDVA

SEQ ID NO: 9732 - protein, 7 aa, Artificial Sequence
  Description of Artificial Sequence: Synthetic peptide
  XENP018883 vlCDR2
YASHRYT

SEQ ID NO: 9733 - protein, 9 aa, Artificial Sequence
  Description of Artificial Sequence: Synthetic peptide
  XENP018883 vlCDR3
QQDYSAPRT

SEQ ID NO: 9734 - protein, 249 aa, Artificial Sequence
  Description of Artificial Sequence: Synthetic polypeptide
  XENP018884 1G6_H1_L1.138_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSNPRTFGGGTKVEIK

SEQ ID NO: 9735 - protein, 122 aa, Artificial Sequence; identical to SEQ ID NO: 6246
  Description of Artificial Sequence: Synthetic polypeptide
  VH of XENP018884

SEQ ID NO: 9736 - protein, 107 aa, Artificial Sequence
  Description of Artificial Sequence: Synthetic polypeptide
  VL of XENP018884
SIVMTQSPATLSVSPGERATLSCRASQSVSNDVAWYQQKPGQSPRLLINYASHRYTGVPDRFTGSGYGTEFTLTISSLQSEDFAVYFCQQDYSNPRTFGGGTKVEIK

SEQ ID NO: 9737 - protein, 5 aa, Artificial Sequence
  Description of Artificial Sequence: Synthetic peptide
  XENP018884 vhCDR1
NYWMN

SEQ ID NO: 9738 - protein, 19 aa, Artificial Sequence
  Description of Artificial Sequence: Synthetic peptide
  XENP018884 vhCDR2
EIRLKSNNYATHYAEPVKG

SEQ ID NO: 9739 - protein, 11 aa, Artificial Sequence
  Description of Artificial Sequence: Synthetic peptide
  XENP018884 vhCDR3
YYGNYGGYFDV

SEQ ID NO: 9740 - protein, 11 aa, Artificial Sequence
  Description of Artificial Sequence: Synthetic peptide
  XENP018884 vlCDR1
RASQSVSNDVA

SEQ ID NO: 9741 - protein, 7 aa, Artificial Sequence
  Description of Artificial Sequence: Synthetic peptide
  XENP018884 vlCDR2
YASHRYT

SEQ ID NO: 9742 - protein, 9 aa, Artificial Sequence
  Description of Artificial Sequence: Synthetic peptide
  XENP018884 vlCDR3
QQDYSNPRT

SEQ ID NO: 9743 - protein, 249 aa, Artificial Sequence
  Description of Artificial Sequence: Synthetic polypeptide
  XENP018885 1G6_H1_L1.139_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSGPRTFGGGTKVEIK

SEQ ID NO: 9744 - protein, 122 aa, Artificial Sequence; identical to SEQ ID NO: 6246
  Description of Artificial Sequence: Synthetic polypeptide
  VH of XENP018885

SEQ ID NO: 9745 - protein, 107 aa, Artificial Sequence
  Description of Artificial Sequence: Synthetic polypeptide
  VL of XENP018885
SIVMTQSPATLSVSPGERATLSCRASQSVSNDVAWYQQKPGQSPRLLINYASHRYTGVPDRFTGSGYGTEFTLTISSLQSEDFAVYFCQQDYSGPRTFGGGTKVEIK

SEQ ID NO: 9746 - protein, 5 aa, Artificial Sequence
  Description of Artificial Sequence: Synthetic peptide
  XENP018885 vhCDR1
NYWMN

SEQ ID NO: 9747 - protein, 19 aa, Artificial Sequence
  Description of Artificial Sequence: Synthetic peptide
  XENP018885 vhCDR2
EIRLKSNNYATHYAEPVKG

SEQ ID NO: 9748 - protein, 11 aa, Artificial Sequence
  Description of Artificial Sequence: Synthetic peptide
  XENP018885 vhCDR3
YYGNYGGYFDV

SEQ ID NO: 9749 - protein, 11 aa, Artificial Sequence
  Description of Artificial Sequence: Synthetic peptide
  XENP018885 vlCDR1
RASQSVSNDVA

SEQ ID NO: 9750 - protein, 7 aa, Artificial Sequence
  Description of Artificial Sequence: Synthetic peptide
  XENP018885 vlCDR2
YASHRYT

SEQ ID NO: 9751 - protein, 9 aa, Artificial Sequence
  Description of Artificial Sequence: Synthetic peptide
  XENP018885 vlCDR3
QQDYSGPRT

SEQ ID NO: 9752 - protein, 249 aa, Artificial Sequence
  Description of Artificial Sequence: Synthetic polypeptide
  XENP018886 1G6_H1_L1.140_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSVPRTFGGGTKVEIK

SEQ ID NO: 9753 - protein, 122 aa, Artificial Sequence; identical to SEQ ID NO: 6246
  Description of Artificial Sequence: Synthetic polypeptide
  VH of XENP018886

SEQ ID NO: 9754 - protein, 107 aa, Artificial Sequence
  Description of Artificial Sequence: Synthetic polypeptide
  VL of XENP018886
SIVMTQSPATLSVSPGERATLSCRASQSVSNDVAWYQQKPGQSPRLLINYASHRYTGVPDRFTGSGYGTEFTLTISSLQSEDFAVYFCQQDYSVPRTFGGGTKVEIK

SEQ ID NO: 9755 - protein, 5 aa, Artificial Sequence
  Description of Artificial Sequence: Synthetic peptide
  XENP018886 vhCDR1
NYWMN

SEQ ID NO: 9756 - protein, 19 aa, Artificial Sequence
  Description of Artificial Sequence: Synthetic peptide
  XENP018886 vhCDR2
EIRLKSNNYATHYAEPVKG

SEQ ID NO: 9757 - protein, 11 aa, Artificial Sequence
  Description of Artificial Sequence: Synthetic peptide
  XENP018886 vhCDR3
YYGNYGGYFDV

SEQ ID NO: 9758 - protein, 11 aa, Artificial Sequence
  Description of Artificial Sequence: Synthetic peptide
  XENP018886 vlCDR1
RASQSVSNDVA

SEQ ID NO: 9759 - protein, 7 aa, Artificial Sequence
  Description of Artificial Sequence: Synthetic peptide
  XENP018886 vlCDR2
YASHRYT

SEQ ID NO: 9760 - protein, 9 aa, Artificial Sequence
  Description of Artificial Sequence: Synthetic peptide
  XENP018886 vlCDR3
QQDYSVPRT

SEQ ID NO: 9761 - protein, 249 aa, Artificial Sequence
  Description of Artificial Sequence: Synthetic polypeptide
  XENP018887 1G6_H1_L1.141_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSHPRTFGGGTKVEIK

SEQ ID NO: 9762 - protein, 122 aa, Artificial Sequence; identical to SEQ ID NO: 6246
  Description of Artificial Sequence: Synthetic polypeptide
  VH of XENP018887

SEQ ID NO: 9763 - protein, 107 aa, Artificial Sequence
  Description of Artificial Sequence: Synthetic polypeptide
  VL of XENP018887
SIVMTQSPATLSVSPGERATLSCRASQSVSNDVAWYQQKPGQSPRLLINYASHRYTGVPDRFTGSGYGTEFTLTISSLQSEDFAVYFCQQDYSHPRTFGGGTKVEIK

SEQ ID NO: 9764 - protein, 5 aa, Artificial Sequence
  Description of Artificial Sequence: Synthetic peptide
  XENP018887 vhCDR1
NYWMN

SEQ ID NO: 9765 - protein, 19 aa, Artificial Sequence
  Description of Artificial Sequence: Synthetic peptide
  XENP018887 vhCDR2
EIRLKSNNYATHYAEPVKG

SEQ ID NO: 9766 - protein, 11 aa, Artificial Sequence
  Description of Artificial Sequence: Synthetic peptide
  XENP018887 vhCDR3
YYGNYGGYFDV

SEQ ID NO: 9767 - protein, 11 aa, Artificial Sequence
  Description of Artificial Sequence: Synthetic peptide
  XENP018887 vlCDR1
RASQSVSNDVA

SEQ ID NO: 9768 - protein, 7 aa, Artificial Sequence
  Description of Artificial Sequence: Synthetic peptide
  XENP018887 vlCDR2
YASHRYT

SEQ ID NO: 9769 - protein, 9 aa, Artificial Sequence
  Description of Artificial Sequence: Synthetic peptide
  XENP018887 vlCDR3
QQDYSHPRT

SEQ ID NO: 9770 - protein, 249 aa, Artificial Sequence
  Description of Artificial Sequence: Synthetic polypeptide
  XENP018888 1G6_H1_L1.142_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSDPRTFGGGTKVEIK

SEQ ID NO: 9771 - protein, 122 aa, Artificial Sequence; identical to SEQ ID NO: 6246
  Description of Artificial Sequence: Synthetic polypeptide
  VH of XENP018888

SEQ ID NO: 9772 - protein, 107 aa, Artificial Sequence
  Description of Artificial Sequence: Synthetic polypeptide
  VL of XENP018888
SIVMTQSPATLSVSPGERATLSCRASQSVSNDVAWYQQKPGQSPRLLINYASHRYTGVPDRFTGSGYGTEFTLTISSLQSEDFAVYFCQQDYSDPRTFGGGTKVEIK

SEQ ID NO: 9773 - protein, 5 aa, Artificial Sequence
  Description of Artificial Sequence: Synthetic peptide
  XENP018888 vhCDR1
NYWMN

SEQ ID NO: 9774 - protein, 19 aa, Artificial Sequence
  Description of Artificial Sequence: Synthetic peptide
  XENP018888 vhCDR2
EIRLKSNNYATHYAEPVKG

SEQ ID NO: 9775 - protein, 11 aa, Artificial Sequence
  Description of Artificial Sequence: Synthetic peptide
  XENP018888 vhCDR3
YYGNYGGYFDV

SEQ ID NO: 9776 - protein, 11 aa, Artificial Sequence
  Description of Artificial Sequence: Synthetic peptide
  XENP018888 vlCDR1
RASQSVSNDVA

SEQ ID NO: 9777 - protein, 7 aa, Artificial Sequence
  Description of Artificial Sequence: Synthetic peptide
  XENP018888 vlCDR2
YASHRYT

SEQ ID NO: 9778 - protein, 9 aa, Artificial Sequence
  Description of Artificial Sequence: Synthetic peptide
  XENP018888 vlCDR3
QQDYSDPRT

SEQ ID NO: 9779 - protein, 249 aa, Artificial Sequence
  Description of Artificial Sequence: Synthetic polypeptide
  XENP018889 1G6_H1_L1.143_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSKPRTFGGGTKVEIK

SEQ ID NO: 9780 - protein, 122 aa, Artificial Sequence; identical to SEQ ID NO: 6246
  Description of Artificial Sequence: Synthetic polypeptide
  VH of XENP018889

SEQ ID NO: 9781 - protein, 107 aa, Artificial Sequence
  Description of Artificial Sequence: Synthetic polypeptide
  VL of XENP018889
SIVMTQSPATLSVSPGERATLSCRASQSVSNDVAWYQQKPGQSPRLLINYASHRYTGVPDRFTGSGYGTEFTLTISSLQSEDFAVYFCQQDYSKPRTFGGGTKVEIK

SEQ ID NO: 9782 - protein, 5 aa, Artificial Sequence
  Description of Artificial Sequence: Synthetic peptide
  XENP018889 vhCDR1
NYWMN

SEQ ID NO: 9783 - protein, 19 aa, Artificial Sequence
  Description of Artificial Sequence: Synthetic peptide
  XENP018889 vhCDR2
EIRLKSNNYATHYAEPVKG

SEQ ID NO: 9784 - protein, 11 aa, Artificial Sequence
  Description of Artificial Sequence: Synthetic peptide
  XENP018889 vhCDR3
YYGNYGGYFDV

SEQ ID NO: 9785 - protein, 11 aa, Artificial Sequence
  Description of Artificial Sequence: Synthetic peptide
  XENP018889 vlCDR1
RASQSVSNDVA

SEQ ID NO: 9786 - protein, 7 aa, Artificial Sequence
  Description of Artificial Sequence: Synthetic peptide
  XENP018889 vlCDR2
YASHRYT

SEQ ID NO: 9787 - protein, 9 aa, Artificial Sequence
  Description of Artificial Sequence: Synthetic peptide
  XENP018889 vlCDR3
QQDYSKPRT

SEQ ID NO: 9788 - protein, 249 aa, Artificial Sequence
  Description of Artificial Sequence: Synthetic polypeptide
  XENP018890 1G6_H1_L1.144_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSFPRTFGGGTKVEIK

SEQ ID NO: 9789 - protein, 122 aa, Artificial Sequence; identical to SEQ ID NO: 6246
  Description of Artificial Sequence: Synthetic polypeptide
  VH of XENP018890

SEQ ID NO: 9790 - protein, 107 aa, Artificial Sequence
  Description of Artificial Sequence: Synthetic polypeptide
  VL of XENP018890
SIVMTQSPATLSVSPGERATLSCRASQSVSNDVAWYQQKPGQSPRLLINYASHRYTGVPDRFTGSGYGTEFTLTISSLQSEDFAVYFCQQDYSFPRTFGGGTKVEIK

SEQ ID NO: 9791 - protein, 5 aa, Artificial Sequence
  Description of Artificial Sequence: Synthetic peptide
  XENP018890 vhCDR1
NYWMN

SEQ ID NO: 9792 - protein, 19 aa, Artificial Sequence
  Description of Artificial Sequence: Synthetic peptide
  XENP018890 vhCDR2
EIRLKSNNYATHYAEPVKG

SEQ ID NO: 9793 - protein, 11 aa, Artificial Sequence
  Description of Artificial Sequence: Synthetic peptide
  XENP018890 vhCDR3
YYGNYGGYFDV

SEQ ID NO: 9794 - protein, 11 aa, Artificial Sequence
  Description of Artificial Sequence: Synthetic peptide
  XENP018890 vlCDR1
RASQSVSNDVA

SEQ ID NO: 9795 - protein, 7 aa, Artificial Sequence
  Description of Artificial Sequence: Synthetic peptide
  XENP018890 vlCDR2
YASHRYT

SEQ ID NO: 9796 - protein, 9 aa, Artificial Sequence
  Description of Artificial Sequence: Synthetic peptide
  XENP018890 vlCDR3
QQDYSFPRT

SEQ ID NO: 9797 - protein, 249 aa, Artificial Sequence
  Description of Artificial Sequence: Synthetic polypeptide
  XENP018891 1G6_H1_L1.145_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKLEIK

SEQ ID NO: 9798 - protein, 122 aa, Artificial Sequence; identical to SEQ ID NO: 6246
  Description of Artificial Sequence: Synthetic polypeptide
  VH of XENP018891

SEQ ID NO: 9799 - protein, 107 aa, Artificial Sequence
  Description of Artificial Sequence: Synthetic polypeptide
  VL of XENP018891
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKLEIK

SEQ ID NO: 9800 - protein, 5 aa, Artificial Sequence
  Description of Artificial Sequence: Synthetic peptide
  XENP018891 vhCDR1
NYWMN

SEQ ID NO: 9801 - protein, 19 aa, Artificial Sequence
  Description of Artificial Sequence: Synthetic peptide
  XENP018891 vhCDR2
EIRLKSNNYATHYAEPVKG

SEQ ID NO: 9802 - protein, 11 aa, Artificial Sequence
  Description of Artificial Sequence: Synthetic peptide
  XENP018891 vhCDR3
YYGNYGGYFDV

SEQ ID NO: 9803 - protein, 11 aa, Artificial Sequence
  Description of Artificial Sequence: Synthetic peptide
  XENP018891 vlCDR1
RASQSVSNDVA

SEQ ID NO: 9804 - protein, 7 aa, Artificial Sequence
  Description of Artificial Sequence: Synthetic peptide
  XENP018891 vlCDR2
YASHRYT

SEQ ID NO: 9805 - protein, 9 aa, Artificial Sequence
  Description of Artificial Sequence: Synthetic peptide
  XENP018891 vlCDR3
QQDYSSPRT

SEQ ID NO: 9806 - protein, 249 aa, Artificial Sequence
  Description of Artificial Sequence: Synthetic polypeptide
  XENP018895 1G6_H0L0_scFv(GKPGS)4
EVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCTRYYGNYGGYFDVWGAGTTVTVSSGKPGSGKPGSGKPGSGKPGSSIVMTQTPKFLLVSAGDRVTITCKASQSVSNDVAWYQQKPGQSPKLLINYASHRYTGVPDRFTGSGYGTDFTFTISTVQAEDLAVYFCQQDYSSPRTFGGGTKLEIK

SEQ ID NO: 9807 - protein, 122 aa, Artificial Sequence
  Description of Artificial Sequence: Synthetic polypeptide
  VH of XENP018895
EVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCTRYYGNYGGYFDVWGAGTTVTVSS

SEQ ID NO: 9808 - protein, 107 aa, Artificial Sequence
  Description of Artificial Sequence: Synthetic polypeptide
  VL of XENP018895
SIVMTQTPKFLLVSAGDRVTITCKASQSVSNDVAWYQQKPGQSPKLLINYASHRYTGVPDRFTGSGYGTDFTFTISTVQAEDLAVYFCQQDYSSPRTFGGGTKLEIK

SEQ ID NO: 9809 - protein, 5 aa, Artificial Sequence
  Description of Artificial Sequence: Synthetic peptide
  XENP018895 vhCDR1
NYWMN

SEQ ID NO: 9810 - protein, 19 aa, Artificial Sequence
  Description of Artificial Sequence: Synthetic peptide
  XENP018895 vhCDR2
EIRLKSNNYATHYAESVKG

SEQ ID NO: 9811 - protein, 11 aa, Artificial Sequence
  Description of Artificial Sequence: Synthetic peptide
  XENP018895 vhCDR3
YYGNYGGYFDV

SEQ ID NO: 9812 - protein, 11 aa, Artificial Sequence
  Description of Artificial Sequence: Synthetic peptide
  XENP018895 vlCDR1
KASQSVSNDVA

SEQ ID NO: 9813 - protein, 7 aa, Artificial Sequence
  Description of Artificial Sequence: Synthetic peptide
  XENP018895 vlCDR2
YASHRYT

SEQ ID NO: 9814 - protein, 9 aa, Artificial Sequence
  Description of Artificial Sequence: Synthetic peptide
  XENP018895 vlCDR3
QQDYSSPRT

SEQ ID NO: 9815 - protein, 249 aa, Artificial Sequence
  Description of Artificial Sequence: Synthetic polypeptide
  XENP018896 1G6_L1H1_scFv(GKPGS)4
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKGKPGSGKPGSGKPGSGKPGSEVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 9816 - protein, 107 aa, Artificial Sequence; identical to SEQ ID NO: 6247
  Description of Artificial Sequence: Synthetic polypeptide
  VH of XENP018896

SEQ ID NO: 9817 - protein, 122 aa, Artificial Sequence; identical to SEQ ID NO: 6246
  Description of Artificial Sequence: Synthetic polypeptide
  VL of XENP018896

SEQ ID NO: 9818 - protein, 11 aa, Artificial Sequence
  Description of Artificial Sequence: Synthetic peptide
  XENP018896 vhCDR1
RASQSVSNDVA

SEQ ID NO: 9819 - protein, 7 aa, Artificial Sequence
  Description of Artificial Sequence: Synthetic peptide
  XENP018896 vhCDR2
YASHRYT

SEQ ID NO: 9820 - protein, 9 aa, Artificial Sequence
  Description of Artificial Sequence: Synthetic peptide
  XENP018896 vhCDR3
QQDYSSPRT

SEQ ID NO: 9821 - protein, 5 aa, Artificial Sequence
  Description of Artificial Sequence: Synthetic peptide
  XENP018896 vlCDR1
NYWMN

SEQ ID NO: 9822 - protein, 19 aa, Artificial Sequence
  Description of Artificial Sequence: Synthetic peptide
  XENP018896 vlCDR2
EIRLKSNNYATHYAEPVKG

SEQ ID NO: 9823 - protein, 11 aa, Artificial Sequence
  Description of Artificial Sequence: Synthetic peptide
  XENP018896 vlCDR3
YYGNYGGYFDV

SEQ ID NO: 9824 - protein, 244 aa, Artificial Sequence
  Description of Artificial Sequence: Synthetic polypeptide
  XENP018901 6A3_H0L0_scFv(GKPGS)4
EVKLVESGGGLVKPGGSLKLSCAASGFTFSSYGMSWVRQTPEKRLEWVATISGGGRYTYYPDSVKGRFTISRDNAKNNLYLQMSSLRSEDTALYYCASYYDSSFDYWGQGTTLTVSSGKPGSGKPGSGKPGSGKPGSDIVMTQSHKFMSTSVGDRVSITCKASQDVGTAVAWYQQKPGQSPKLLIYWASTRHTGVPDRFTGSGSGTDFTLTISNVQSEDLADYFCQHYSIYPWTFGGGTKLEIK

SEQ ID NO: 9825 - protein, 117 aa, Artificial Sequence
  Description of Artificial Sequence: Synthetic polypeptide
  VH of XENP018901
EVKLVESGGGLVKPGGSLKLSCAASGFTFSSYGMSWVRQTPEKRLEWVATISGGGRYTYYPDSVKGRFTISRDNAKNNLYLQMSSLRSEDTALYYCASYYDSSFDYWGQGTTLTVSS

SEQ ID NO: 9826 - protein, 107 aa, Artificial Sequence
  Description of Artificial Sequence: Synthetic polypeptide
  VL of XENP018901
DIVMTQSHKFMSTSVGDRVSITCKASQDVGTAVAWYQQKPGQSPKLLIYWASTRHTGVPDRFTGSGSGTDFTLTISNVQSEDLADYFCQHYSIYPWTFGGGTKLEIK

SEQ ID NO: 9827 - protein, 5 aa, Artificial Sequence
  Description of Artificial Sequence: Synthetic peptide
  XENP018901 vhCDR1
SYGMS

SEQ ID NO: 9828 - protein, 17 aa, Artificial Sequence
  Description of Artificial Sequence: Synthetic peptide
  XENP018901 vhCDR2
TISGGGRYTYYPDSVKG

SEQ ID NO: 9829 - protein, 8 aa, Artificial Sequence
  Description of Artificial Sequence: Synthetic peptide
  XENP018901 vhCDR3
YYDSSFDY

SEQ ID NO: 9830 - protein, 11 aa, Artificial Sequence
  Description of Artificial Sequence: Synthetic peptide
  XENP018901 vlCDR1
KASQDVGTAVA

SEQ ID NO: 9831 - protein, 7 aa, Artificial Sequence
  Description of Artificial Sequence: Synthetic peptide
  XENP018901 vlCDR2
WASTRHT

SEQ ID NO: 9832 - protein, 9 aa, Artificial Sequence
  Description of Artificial Sequence: Synthetic peptide
  XENP018901 vlCDR3
QHYSIYPWT

SEQ ID NO: 9833 - protein, 244 aa, Artificial Sequence
  Description of Artificial Sequence: Synthetic polypeptide
  XENP018902 6A3_L3_H1.1_scFv(GKPGS)4
DIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIKGKPGSGKPGSGKPGSGKPGSEVQLLESGGGLVQPGGSLRLSCAASGFTFSSYGMSWVRQAPGKGLEWVSTISGGGRYTYYPDSVKGRFTISRDNSKNTLYLQMNSLRAEDTAVYYCASYYDSSFDYWGQGTLVTVSS

SEQ ID NO: 9834 - protein, 107 aa, Artificial Sequence; identical to SEQ ID NO: 6337
  Description of Artificial Sequence: Synthetic polypeptide
  VH of XENP018902

SEQ ID NO: 9835 - protein, 117 aa, Artificial Sequence; identical to SEQ ID NO: 6354
  Description of Artificial Sequence: Synthetic polypeptide
  VL of XENP018902

SEQ ID NO: 9836 - protein, 11 aa, Artificial Sequence
  Description of Artificial Sequence: Synthetic peptide
  XENP018902 vhCDR1
RASQDVGTAVA

SEQ ID NO: 9837 - protein, 7 aa, Artificial Sequence
  Description of Artificial Sequence: Synthetic peptide
  XENP018902 vhCDR2
WASTRHT

SEQ ID NO: 9838 - protein, 9 aa, Artificial Sequence
  Description of Artificial Sequence: Synthetic peptide
  XENP018902 vhCDR3
QHYSIYPWT

SEQ ID NO: 9839 - protein, 5 aa, Artificial Sequence
  Description of Artificial Sequence: Synthetic peptide
  XENP018902 vlCDR1
SYGMS

SEQ ID NO: 9840 - protein, 17 aa, Artificial Sequence
  Description of Artificial Sequence: Synthetic peptide
  XENP018902 vlCDR2
TISGGGRYTYYPDSVKG

SEQ ID NO: 9841 - protein, 9 aa, Artificial Sequence
  Description of Artificial Sequence: Synthetic peptide
  XENP018902 vlCDR3
SYYDSSFDY

SEQ ID NO: 9842 - protein, 249 aa, Artificial Sequence
  Description of Artificial Sequence: Synthetic polypeptide
  XENP018921 1G6_H1L3_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPLSLPVTPGEPASISCRASQSVSNDVAWYLQKPGQSPQLLINYASHRYTGVPDRFTGSGYGTDFTLKISRVEAEDVGVYFCQQDYSSPRTFGGGTKVEIK

SEQ ID NO: 9843 - protein, 122 aa, Artificial Sequence; identical to SEQ ID NO: 6246
  Description of Artificial Sequence: Synthetic polypeptide
  VH of XENP018921

SEQ ID NO: 9844 - protein, 107 aa, Artificial Sequence
  Description of Artificial Sequence: Synthetic polypeptide
  VL of XENP018921
SIVMTQSPLSLPVTPGEPASISCRASQSVSNDVAWYLQKPGQSPQLLINYASHRYTGVPDRFTGSGYGTDFTLKISRVEAEDVGVYFCQQDYSSPRTFGGGTKVEIK

SEQ ID NO: 9845 - protein, 5 aa, Artificial Sequence
  Description of Artificial Sequence: Synthetic peptide
  XENP018921 vhCDR1
NYWMN

SEQ ID NO: 9846 - protein, 19 aa, Artificial Sequence
  Description of Artificial Sequence: Synthetic peptide
  XENP018921 vhCDR2
EIRLKSNNYATHYAEPVKG

SEQ ID NO: 9847 - protein, 11 aa, Artificial Sequence
  Description of Artificial Sequence: Synthetic peptide
  XENP018921 vhCDR3
YYGNYGGYFDV

SEQ ID NO: 9848 - protein, 11 aa, Artificial Sequence
  Description of Artificial Sequence: Synthetic peptide
  XENP018921 vlCDR1
RASQSVSNDVA

SEQ ID NO: 9849 - protein, 7 aa, Artificial Sequence
  Description of Artificial Sequence: Synthetic peptide
  XENP018921 vlCDR2
YASHRYT

SEQ ID NO: 9850 - protein, 9 aa, Artificial Sequence
  Description of Artificial Sequence: Synthetic peptide
  XENP018921 vlCDR3
QQDYSSPRT

SEQ ID NO: 9851 - protein, 249 aa, Artificial Sequence
  Description of Artificial Sequence: Synthetic polypeptide
  XENP018922 1G6_H1L4_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPGTLSLSPGERATLSCRASQSVSNDVAWYQQKPGQSPRLLINYASHRYTGVPDRFTGSGYGTDFTLTISRLEPEDFAVYFCQQDYSSPRTFGGGTKVEIK

SEQ ID NO: 9852 - protein, 122 aa, Artificial Sequence; identical to SEQ ID NO: 6246
  Description of Artificial Sequence: Synthetic polypeptide
  VH of XENP018922

SEQ ID NO: 9853 - protein, 107 aa, Artificial Sequence
  Description of Artificial Sequence: Synthetic polypeptide
  VL of XENP018922
SIVMTQSPGTLSLSPGERATLSCRASQSVSNDVAWYQQKPGQSPRLLINYASHRYTGVPDRFTGSGYGTDFTLTISRLEPEDFAVYFCQQDYSSPRTFGGGTKVEIK

SEQ ID NO: 9854 - protein, 5 aa, Artificial Sequence
  Description of Artificial Sequence: Synthetic peptide
  XENP018922 vhCDR1
NYWMN

SEQ ID NO: 9855 - protein, 19 aa, Artificial Sequence
  Description of Artificial Sequence: Synthetic peptide
  XENP018922 vhCDR2
EIRLKSNNYATHYAEPVKG

SEQ ID NO: 9856 - protein, 11 aa, Artificial Sequence
  Description of Artificial Sequence: Synthetic peptide
  XENP018922 vhCDR3
YYGNYGGYFDV

SEQ ID NO: 9857 - protein, 11 aa, Artificial Sequence
  Description of Artificial Sequence: Synthetic peptide
  XENP018922 vlCDR1
RASQSVSNDVA

SEQ ID NO: 9858 - protein, 7 aa, Artificial Sequence
  Description of Artificial Sequence: Synthetic peptide
  XENP018922 vlCDR2
YASHRYT

SEQ ID NO: 9859 - protein, 9 aa, Artificial Sequence
  Description of Artificial Sequence: Synthetic peptide
  XENP018922 vlCDR3
QQDYSSPRT

SEQ ID NO: 9860 - protein, 249 aa, Artificial Sequence
  Description of Artificial Sequence: Synthetic polypeptide
  XENP018923 1G6_H1L5_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPDSLAVSLGERATINCKASQSVSNDVAWYQQKPGQSPKLLINYASHRYTGVPDRFTGSGYGTDFTLTISSLQAEDVAVYFCQQDYSSPRTFGGGTKVEIK

SEQ ID NO: 9861 - protein, 122 aa, Artificial Sequence; identical to SEQ ID NO: 6246
  Description of Artificial Sequence: Synthetic polypeptide
  VH of XENP018923

SEQ ID NO: 9862 - protein, 107 aa, Artificial Sequence
  Description of Artificial Sequence: Synthetic polypeptide
  VL of XENP018923
SIVMTQSPDSLAVSLGERATINCKASQSVSNDVAWYQQKPGQSPKLLINYASHRYTGVPDRFTGSGYGTDFTLTISSLQAEDVAVYFCQQDYSSPRTFGGGTKVEIK

SEQ ID NO: 9863 - protein, 5 aa, Artificial Sequence
  Description of Artificial Sequence: Synthetic peptide
  XENP018923 vhCDR1
NYWMN

SEQ ID NO: 9864 - protein, 19 aa, Artificial Sequence
  Description of Artificial Sequence: Synthetic peptide
  XENP018923 vhCDR2
EIRLKSNNYATHYAEPVKG

SEQ ID NO: 9865 - protein, 11 aa, Artificial Sequence
  Description of Artificial Sequence: Synthetic peptide
  XENP018923 vhCDR3
YYGNYGGYFDV

SEQ ID NO: 9866 - protein, 11 aa, Artificial Sequence
  Description of Artificial Sequence: Synthetic peptide
  XENP018923 vlCDR1
KASQSVSNDVA

SEQ ID NO: 9867 - protein, 7 aa, Artificial Sequence
  Description of Artificial Sequence: Synthetic peptide
  XENP018923 vlCDR2
YASHRYT

SEQ ID NO: 9868 - protein, 9 aa, Artificial Sequence
  Description of Artificial Sequence: Synthetic peptide
  XENP018923 vlCDR3
QQDYSSPRT

SEQ ID NO: 9869 - protein, 249 aa, Artificial Sequence
  Description of Artificial Sequence: Synthetic polypeptide
  XENP018924 1G6_H2L1_scFv(GKPGS)4
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 9870 - protein, 122 aa, Artificial Sequence
  Description of Artificial Sequence: Synthetic polypeptide
  VH of XENP018924
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSS

SEQ ID NO: 9871 - protein, 107 aa, Artificial Sequence; identical to SEQ ID NO: 6247
  Description of Artificial Sequence: Synthetic polypeptide
  VL of XENP018924

SEQ ID NO: 9872 - protein, 5 aa, Artificial Sequence
  Description of Artificial Sequence: Synthetic peptide
  XENP018924 vhCDR1
NYWMN

SEQ ID NO: 9873 - protein, 19 aa, Artificial Sequence
  Description of Artificial Sequence: Synthetic peptide
  XENP018924 vhCDR2
EIRLKSNNYATHYAEKFQG

SEQ ID NO: 9874 - protein, 11 aa, Artificial Sequence
  Description of Artificial Sequence: Synthetic peptide
  XENP018924 vhCDR3
YYGNYGGYFDV

SEQ ID NO: 9875 - protein, 11 aa, Artificial Sequence
  Description of Artificial Sequence: Synthetic peptide
  XENP018924 vlCDR1
RASQSVSNDVA

SEQ ID NO: 9876 - protein, 7 aa, Artificial Sequence
  Description of Artificial Sequence: Synthetic peptide
  XENP018924 vlCDR2
YASHRYT

SEQ ID NO: 9877 - protein, 9 aa, Artificial Sequence
  Description of Artificial Sequence: Synthetic peptide
  XENP018924 vlCDR3
QQDYSSPRT

SEQ ID NO: 9878 - protein, 249 aa, Artificial Sequence
  Description of Artificial Sequence: Synthetic polypeptide
  XENP018925 1G6_H2L2_scFv(GKPGS)4
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSSGKPGSGKPGSGKPGSGKPGSSIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIK

SEQ ID NO: 9879 - protein, 122 aa, Artificial Sequence; identical to SEQ ID NO: 9870
  Description of Artificial Sequence: Synthetic polypeptide
  VH of XENP018925

SEQ ID NO: 9880 - protein, 107 aa, Artificial Sequence; identical to SEQ ID NO: 6256
  Description of Artificial Sequence: Synthetic polypeptide
  VL of XENP018925

SEQ ID NO: 9881 - protein, 5 aa, Artificial Sequence
  Description of Artificial Sequence: Synthetic peptide
  XENP018925 vhCDR1
NYWMN

SEQ ID NO: 9882 - protein, 19 aa, Artificial Sequence
  Description of Artificial Sequence: Synthetic peptide
  XENP018925 vhCDR2
EIRLKSNNYATHYAEKFQG

SEQ ID NO: 9883 - protein, 11 aa, Artificial Sequence
  Description of Artificial Sequence: Synthetic peptide
  XENP018925 vhCDR3
YYGNYGGYFDV

SEQ ID NO: 9884 - protein, 11 aa, Artificial Sequence
  Description of Artificial Sequence: Synthetic peptide
  XENP018925 vlCDR1
RASQSVSNDVA

SEQ ID NO: 9885 - protein, 7 aa, Artificial Sequence
  Description of Artificial Sequence: Synthetic peptide
  XENP018925 vlCDR2
YASHRYT

SEQ ID NO: 9886 - protein, 9 aa, Artificial Sequence
  Description of Artificial Sequence: Synthetic peptide
  XENP018925 vlCDR3
QQDYSSPRT

SEQ ID NO: 9887 - protein, 249 aa, Artificial Sequence
  Description of Artificial Sequence: Synthetic polypeptide
  XENP018926 1G6_H2L3_scFv(GKPGS)4
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSSGKPGSGKPGSGKPGSGKPGSSIVMTQSPLSLPVTPGEPASISCRASQSVSNDVAWYLQKPGQSPQLLINYASHRYTGVPDRFTGSGYGTDFTLKISRVEAEDVGVYFCQQDYSSPRTFGGGTKVEIK

SEQ ID NO: 9888 - protein, 122 aa, Artificial Sequence; identical to SEQ ID NO: 9870
  Description of Artificial Sequence: Synthetic polypeptide
  VH of XENP018926

SEQ ID NO: 9889 - protein, 107 aa, Artificial Sequence; identical to SEQ ID NO: 9844
  Description of Artificial Sequence: Synthetic polypeptide
  VL of XENP018926

SEQ ID NO: 9890 - protein, 5 aa, Artificial Sequence
  Description of Artificial Sequence: Synthetic peptide
  XENP018926 vhCDR1
NYWMN

SEQ ID NO: 9891 - protein, 19 aa, Artificial Sequence
  Description of Artificial Sequence: Synthetic peptide
  XENP018926 vhCDR2
EIRLKSNNYATHYAEKFQG

SEQ ID NO: 9892 - protein, 11 aa, Artificial Sequence
  Description of Artificial Sequence: Synthetic peptide
  XENP018926 vhCDR3
YYGNYGGYFDV

SEQ ID NO: 9893 - protein, 11 aa, Artificial Sequence
  Description of Artificial Sequence: Synthetic peptide
  XENP018926 vlCDR1
RASQSVSNDVA

SEQ ID NO: 9894 - protein, 7 aa, Artificial Sequence
  Description of Artificial Sequence: Synthetic peptide
  XENP018926 vlCDR2
YASHRYT

SEQ ID NO: 9895 - protein, 9 aa, Artificial Sequence
  Description of Artificial Sequence: Synthetic peptide
  XENP018926 vlCDR3
QQDYSSPRT

SEQ ID NO: 9896 - protein, 249 aa, Artificial Sequence
  Description of Artificial Sequence: Synthetic polypeptide
  XENP018927 1G6_H2L4_scFv(GKPGS)4
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSSGKPGSGKPGSGKPGSGKPGSSIVMTQSPGTLSLSPGERATLSCRASQSVSNDVAWYQQKPGQSPRLLINYASHRYTGVPDRFTGSGYGTDFTLTISRLEPEDFAVYFCQQDYSSPRTFGGGTKVEIK

SEQ ID NO: 9897 - protein, 122 aa, Artificial Sequence; identical to SEQ ID NO: 9870
  Description of Artificial Sequence: Synthetic polypeptide
  VH of XENP018927

SEQ ID NO: 9898 - protein, 107 aa, Artificial Sequence; identical to SEQ ID NO: 9853
  Description of Artificial Sequence: Synthetic polypeptide
  VL of XENP018927

SEQ ID NO: 9899 - protein, 5 aa, Artificial Sequence
  Description of Artificial Sequence: Synthetic peptide
  XENP018927 vhCDR1
NYWMN

SEQ ID NO: 9900 - protein, 19 aa, Artificial Sequence
  Description of Artificial Sequence: Synthetic peptide
  XENP018927 vhCDR2
EIRLKSNNYATHYAEKFQG

SEQ ID NO: 9901 - protein, 11 aa, Artificial Sequence
  Description of Artificial Sequence: Synthetic peptide
  XENP018927 vhCDR3
YYGNYGGYFDV

SEQ ID NO: 9902 - protein, 11 aa, Artificial Sequence
  Description of Artificial Sequence: Synthetic peptide
  XENP018927 vlCDR1
RASQSVSNDVA

SEQ ID NO: 9903 - protein, 7 aa, Artificial Sequence
  Description of Artificial Sequence: Synthetic peptide
  XENP018927 vlCDR2
YASHRYT

SEQ ID NO: 9904 - protein, 9 aa, Artificial Sequence
  Description of Artificial Sequence: Synthetic peptide
  XENP018927 vlCDR3
QQDYSSPRT

SEQ ID NO: 9905 - protein, 249 aa, Artificial Sequence
  Description of Artificial Sequence: Synthetic polypeptide
  XENP018928 1G6_H2L5_scFv(GKPGS)4
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSSGKPGSGKPGSGKPGSGKPGSSIVMTQSPDSLAVSLGERATINCKASQSVSNDVAWYQQKPGQSPKLLINYASHRYTGVPDRFTGSGYGTDFTLTISSLQAEDVAVYFCQQDYSSPRTFGGGTKVEIK

SEQ ID NO: 9906 - protein, 122 aa, Artificial Sequence; identical to SEQ ID NO: 9870
  Description of Artificial Sequence: Synthetic polypeptide
  VH of XENP018928

SEQ ID NO: 9907 - protein, 107 aa, Artificial Sequence; identical to SEQ ID NO: 9862
  Description of Artificial Sequence: Synthetic polypeptide
  VL of XENP018928

SEQ ID NO: 9908 - protein, 5 aa, Artificial Sequence
  Description of Artificial Sequence: Synthetic peptide
  XENP018928 vhCDR1
NYWMN

SEQ ID NO: 9909 - protein, 19 aa, Artificial Sequence
  Description of Artificial Sequence: Synthetic peptide
  XENP018928 vhCDR2
EIRLKSNNYATHYAEKFQG

SEQ ID NO: 9910 - protein, 11 aa, Artificial Sequence
  Description of Artificial Sequence: Synthetic peptide
  XENP018928 vhCDR3
YYGNYGGYFDV

SEQ ID NO: 9911 - protein, 11 aa, Artificial Sequence
  Description of Artificial Sequence: Synthetic peptide
  XENP018928 vlCDR1
KASQSVSNDVA

SEQ ID NO: 9912 - protein, 7 aa, Artificial Sequence
  Description of Artificial Sequence: Synthetic peptide
  XENP018928 vlCDR2
YASHRYT

SEQ ID NO: 9913 - protein, 9 aa, Artificial Sequence
  Description of Artificial Sequence: Synthetic peptide
  XENP018928 vlCDR3
QQDYSSPRT

SEQ ID NO: 9914 - protein, 249 aa, Artificial Sequence
  Description of Artificial Sequence: Synthetic polypeptide
  XENP018929 1G6_H3L1_scFv(GKPGS)4
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 9915 - protein, 122 aa, Artificial Sequence
  Description of Artificial Sequence: Synthetic polypeptide
  VH of XENP018929
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSS

SEQ ID NO: 9916 - protein, 107 aa, Artificial Sequence; identical to SEQ ID NO: 6247
  Description of Artificial Sequence: Synthetic polypeptide
  VL of XENP018929

SEQ ID NO: 9917 - protein, 5 aa, Artificial Sequence
  Description of Artificial Sequence: Synthetic peptide
  XENP018929 vhCDR1
NYWMN

SEQ ID NO: 9918 - protein, 19 aa, Artificial Sequence
  Description of Artificial Sequence: Synthetic peptide
  XENP018929 vhCDR2
EIRLKSNNYATHYAESVKG

SEQ ID NO: 9919 - protein, 11 aa, Artificial Sequence
  Description of Artificial Sequence: Synthetic peptide
  XENP018929 vhCDR3
YYGNYGGYFDV

SEQ ID NO: 9920 - protein, 11 aa, Artificial Sequence
  Description of Artificial Sequence: Synthetic peptide
  XENP018929 vlCDR1
RASQSVSNDVA

SEQ ID NO: 9921 - protein, 7 aa, Artificial Sequence
  Description of Artificial Sequence: Synthetic peptide
  XENP018929 vlCDR2
YASHRYT

SEQ ID NO: 9922 - protein, 9 aa, Artificial Sequence
  Description of Artificial Sequence: Synthetic peptide
  XENP018929 vlCDR3
QQDYSSPRT

SEQ ID NO: 9923 - protein, 249 aa, Artificial Sequence
  Description of Artificial Sequence: Synthetic polypeptide
  XENP018930 1G6_H3L2_scFv(GKPGS)4
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSSGKPGSGKPGSGKPGSGKPGSSIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIK

SEQ ID NO: 9924 - protein, 122 aa, Artificial Sequence; identical to SEQ ID NO: 9915
  Description of Artificial Sequence: Synthetic polypeptide
  VH of XENP018930

SEQ ID NO: 9925 - protein, 107 aa, Artificial Sequence; identical to SEQ ID NO: 6256
  Description of Artificial Sequence: Synthetic polypeptide
  VL of XENP018930

SEQ ID NO: 9926 - protein, 5 aa, Artificial Sequence
  Description of Artificial Sequence: Synthetic peptide
  XENP018930 vhCDR1
NYWMN

SEQ ID NO: 9927 - protein, 19 aa, Artificial Sequence
  Description of Artificial Sequence: Synthetic peptide
  XENP018930 vhCDR2
EIRLKSNNYATHYAESVKG

SEQ ID NO: 9928 - protein, 11 aa, Artificial Sequence
  Description of Artificial Sequence: Synthetic peptide
  XENP018930 vhCDR3
YYGNYGGYFDV

SEQ ID NO: 9929 - protein, 11 aa, Artificial Sequence
  Description of Artificial Sequence: Synthetic peptide
  XENP018930 vlCDR1
RASQSVSNDVA

SEQ ID NO: 9930 - protein, 7 aa, Artificial Sequence
  Description of Artificial Sequence: Synthetic peptide
  XENP018930 vlCDR2
YASHRYT

SEQ ID NO: 9931 - protein, 9 aa, Artificial Sequence
  Description of Artificial Sequence: Synthetic peptide
  XENP018930 vlCDR3
QQDYSSPRT

SEQ ID NO: 9932 - protein, 249 aa, Artificial Sequence
  Description of Artificial Sequence: Synthetic polypeptide
  XENP018931 1G6_H3L3_scFv(GKPGS)4
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSSGKPGSGKPGSGKPGSGKPGSSIVMTQSPLSLPVTPGEPASISCRASQSVSNDVAWYLQKPGQSPQLLINYASHRYTGVPDRFTGSGYGTDFTLKISRVEAEDVGVYFCQQDYSSPRTFGGGTKVEIK

SEQ ID NO: 9933 - protein, 122 aa, Artificial Sequence; identical to SEQ ID NO: 9915
  Description of Artificial Sequence: Synthetic polypeptide
  VH of XENP018931

SEQ ID NO: 9934 - protein, 107 aa, Artificial Sequence; identical to SEQ ID NO: 9844
  Description of Artificial Sequence: Synthetic polypeptide
  VL of XENP018931

SEQ ID NO: 9935 - protein, 5 aa, Artificial Sequence
  Description of Artificial Sequence: Synthetic peptide
  XENP018931 vhCDR1
NYWMN

SEQ ID NO: 9936 - protein, 19 aa, Artificial Sequence
  Description of Artificial Sequence: Synthetic peptide
  XENP018931 vhCDR2
EIRLKSNNYATHYAESVKG

SEQ ID NO: 9937 - protein, 11 aa, Artificial Sequence
  Description of Artificial Sequence: Synthetic peptide
  XENP018931 vhCDR3
YYGNYGGYFDV

SEQ ID NO: 9938 - protein, 11 aa, Artificial Sequence
  Description of Artificial Sequence: Synthetic peptide
  XENP018931 vlCDR1
RASQSVSNDVA

SEQ ID NO: 9939 - protein, 7 aa, Artificial Sequence
  Description of Artificial Sequence: Synthetic peptide
  XENP018931 vlCDR2
YASHRYT

SEQ ID NO: 9940 - protein, 9 aa, Artificial Sequence
  Description of Artificial Sequence: Synthetic peptide
  XENP018931 vlCDR3
QQDYSSPRT

SEQ ID NO: 9941 - protein, 249 aa, Artificial Sequence
  Description of Artificial Sequence: Synthetic polypeptide
  XENP018932 1G6_H3L4_scFv(GKPGS)4
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSSGKPGSGKPGSGKPGSGKPGSSIVMTQSPGTLSLSPGERATLSCRASQSVSNDVAWYQQKPGQSPRLLINYASHRYTGVPDRFTGSGYGTDFTLTISRLEPEDFAVYFCQQDYSSPRTFGGGTKVEIK

SEQ ID NO: 9942 - protein, 122 aa, Artificial Sequence; identical to SEQ ID NO: 9915
  Description of Artificial Sequence: Synthetic polypeptide
  VH of XENP018932

SEQ ID NO: 9943 - protein, 107 aa, Artificial Sequence; identical to SEQ ID NO: 9853
  Description of Artificial Sequence: Synthetic polypeptide
  VL of XENP018932

SEQ ID NO: 9944 - protein, 5 aa, Artificial Sequence
  Description of Artificial Sequence: Synthetic peptide
  XENP018932 vhCDR1
NYWMN

SEQ ID NO: 9945 - protein, 19 aa, Artificial Sequence
  Description of Artificial Sequence: Synthetic peptide
  XENP018932 vhCDR2
EIRLKSNNYATHYAESVKG

SEQ ID NO: 9946 - protein, 11 aa, Artificial Sequence
  Description of Artificial Sequence: Synthetic peptide
  XENP018932 vhCDR3
YYGNYGGYFDV

SEQ ID NO: 9947 - protein, 11 aa, Artificial Sequence
  Description of Artificial Sequence: Synthetic peptide
  XENP018932 vlCDR1
RASQSVSNDVA

SEQ ID NO: 9948 - protein, 7 aa, Artificial Sequence
  Description of Artificial Sequence: Synthetic peptide
  XENP018932 vlCDR2
YASHRYT

SEQ ID NO: 9949 - protein, 9 aa, Artificial Sequence
  Description of Artificial Sequence: Synthetic peptide
  XENP018932 vlCDR3
QQDYSSPRT

SEQ ID NO: 9950 - protein, 249 aa, Artificial Sequence
  Description of Artificial Sequence: Synthetic polypeptide
  XENP018933 1G6_H3L5_scFv(GKPGS)4
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSSGKPGSGKPGSGKPGSGKPGSSIVMTQSPDSLAVSLGERATINCKASQSVSNDVAWYQQKPGQSPKLLINYASHRYTGVPDRFTGSGYGTDFTLTISSLQAEDVAVYFCQQDYSSPRTFGGGTKVEIK

SEQ ID NO: 9951 - protein, 122 aa, Artificial Sequence; identical to SEQ ID NO: 9915
  Description of Artificial Sequence: Synthetic polypeptide
  VH of XENP018933

SEQ ID NO: 9952 - protein, 107 aa, Artificial Sequence; identical to SEQ ID NO: 9862
  Description of Artificial Sequence: Synthetic polypeptide
  VL of XENP018933

SEQ ID NO: 9953 - protein, 5 aa, Artificial Sequence
  Description of Artificial Sequence: Synthetic peptide
  XENP018933 vhCDR1
NYWMN

SEQ ID NO: 9954 - protein, 19 aa, Artificial Sequence
  Description of Artificial Sequence: Synthetic peptide
  XENP018933 vhCDR2
EIRLKSNNYATHYAESVKG

SEQ ID NO: 9955 - protein, 11 aa, Artificial Sequence
  Description of Artificial Sequence: Synthetic peptide
  XENP018933 vhCDR3
YYGNYGGYFDV

SEQ ID NO: 9956 - protein, 11 aa, Artificial Sequence
  Description of Artificial Sequence: Synthetic peptide
  XENP018933 vlCDR1
KASQSVSNDVA

SEQ ID NO: 9957 - protein, 7 aa, Artificial Sequence
  Description of Artificial Sequence: Synthetic peptide
  XENP018933 vlCDR2
YASHRYT

SEQ ID NO: 9958 - protein, 9 aa, Artificial Sequence
  Description of Artificial Sequence: Synthetic peptide
  XENP018933 vlCDR3
QQDYSSPRT

SEQ ID NO: 9959 - protein, 249 aa, Artificial Sequence
  Description of Artificial Sequence: Synthetic polypeptide
  XENP018934 1G6_H4L1_scFv(GKPGS)4
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 9960 - protein, 122 aa, Artificial Sequence
  Description of Artificial Sequence: Synthetic polypeptide
  VH of XENP018934
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSS

SEQ ID NO: 9961 - protein, 107 aa, Artificial Sequence; identical to SEQ ID NO: 6247
  Description of Artificial Sequence: Synthetic polypeptide
  VL of XENP018934

SEQ ID NO: 9962 - protein, 5 aa, Artificial Sequence
  Description of Artificial Sequence: Synthetic peptide
  XENP018934 vhCDR1
NYWMN

SEQ ID NO: 9963 - protein, 19 aa, Artificial Sequence
  Description of Artificial Sequence: Synthetic peptide
  XENP018934 vhCDR2
EIRLKSNNYATHYAESVKG

SEQ ID NO: 9964 - protein, 11 aa, Artificial Sequence
  Description of Artificial Sequence: Synthetic peptide
  XENP018934 vhCDR3
YYGNYGGYFDV

SEQ ID NO: 9965 - protein, 11 aa, Artificial Sequence
  Description of Artificial Sequence: Synthetic peptide
  XENP018934 vlCDR1
RASQSVSNDVA

SEQ ID NO: 9966 - protein, 7 aa, Artificial Sequence
  Description of Artificial Sequence: Synthetic peptide
  XENP018934 vlCDR2
YASHRYT

SEQ ID NO: 9967 - protein, 9 aa, Artificial Sequence
  Description of Artificial Sequence: Synthetic peptide
  XENP018934 vlCDR3
QQDYSSPRT

SEQ ID NO: 9968 - protein, 249 aa, Artificial Sequence
  Description of Artificial Sequence: Synthetic polypeptide
  XENP018935 1G6_H4L2_scFv(GKPGS)4
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIK

SEQ ID NO: 9969 - protein, 122 aa, Artificial Sequence; identical to SEQ ID NO: 9960
  Description of Artificial Sequence: Synthetic polypeptide
  VH of XENP018935

SEQ ID NO: 9970 - protein, 107 aa, Artificial Sequence; identical to SEQ ID NO: 6256
  Description of Artificial Sequence: Synthetic polypeptide
  VL of XENP018935

SEQ ID NO: 9971 - protein, 5 aa, Artificial Sequence
  Description of Artificial Sequence: Synthetic peptide
  XENP018935 vhCDR1
NYWMN

SEQ ID NO: 9972 - protein, 19 aa, Artificial Sequence
  Description of Artificial Sequence: Synthetic peptide
  XENP018935 vhCDR2
EIRLKSNNYATHYAESVKG

SEQ ID NO: 9973 - protein, 11 aa, Artificial Sequence
  Description of Artificial Sequence: Synthetic peptide
  XENP018935 vhCDR3
YYGNYGGYFDV

SEQ ID NO: 9974 - protein, 11 aa, Artificial Sequence
  Description of Artificial Sequence: Synthetic peptide
  XENP018935 vlCDR1
RASQSVSNDVA

SEQ ID NO: 9975 - protein, 7 aa, Artificial Sequence
  Description of Artificial Sequence: Synthetic peptide
  XENP018935 vlCDR2
YASHRYT

SEQ ID NO: 9976 - protein, 9 aa, Artificial Sequence
  Description of Artificial Sequence: Synthetic peptide
  XENP018935 vlCDR3
QQDYSSPRT

SEQ ID NO: 9977 - protein, 249 aa, Artificial Sequence
  Description of Artificial Sequence: Synthetic polypeptide
  XENP018936 1G6_H4L3_scFv(GKPGS)4
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPLSLPVTPGEPASISCRASQSVSNDVAWYLQKPGQSPQLLINYASHRYTGVPDRFTGSGYGTDFTLKISRVEAEDVGVYFCQQDYSSPRTFGGGTKVEIK

SEQ ID NO: 9978 - protein, 122 aa, Artificial Sequence; identical to SEQ ID NO: 9960
  Description of Artificial Sequence: Synthetic polypeptide
  VH of XENP018936

SEQ ID NO: 9979 - protein, 107 aa, Artificial Sequence; identical to SEQ ID NO: 9844
  Description of Artificial Sequence: Synthetic polypeptide
  VL of XENP018936

SEQ ID NO: 9980 - protein, 5 aa, Artificial Sequence
  Description of Artificial Sequence: Synthetic peptide
  XENP018936 vhCDR1
NYWMN

SEQ ID NO: 9981 - protein, 19 aa, Artificial Sequence
  Description of Artificial Sequence: Synthetic peptide
  XENP018936 vhCDR2
EIRLKSNNYATHYAESVKG

SEQ ID NO: 9982 - protein, 11 aa, Artificial Sequence
  Description of Artificial Sequence: Synthetic peptide
  XENP018936 vhCDR3
YYGNYGGYFDV

SEQ ID NO: 9983 - protein, 11 aa, Artificial Sequence
  Description of Artificial Sequence: Synthetic peptide
  XENP018936 vlCDR1
RASQSVSNDVA

SEQ ID NO: 9984 - protein, 7 aa, Artificial Sequence
  Description of Artificial Sequence: Synthetic peptide
  XENP018936 vlCDR2
YASHRYT

SEQ ID NO: 9985 - protein, 9 aa, Artificial Sequence
  Description of Artificial Sequence: Synthetic peptide
  XENP018936 vlCDR3
QQDYSSPRT

SEQ ID NO: 9986 - protein, 249 aa, Artificial Sequence
  Description of Artificial Sequence: Synthetic polypeptide
  XENP018937 1G6_H4L4_scFv(GKPGS)4
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPGTLSLSPGERATLSCRASQSVSNDVAWYQQKPGQSPRLLINYASHRYTGVPDRFTGSGYGTDFTLTISRLEPEDFAVYFCQQDYSSPRTFGGGTKVEIK

SEQ ID NO: 9987 - protein, 122 aa, Artificial Sequence; identical to SEQ ID NO: 9960
  Description of Artificial Sequence: Synthetic polypeptide
  VH of XENP018937

SEQ ID NO: 9988 - protein, 107 aa, Artificial Sequence; identical to SEQ ID NO: 9853
  Description of Artificial Sequence: Synthetic polypeptide
  VL of XENP018937

SEQ ID NO: 9989 - protein, 5 aa, Artificial Sequence
  Description of Artificial Sequence: Synthetic peptide
  XENP018937 vhCDR1
NYWMN

SEQ ID NO: 9990 - protein, 19 aa, Artificial Sequence
  Description of Artificial Sequence: Synthetic peptide
  XENP018937 vhCDR2
EIRLKSNNYATHYAESVKG

SEQ ID NO: 9991 - protein, 11 aa, Artificial Sequence
  Description of Artificial Sequence: Synthetic peptide
  XENP018937 vhCDR3
YYGNYGGYFDV

SEQ ID NO: 9992 - protein, 11 aa, Artificial Sequence
  Description of Artificial Sequence: Synthetic peptide
  XENP018937 vlCDR1
RASQSVSNDVA

SEQ ID NO: 9993 - protein, 7 aa, Artificial Sequence
  Description of Artificial Sequence: Synthetic peptide
  XENP018937 vlCDR2
YASHRYT

SEQ ID NO: 9994 - protein, 9 aa, Artificial Sequence
  Description of Artificial Sequence: Synthetic peptide
  XENP018937 vlCDR3
QQDYSSPRT

SEQ ID NO: 9995 - protein, 249 aa, Artificial Sequence
  Description of Artificial Sequence: Synthetic polypeptide
  XENP018938 1G6_H4L5_scFv(GKPGS)4
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPDSLAVSLGERATINCKASQSVSNDVAWYQQKPGQSPKLLINYASHRYTGVPDRFTGSGYGTDFTLTISSLQAEDVAVYFCQQDYSSPRTFGGGTKVEIK

SEQ ID NO: 9996 - protein, 122 aa, Artificial Sequence; identical to SEQ ID NO: 9960
  Description of Artificial Sequence: Synthetic polypeptide
  VH of XENP018938

SEQ ID NO: 9997 - protein, 107 aa, Artificial Sequence; identical to SEQ ID NO: 9862
  Description of Artificial Sequence: Synthetic polypeptide
  VL of XENP018938

SEQ ID NO: 9998 - protein, 5 aa, Artificial Sequence
  Description of Artificial Sequence: Synthetic peptide
  XENP018938 vhCDR1
NYWMN

SEQ ID NO: 9999 - protein, 19 aa, Artificial Sequence
  Description of Artificial Sequence: Synthetic peptide
  XENP018938 vhCDR2
EIRLKSNNYATHYAESVKG

SEQ ID NO: 10000 - protein, 11 aa, Artificial Sequence
  Description of Artificial Sequence: Synthetic peptide
  XENP018938 vhCDR3
YYGNYGGYFDV

SEQ ID NO: 10001 - protein, 11 aa, Artificial Sequence
  Description of Artificial Sequence: Synthetic peptide
  XENP018938 vlCDR1
KASQSVSNDVA

SEQ ID NO: 10002 - protein, 7 aa, Artificial Sequence
  Description of Artificial Sequence: Synthetic peptide
  XENP018938 vlCDR2
YASHRYT

SEQ ID NO: 10003 - protein, 9 aa, Artificial Sequence
  Description of Artificial Sequence: Synthetic peptide
  XENP018938 vlCDR3
QQDYSSPRT

SEQ ID NO: 10004 - protein, 249 aa, Artificial Sequence
  Description of Artificial Sequence: Synthetic polypeptide
  XENP019064 1G6_H1.239_L1_scFv(GKPGS)4
EVQLKESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10005 - protein, 122 aa, Artificial Sequence
  Description of Artificial Sequence: Synthetic polypeptide
  VH of XENP019064
EVQLKESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 10006 - protein, 107 aa, Artificial Sequence; identical to SEQ ID NO: 6247
  Description of Artificial Sequence: Synthetic polypeptide
  VL of XENP019064

SEQ ID NO: 10007 - protein, 5 aa, Artificial Sequence
  Description of Artificial Sequence: Synthetic peptide
  XENP019064 vhCDR1
NYWMN

SEQ ID NO: 10008 - protein, 19 aa, Artificial Sequence
  Description of Artificial Sequence: Synthetic peptide
  XENP019064 vhCDR2
EIRLKSNNYATHYAEPVKG

SEQ ID NO: 10009 - protein, 11 aa, Artificial Sequence
  Description of Artificial Sequence: Synthetic peptide
  XENP019064 vhCDR3
YYGNYGGYFDV

SEQ ID NO: 10010 - protein, 11 aa, Artificial Sequence
  Description of Artificial Sequence: Synthetic peptide
  XENP019064 vlCDR1
RASQSVSNDVA

SEQ ID NO: 10011 - protein, 7 aa, Artificial Sequence
  Description of Artificial Sequence: Synthetic peptide
  XENP019064 vlCDR2
YASHRYT

SEQ ID NO: 10012 - protein, 9 aa, Artificial Sequence
  Description of Artificial Sequence: Synthetic peptide
  XENP019064 vlCDR3
QQDYSSPRT

SEQ ID NO: 10013 - protein, 249 aa, Artificial Sequence
  Description of Artificial Sequence: Synthetic polypeptide
  XENP019065 1G6_H1.240_L1_scFv(GKPGS)4
EVQLVESGGGLVKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10014 - protein, 122 aa, Artificial Sequence
  Description of Artificial Sequence: Synthetic polypeptide
  VH of XENP019065
EVQLVESGGGLVKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 10015 - protein, 107 aa, Artificial Sequence; identical to SEQ ID NO: 6247
  Description of Artificial Sequence: Synthetic polypeptide
  VL of XENP019065

SEQ ID NO: 10016 - protein, 5 aa, Artificial Sequence
  Description of Artificial Sequence: Synthetic peptide
  XENP019065 vhCDR1
NYWMN

SEQ ID NO: 10017 - protein, 19 aa, Artificial Sequence
  Description of Artificial Sequence: Synthetic peptide
  XENP019065 vhCDR2
EIRLKSNNYATHYAEPVKG

SEQ ID NO: 10018 - protein, 11 aa, Artificial Sequence
  Description of Artificial Sequence: Synthetic peptide
  XENP019065 vhCDR3
YYGNYGGYFDV

SEQ ID NO: 10019 - protein, 11 aa, Artificial Sequence
  Description of Artificial Sequence: Synthetic peptide
  XENP019065 vlCDR1
RASQSVSNDVA

SEQ ID NO: 10020 - protein, 7 aa, Artificial Sequence
  Description of Artificial Sequence: Synthetic peptide
  XENP019065 vlCDR2
YASHRYT

SEQ ID NO: 10021 - protein, 9 aa, Artificial Sequence
  Description of Artificial Sequence: Synthetic peptide
  XENP019065 vlCDR3
QQDYSSPRT

SEQ ID NO: 10022 - protein, 249 aa, Artificial Sequence
  Description of Artificial Sequence: Synthetic polypeptide
  XENP019066 1G6_H1.241_L1_scFv(GKPGS)4
EVQLVESGGGLVKPGGSLRLTCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10023 - protein, 122 aa, Artificial Sequence
  Description of Artificial Sequence: Synthetic polypeptide
  VH of XENP019066
EVQLVESGGGLVKPGGSLRLTCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 10024 - protein, 107 aa, Artificial Sequence; identical to SEQ ID NO: 6247
  Description of Artificial Sequence: Synthetic polypeptide
  VL of XENP019066

SEQ ID NO: 10025 - protein, 5 aa, Artificial Sequence
  Description of Artificial Sequence: Synthetic peptide
  XENP019066 vhCDR1
NYWMN

SEQ ID NO: 10026 - protein, 19 aa, Artificial Sequence
  Description of Artificial Sequence: Synthetic peptide
  XENP019066 vhCDR2
EIRLKSNNYATHYAEPVKG

SEQ ID NO: 10027 - protein, 11 aa, Artificial Sequence
  Description of Artificial Sequence: Synthetic peptide
  XENP019066 vhCDR3
YYGNYGGYFDV

SEQ ID NO: 10028 - protein, 11 aa, Artificial Sequence
  Description of Artificial Sequence: Synthetic peptide
  XENP019066 vlCDR1
RASQSVSNDVA

SEQ ID NO: 10029 - protein, 7 aa, Artificial Sequence
  Description of Artificial Sequence: Synthetic peptide
  XENP019066 vlCDR2
YASHRYT

SEQ ID NO: 10030 - protein, 9 aa, Artificial Sequence
  Description of Artificial Sequence: Synthetic peptide
  XENP019066 vlCDR3
QQDYSSPRT

SEQ ID NO: 10031 - protein, 249 aa, Artificial Sequence
  Description of Artificial Sequence: Synthetic polypeptide
  XENP019067 1G6_H1.242_L1_scFv(GKPGS)4
EVQLVESGGGLVKPGGSLRLVCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10032 - protein, 122 aa, Artificial Sequence
  Description of Artificial Sequence: Synthetic polypeptide
  VH of XENP019067
EVQLVESGGGLVKPGGSLRLVCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 10033 - protein, 107 aa, Artificial Sequence; identical to SEQ ID NO: 6247
  Description of Artificial Sequence: Synthetic polypeptide
  VL of XENP019067

SEQ ID NO: 10034 - protein, 5 aa, Artificial Sequence
  Description of Artificial Sequence: Synthetic peptide
  XENP019067 vhCDR1
NYWMN

SEQ ID NO: 10035 - protein, 19 aa, Artificial Sequence
  Description of Artificial Sequence: Synthetic peptide
  XENP019067 vhCDR2
EIRLKSNNYATHYAEPVKG

SEQ ID NO: 10036 - protein, 11 aa, Artificial Sequence
  Description of Artificial Sequence: Synthetic peptide
  XENP019067 vhCDR3
YYGNYGGYFDV

SEQ ID NO: 10037 - protein, 11 aa, Artificial Sequence
  Description of Artificial Sequence: Synthetic peptide
  XENP019067 vlCDR1
RASQSVSNDVA

SEQ ID NO: 10038 - protein, 7 aa, Artificial Sequence
  Description of Artificial Sequence: Synthetic peptide
  XENP019067 vlCDR2
YASHRYT

SEQ ID NO: 10039 - protein, 9 aa, Artificial Sequence
  Description of Artificial Sequence: Synthetic peptide
  XENP019067 vlCDR3
QQDYSSPRT

SEQ ID NO: 10040 - protein, 249 aa, Artificial Sequence
  Description of Artificial Sequence: Synthetic polypeptide
  XENP019068 1G6_H1.243_L1_scFv(GKPGS)4
EVQLVESGGGLVKPGGSLRLSCAASGFTLSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10041 - protein, 122 aa, Artificial Sequence
  Description of Artificial Sequence: Synthetic polypeptide
  VH of XENP019068
EVQLVESGGGLVKPGGSLRLSCAASGFTLSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 10042 - protein, 107 aa, Artificial Sequence; identical to SEQ ID NO: 6247
  Description of Artificial Sequence: Synthetic polypeptide
  VL of XENP019068

SEQ ID NO: 10043 - protein, 5 aa, Artificial Sequence
  Description of Artificial Sequence: Synthetic peptide
  XENP019068 vhCDR1
NYWMN

SEQ ID NO: 10044 - protein, 19 aa, Artificial Sequence
  Description of Artificial Sequence: Synthetic peptide
  XENP019068 vhCDR2
EIRLKSNNYATHYAEPVKG

SEQ ID NO: 10045 - protein, 11 aa, Artificial Sequence
  Description of Artificial Sequence: Synthetic peptide
  XENP019068 vhCDR3
YYGNYGGYFDV

SEQ ID NO: 10046 - protein, 11 aa, Artificial Sequence
  Description of Artificial Sequence: Synthetic peptide
  XENP019068 vlCDR1
RASQSVSNDVA

SEQ ID NO: 10047 - protein, 7 aa, Artificial Sequence
  Description of Artificial Sequence: Synthetic peptide
  XENP019068 vlCDR2
YASHRYT

SEQ ID NO: 10048 - protein, 9 aa, Artificial Sequence
  Description of Artificial Sequence: Synthetic peptide
  XENP019068 vlCDR3
QQDYSSPRT

SEQ ID NO: 10049 - protein, 249 aa, Artificial Sequence
  Description of Artificial Sequence: Synthetic polypeptide
  XENP019069 1G6_H1.244_L1_scFv(GKPGS)4
EVQLVESGGGLVKPGGSLRLSCAASGFTFSNYWMNWVRQAPGKGLQWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10050 - protein, 122 aa, Artificial Sequence
  Description of Artificial Sequence: Synthetic polypeptide
  VH of XENP019069
EVQLVESGGGLVKPGGSLRLSCAASGFTFSNYWMNWVRQAPGKGLQWVGEIRLKSNNYATHYAEPVKGRFTISRDDSKSTVYLQMNSLKTEDTAVYYCTRYYGNYGGYFDVWGAGTLVTVSS

SEQ ID NO: 10051 - protein, 107 aa, Artificial Sequence; identical to SEQ ID NO: 6247
  Description of Artificial Sequence: Synthetic polypeptide
  VL of XENP019069

SEQ ID NO: 10052 - protein, 5 aa, Artificial Sequence
  Description of Artificial Sequence: Synthetic peptide
  XENP019069 vhCDR1
NYWMN

SEQ ID NO: 10053 - protein, 19 aa, Artificial Sequence
  Description of Artificial Sequence: Synthetic peptide
  XENP019069 vhCDR2
EIRLKSNNYATHYAEPVKG

SEQ ID NO: 10054 - protein, 11 aa, Artificial Sequence
  Description of Artificial Sequence: Synthetic peptide
  XENP019069 vhCDR3
YYGNYGGYFDV

SEQ ID NO: 10055 - protein, 11 aa, Artificial Sequence
  Description of Artificial Sequence: Synthetic peptide
  XENP019069 vlCDR1
RASQSVSNDVA

SEQ ID NO: 10056 - protein, 7 aa, Artificial Sequence
  Description of Artificial Sequence: Synthetic peptide
  XENP019069 vlCDR2
YASHRYT

SEQ ID NO: 10057 - protein, 9 aa, Artificial Sequence
  Description of Artificial Sequence: Synthetic peptide
  XENP019069 vlCDR3
QQDYSSPRT

SEQ ID NO: 10058 - protein, 249 aa, Artificial Sequence
  Description of Artificial Sequence: Synthetic polypeptide
  XENP019070 1G6_H1.245_L1_scFv(GKPGS)4
EVQLVESGGGLVKPGGSLRLSCAASGFTFSNYWMNWVRQAPGKGLEWIGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10059 - protein, 122 aa, Artificial Sequence
  Description of Artificial Sequence: Synthetic polypeptide
  VH of XENP019070
EVQLVESGGGLVKPGGSLRLSCAASGFTFSNYWMNWVRQAPGKGLEWIGEIRLKSNNYATHYAEPVKGRFTISRDDSKSTVYLQMNSLKTEDTAVYYCTRYYGNYGGYFDVWGAGTLVTVSS

SEQ ID NO: 10060 - protein, 107 aa, Artificial Sequence; identical to SEQ ID NO: 6247
  Description of Artificial Sequence: Synthetic polypeptide
  VL of XENP019070

SEQ ID NO: 10061 - protein, 5 aa, Artificial Sequence
  Description of Artificial Sequence: Synthetic peptide
  XENP019070 vhCDR1
NYWMN

SEQ ID NO: 10062 - protein, 19 aa, Artificial Sequence
  Description of Artificial Sequence: Synthetic peptide
  XENP019070 vhCDR2
EIRLKSNNYATHYAEPVKG

SEQ ID NO: 10063 - protein, 11 aa, Artificial Sequence
  Description of Artificial Sequence: Synthetic peptide
  XENP019070 vhCDR3
YYGNYGGYFDV

SEQ ID NO: 10064 - protein, 11 aa, Artificial Sequence
  Description of Artificial Sequence: Synthetic peptide
  XENP019070 vlCDR1
RASQSVSNDVA

SEQ ID NO: 10065 - protein, 7 aa, Artificial Sequence
  Description of Artificial Sequence: Synthetic peptide
  XENP019070 vlCDR2
YASHRYT

SEQ ID NO: 10066 - protein, 9 aa, Artificial Sequence
  Description of Artificial Sequence: Synthetic peptide
  XENP019070 vlCDR3
QQDYSSPRT

SEQ ID NO: 10067 - protein, 249 aa, Artificial Sequence
  Description of Artificial Sequence: Synthetic polypeptide
  XENP019071 1G6_H1.246_L1_scFv(GKPGS)4
EVQLVESGGGLVKPGGSLRLSCAASGFTFSNYWMNWVRQAPGKGLEWMGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10068 - protein, 122 aa, Artificial Sequence
  Description of Artificial Sequence: Synthetic polypeptide
  VH of XENP019071
EVQLVESGGGLVKPGGSLRLSCAASGFTFSNYWMNWVRQAPGKGLEWMGEIRLKSNNYATHYAEPVKGRFTISRDDSKSTVYLQMNSLKTEDTAVYYCTRYYGNYGGYFDVWGAGTLVTVSS

SEQ ID NO: 10069 - protein, 107 aa, Artificial Sequence; identical to SEQ ID NO: 6247
  Description of Artificial Sequence: Synthetic polypeptide
  VL of XENP019071

SEQ ID NO: 10070 - protein, 5 aa, Artificial Sequence
  Description of Artificial Sequence: Synthetic peptide
  XENP019071 vhCDR1
NYWMN

SEQ ID NO: 10071 - protein, 19 aa, Artificial Sequence
  Description of Artificial Sequence: Synthetic peptide
  XENP019071 vhCDR2
EIRLKSNNYATHYAEPVKG

SEQ ID NO: 10072 - protein, 11 aa, Artificial Sequence
  Description of Artificial Sequence: Synthetic peptide
  XENP019071 vhCDR3
YYGNYGGYFDV

SEQ ID NO: 10073 - protein, 11 aa, Artificial Sequence
  Description of Artificial Sequence: Synthetic peptide
  XENP019071 vlCDR1
RASQSVSNDVA

SEQ ID NO: 10074 - protein, 7 aa, Artificial Sequence
  Description of Artificial Sequence: Synthetic peptide
  XENP019071 vlCDR2
YASHRYT

SEQ ID NO: 10075 - protein, 9 aa, Artificial Sequence
  Description of Artificial Sequence: Synthetic peptide
  XENP019071 vlCDR3
QQDYSSPRT

SEQ ID NO: 10076 - protein, 249 aa, Artificial Sequence
  Description of Artificial Sequence: Synthetic polypeptide
  XENP019072 1G6_H1.247_L1_scFv(GKPGS)4
EVQLVESGGGLVKPGGSLRLSCAASGFTFSNYWMNWVRQAPGKGLEWVGEIRLKSNNYATHYAEPFKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10077 - protein, 122 aa, Artificial Sequence
  Description of Artificial Sequence: Synthetic polypeptide
  VH of XENP019072
EVQLVESGGGLVKPGGSLRLSCAASGFTFSNYWMNWVRQAPGKGLEWVGEIRLKSNNYATHYAEPFKGRFTISRDDSKSTVYLQMNSLKTEDTAVYYCTRYYGNYGGYFDVWGAGTLVTVSS

SEQ ID NO: 10078 - protein, 107 aa, Artificial Sequence; identical to SEQ ID NO: 6247
  Description of Artificial Sequence: Synthetic polypeptide
  VL of XENP019072

SEQ ID NO: 10079 - protein, 5 aa, Artificial Sequence
  Description of Artificial Sequence: Synthetic peptide
  XENP019072 vhCDR1
NYWMN

SEQ ID NO: 10080 - protein, 19 aa, Artificial Sequence
  Description of Artificial Sequence: Synthetic peptide
  XENP019072 vhCDR2
EIRLKSNNYATHYAEPFKG

SEQ ID NO: 10081 - protein, 11 aa, Artificial Sequence
  Description of Artificial Sequence: Synthetic peptide
  XENP019072 vhCDR3
YYGNYGGYFDV

SEQ ID NO: 10082 - protein, 11 aa, Artificial Sequence
  Description of Artificial Sequence: Synthetic peptide
  XENP019072 vlCDR1
RASQSVSNDVA

SEQ ID NO: 10083 - protein, 7 aa, Artificial Sequence
  Description of Artificial Sequence: Synthetic peptide
  XENP019072 vlCDR2
YASHRYT

SEQ ID NO: 10084 - protein, 9 aa, Artificial Sequence
  Description of Artificial Sequence: Synthetic peptide
  XENP019072 vlCDR3
QQDYSSPRT

SEQ ID NO: 10085 - protein, 249 aa, Artificial Sequence
  Description of Artificial Sequence: Synthetic polypeptide
  XENP019073 1G6_H1.248_L1_scFv(GKPGS)4
EVQLVESGGGLVKPGGSLRLSCAASGFTFSNYWMNWVRQAPGKGLEWVGEIRLKSNNYATHYAEPVKGRATISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10086 - protein, 122 aa, Artificial Sequence
  Description of Artificial Sequence: Synthetic polypeptide
  VH of XENP019073
EVQLVESGGGLVKPGGSLRLSCAASGFTFSNYWMNWVRQAPGKGLEWVGEIRLKSNNYATHYAEPVKGRATISRDDSKSTVYLQMNSLKTEDTAVYYCTRYYGNYGGYFDVWGAGTLVTVSS

SEQ ID NO: 10087 - protein, 107 aa, Artificial Sequence; identical to SEQ ID NO: 6247
  Description of Artificial Sequence: Synthetic polypeptide
  VL of XENP019073

SEQ ID NO: 10088 - protein, 5 aa, Artificial Sequence
  Description of Artificial Sequence: Synthetic peptide
  XENP019073 vhCDR1
NYWMN

SEQ ID NO: 10089 - protein, 19 aa, Artificial Sequence
  Description of Artificial Sequence: Synthetic peptide
  XENP019073 vhCDR2
EIRLKSNNYATHYAEPVKG

SEQ ID NO: 10090 - protein, 11 aa, Artificial Sequence
  Description of Artificial Sequence: Synthetic peptide
  XENP019073 vhCDR3
YYGNYGGYFDV

SEQ ID NO: 10091 - protein, 11 aa, Artificial Sequence
  Description of Artificial Sequence: Synthetic peptide
  XENP019073 vlCDR1
RASQSVSNDVA

SEQ ID NO: 10092 - protein, 7 aa, Artificial Sequence
  Description of Artificial Sequence: Synthetic peptide
  XENP019073 vlCDR2
YASHRYT

SEQ ID NO: 10093 - protein, 9 aa, Artificial Sequence
  Description of Artificial Sequence: Synthetic peptide
  XENP019073 vlCDR3
QQDYSSPRT

SEQ ID NO: 10094 - protein, 249 aa, Artificial Sequence
  Description of Artificial Sequence: Synthetic polypeptide
  XENP019074 1G6_H1.249_L1_scFv(GKPGS)4
EVQLVESGGGLVKPGGSLRLSCAASGFTFSNYWMNWVRQAPGKGLEWVGEIRLKSNNYATHYAEPVKGRVTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10095 - protein, 122 aa, Artificial Sequence
  Description of Artificial Sequence: Synthetic polypeptide
  VH of XENP019074
EVQLVESGGGLVKPGGSLRLSCAASGFTFSNYWMNWVRQAPGKGLEWVGEIRLKSNNYATHYAEPVKGRVTISRDDSKSTVYLQMNSLKTEDTAVYYCTRYYGNYGGYFDVWGAGTLVTVSS

SEQ ID NO: 10096 - protein, 107 aa, Artificial Sequence; identical to SEQ ID NO: 6247
  Description of Artificial Sequence: Synthetic polypeptide
  VL of XENP019074

SEQ ID NO: 10097 - protein, 5 aa, Artificial Sequence
  Description of Artificial Sequence: Synthetic peptide
  XENP019074 vhCDR1
NYWMN

SEQ ID NO: 10098 - protein, 19 aa, Artificial Sequence
  Description of Artificial Sequence: Synthetic peptide
  XENP019074 vhCDR2
EIRLKSNNYATHYAEPVKG

SEQ ID NO: 10099 - protein, 11 aa, Artificial Sequence
  Description of Artificial Sequence: Synthetic peptide
  XENP019074 vhCDR3
YYGNYGGYFDV

SEQ ID NO: 10100 - protein, 11 aa, Artificial Sequence
  Description of Artificial Sequence: Synthetic peptide
  XENP019074 vlCDR1
RASQSVSNDVA

SEQ ID NO: 10101 - protein, 7 aa, Artificial Sequence
  Description of Artificial Sequence: Synthetic peptide
  XENP019074 vlCDR2
YASHRYT

SEQ ID NO: 10102 - protein, 9 aa, Artificial Sequence
  Description of Artificial Sequence: Synthetic peptide
  XENP019074 vlCDR3
QQDYSSPRT

SEQ ID NO: 10103 - protein, 249 aa, Artificial Sequence
  Description of Artificial Sequence: Synthetic polypeptide
  XENP019075 1G6_H1.250_L1_scFv(GKPGS)4
EVQLVESGGGLVKPGGSLRLSCAASGFTFSNYWMNWVRQAPGKGLEWVGEIRLKSNNYATHYAEPVKGRFTISRDDSSSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10104 - protein, 122 aa, Artificial Sequence
  Description of Artificial Sequence: Synthetic polypeptide
  VH of XENP019075
EVQLVESGGGLVKPGGSLRLSCAASGFTFSNYWMNWVRQAPGKGLEWVGEIRLKSNNYATHYAEPVKGRFTISRDDSSSTVYLQMNSLKTEDTAVYYCTRYYGNYGGYFDVWGAGTLVTVSS

SEQ ID NO: 10105 - protein, 107 aa, Artificial Sequence; identical to SEQ ID NO: 6247
  Description of Artificial Sequence: Synthetic polypeptide
  VL of XENP019075

SEQ ID NO: 10106 - protein, 5 aa, Artificial Sequence
  Description of Artificial Sequence: Synthetic peptide
  XENP019075 vhCDR1
NYWMN

SEQ ID NO: 10107 - protein, 19 aa, Artificial Sequence
  Description of Artificial Sequence: Synthetic peptide
  XENP019075 vhCDR2
EIRLKSNNYATHYAEPVKG

SEQ ID NO: 10108 - protein, 11 aa, Artificial Sequence
  Description of Artificial Sequence: Synthetic peptide
  XENP019075 vhCDR3
YYGNYGGYFDV

SEQ ID NO: 10109 - protein, 11 aa, Artificial Sequence
  Description of Artificial Sequence: Synthetic peptide
  XENP019075 vlCDR1
RASQSVSNDVA

SEQ ID NO: 10110 - protein, 7 aa, Artificial Sequence
  Description of Artificial Sequence: Synthetic peptide
  XENP019075 vlCDR2
YASHRYT

SEQ ID NO: 10111 - protein, 9 aa, Artificial Sequence
  Description of Artificial Sequence: Synthetic peptide
  XENP019075 vlCDR3
QQDYSSPRT

SEQ ID NO: 10112 - protein, 249 aa, Artificial Sequence
  Description of Artificial Sequence: Synthetic polypeptide
  XENP019076 1G6_H1.251_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSMVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10113 - protein, 122 aa, Artificial Sequence
  Description of Artificial Sequence: Synthetic polypeptide
  VH of XENP019076
EVQLVESGGGLVKPGGSLRLSCAASGFTFSNYWMNWVRQAPGKGLEWVGEIRLKSNNYATHYAEPVKGRFTISRDDSKSMVYLQMNSLKTEDTAVYYCTRYYGNYGGYFDVWGAGTLVTVSS

SEQ ID NO: 10114 - protein, 107 aa, Artificial Sequence; identical to SEQ ID NO: 6247
  Description of Artificial Sequence: Synthetic polypeptide
  VL of XENP019076

SEQ ID NO: 10115 - protein, 5 aa, Artificial Sequence
  Description of Artificial Sequence: Synthetic peptide
  XENP019076 vhCDR1
NYWMN

SEQ ID NO: 10116 - protein, 19 aa, Artificial Sequence
  Description of Artificial Sequence: Synthetic peptide
  XENP019076 vhCDR2
EIRLKSNNYATHYAEPVKG

SEQ ID NO: 10117 - protein, 11 aa, Artificial Sequence
  Description of Artificial Sequence: Synthetic peptide
  XENP019076 vhCDR3
YYGNYGGYFDV

SEQ ID NO: 10118 - protein, 11 aa, Artificial Sequence
  Description of Artificial Sequence: Synthetic peptide
  XENP019076 vlCDR1
RASQSVSNDVA

SEQ ID NO: 10119 - protein, 7 aa, Artificial Sequence
  Description of Artificial Sequence: Synthetic peptide
  XENP019076 vlCDR2
YASHRYT

SEQ ID NO: 10120 - protein, 9 aa, Artificial Sequence
  Description of Artificial Sequence: Synthetic peptide
  XENP019076 vlCDR3
QQDYSSPRT

SEQ ID NO: 10121 - protein, 249 aa, Artificial Sequence
  Description of Artificial Sequence: Synthetic polypeptide
  XENP019077 1G6_H1.252_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSQVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10122 - protein, 122 aa, Artificial Sequence
  Description of Artificial Sequence: Synthetic polypeptide
  VH of XENP019077
EVQLVESGGGLVKPGGSLRLSCAASGFTFSNYWMNWVRQAPGKGLEWVGEIRLKSNNYATHYAEPVKGRFTISRDDSKSQVYLQMNSLKTEDTAVYYCTRYYGNYGGYFDVWGAGTLVTVSS

SEQ ID NO: 10123 - protein, 107 aa, Artificial Sequence; identical to SEQ ID NO: 6247
  Description of Artificial Sequence: Synthetic polypeptide
  VL of XENP019077

SEQ ID NO: 10124 - protein, 5 aa, Artificial Sequence
  Description of Artificial Sequence: Synthetic peptide
  XENP019077 vhCDR1
NYWMN

SEQ ID NO: 10125 - protein, 19 aa, Artificial Sequence
  Description of Artificial Sequence: Synthetic peptide
  XENP019077 vhCDR2
EIRLKSNNYATHYAEPVKG

SEQ ID NO: 10126 - protein, 11 aa, Artificial Sequence
  Description of Artificial Sequence: Synthetic peptide
  XENP019077 vhCDR3
YYGNYGGYFDV

SEQ ID NO: 10127 - protein, 11 aa, Artificial Sequence
  Description of Artificial Sequence: Synthetic peptide
  XENP019077 vlCDR1
RASQSVSNDVA

SEQ ID NO: 10128 - protein, 7 aa, Artificial Sequence
  Description of Artificial Sequence: Synthetic peptide
  XENP019077 vlCDR2
YASHRYT

SEQ ID NO: 10129 - protein, 9 aa, Artificial Sequence
  Description of Artificial Sequence: Synthetic peptide
  XENP019077 vlCDR3
QQDYSSPRT

SEQ ID NO: 10130 - protein, 249 aa, Artificial Sequence
  Description of Artificial Sequence: Synthetic polypeptide
  XENP019078 1G6_H1.253_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVVLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10131 - protein, 122 aa, Artificial Sequence
  Description of Artificial Sequence: Synthetic polypeptide
  VH of XENP019078
EVQLVESGGGLVKPGGSLRLSCAASGFTFSNYWMNWVRQAPGKGLEWVGEIRLKSNNYATHYAEPVKGRFTISRDDSKSTVVLQMNSLKTEDTAVYYCTRYYGNYGGYFDVWGAGTLVTVSS

SEQ ID NO: 10132 - protein, 107 aa, Artificial Sequence; identical to SEQ ID NO: 6247
  Description of Artificial Sequence: Synthetic polypeptide
  VL of XENP019078

SEQ ID NO: 10133 - protein, 5 aa, Artificial Sequence
  Description of Artificial Sequence: Synthetic peptide
  XENP019078 vhCDR1
NYWMN

SEQ ID NO: 10134 - protein, 19 aa, Artificial Sequence
  Description of Artificial Sequence: Synthetic peptide
  XENP019078 vhCDR2
EIRLKSNNYATHYAEPVKG

SEQ ID NO: 10135 - protein, 11 aa, Artificial Sequence
  Description of Artificial Sequence: Synthetic peptide
  XENP019078 vhCDR3
YYGNYGGYFDV

SEQ ID NO: 10136 - protein, 11 aa, Artificial Sequence
  Description of Artificial Sequence: Synthetic peptide
  XENP019078 vlCDR1
RASQSVSNDVA

SEQ ID NO: 10137 - protein, 7 aa, Artificial Sequence
  Description of Artificial Sequence: Synthetic peptide
  XENP019078 vlCDR2
YASHRYT

SEQ ID NO: 10138 - protein, 9 aa, Artificial Sequence
  Description of Artificial Sequence: Synthetic peptide
  XENP019078 vlCDR3
QQDYSSPRT

SEQ ID NO: 10139 - protein, 249 aa, Artificial Sequence
  Description of Artificial Sequence: Synthetic polypeptide
  XENP019079 1G6_H1.254_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLEMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10140 - protein, 122 aa, Artificial Sequence
  Description of Artificial Sequence: Synthetic polypeptide
  VH of XENP019079
EVQLVESGGGLVKPGGSLRLSCAASGFTFSNYWMNWVRQAPGKGLEWVGEIRLKSNNYATHYAEPVKGRFTISRDDSKSTVYLEMNSLKTEDTAVYYCTRYYGNYGGYFDVWGAGTLVTVSS

SEQ ID NO: 10141 - protein, 107 aa, Artificial Sequence; identical to SEQ ID NO: 6247
  Description of Artificial Sequence: Synthetic polypeptide
  VL of XENP019079

SEQ ID NO: 10142 - protein, 5 aa, Artificial Sequence
  Description of Artificial Sequence: Synthetic peptide
  XENP019079 vhCDR1
NYWMN

SEQ ID NO: 10143 - protein, 19 aa, Artificial Sequence
  Description of Artificial Sequence: Synthetic peptide
  XENP019079 vhCDR2
EIRLKSNNYATHYAEPVKG

SEQ ID NO: 10144 - protein, 11 aa, Artificial Sequence
  Description of Artificial Sequence: Synthetic peptide
  XENP019079 vhCDR3
YYGNYGGYFDV

SEQ ID NO: 10145 - protein, 11 aa, Artificial Sequence
  Description of Artificial Sequence: Synthetic peptide
  XENP019079 vlCDR1
RASQSVSNDVA

SEQ ID NO: 10146 - protein, 7 aa, Artificial Sequence
  Description of Artificial Sequence: Synthetic peptide
  XENP019079 vlCDR2
YASHRYT

SEQ ID NO: 10147 - protein, 9 aa, Artificial Sequence
  Description of Artificial Sequence: Synthetic peptide
  XENP019079 vlCDR3
QQDYSSPRT

SEQ ID NO: 10148 - protein, 249 aa, Artificial Sequence
  Description of Artificial Sequence: Synthetic polypeptide
  XENP019080 1G6_H1.255_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSEKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10149 - protein, 122 aa, Artificial Sequence
  Description of Artificial Sequence: Synthetic polypeptide
  VH of XENP019080
EVQLVESGGGLVKPGGSLRLSCAASGFTFSNYWMNWVRQAPGKGLEWVGEIRLKSNNYATHYAEPVKGRFTISRDDSKSTVYLQMNSEKTEDTAVYYCTRYYGNYGGYFDVWGAGTLVTVSS

SEQ ID NO: 10150 - protein, 107 aa, Artificial Sequence; identical to SEQ ID NO: 6247
  Description of Artificial Sequence: Synthetic polypeptide
  VL of XENP019080

SEQ ID NO: 10151 - protein, 5 aa, Artificial Sequence
  Description of Artificial Sequence: Synthetic peptide
  XENP019080 vhCDR1
NYWMN

SEQ ID NO: 10152 - protein, 19 aa, Artificial Sequence
  Description of Artificial Sequence: Synthetic peptide
  XENP019080 vhCDR2
EIRLKSNNYATHYAEPVKG

SEQ ID NO: 10153 - protein, 11 aa, Artificial Sequence
  Description of Artificial Sequence: Synthetic peptide
  XENP019080 vhCDR3
YYGNYGGYFDV

SEQ ID NO: 10154 - protein, 11 aa, Artificial Sequence
  Description of Artificial Sequence: Synthetic peptide
  XENP019080 vlCDR1
RASQSVSNDVA

SEQ ID NO: 10155 - protein, 7 aa, Artificial Sequence
  Description of Artificial Sequence: Synthetic peptide
  XENP019080 vlCDR2
YASHRYT

SEQ ID NO: 10156 - protein, 9 aa, Artificial Sequence
  Description of Artificial Sequence: Synthetic peptide
  XENP019080 vlCDR3
QQDYSSPRT

SEQ ID NO: 10157 - protein, 249 aa, Artificial Sequence
  Description of Artificial Sequence: Synthetic polypeptide
  XENP019081 1G6_H1.256_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSVKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10158 - protein, 122 aa, Artificial Sequence
  Description of Artificial Sequence: Synthetic polypeptide
  VH of XENP019081
EVQLVESGGGLVKPGGSLRLSCAASGFTFSNYWMNWVRQAPGKGLEWVGEIRLKSNNYATHYAEPVKGRFTISRDDSKSTVYLQMNSVKTEDTAVYYCTRYYGNYGGYFDVWGAGTLVTVSS

SEQ ID NO: 10159 - protein, 107 aa, Artificial Sequence; identical to SEQ ID NO: 6247
  Description of Artificial Sequence: Synthetic polypeptide
  VL of XENP019081

SEQ ID NO: 10160 - protein, 5 aa, Artificial Sequence
  Description of Artificial Sequence: Synthetic peptide
  XENP019081 vhCDR1
NYWMN

SEQ ID NO: 10161 - protein, 19 aa, Artificial Sequence
  Description of Artificial Sequence: Synthetic peptide
  XENP019081 vhCDR2
EIRLKSNNYATHYAEPVKG

SEQ ID NO: 10162 - protein, 11 aa, Artificial Sequence
  Description of Artificial Sequence: Synthetic peptide
  XENP019081 vhCDR3
YYGNYGGYFDV

SEQ ID NO: 10163 - protein, 11 aa, Artificial Sequence
  Description of Artificial Sequence: Synthetic peptide
  XENP019081 vlCDR1
RASQSVSNDVA

SEQ ID NO: 10164 - protein, 7 aa, Artificial Sequence
  Description of Artificial Sequence: Synthetic peptide
  XENP019081 vlCDR2
YASHRYT

SEQ ID NO: 10165 - protein, 9 aa, Artificial Sequence
  Description of Artificial Sequence: Synthetic peptide
  XENP019081 vlCDR3
QQDYSSPRT

SEQ ID NO: 10166 - protein, 249 aa, Artificial Sequence
  Description of Artificial Sequence: Synthetic polypeptide
  XENP019082 1G6_H1.257_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGRGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10167 - protein, 122 aa, Artificial Sequence
  Description of Artificial Sequence: Synthetic polypeptide
  VH of XENP019082
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGRGTLVTVSS

SEQ ID NO: 10168 - protein, 107 aa, Artificial Sequence; identical to SEQ ID NO: 6247
  Description of Artificial Sequence: Synthetic polypeptide
  VL of XENP019082

SEQ ID NO: 10169 - protein, 5 aa, Artificial Sequence
  Description of Artificial Sequence: Synthetic peptide
  XENP019082 vhCDR1
NYWMN

SEQ ID NO: 10170 - protein, 19 aa, Artificial Sequence
  Description of Artificial Sequence: Synthetic peptide
  XENP019082 vhCDR2
EIRLKSNNYATHYAEPVKG

SEQ ID NO: 10171 - protein, 11 aa, Artificial Sequence
  Description of Artificial Sequence: Synthetic peptide
  XENP019082 vhCDR3
YYGNYGGYFDV

SEQ ID NO: 10172 - protein, 11 aa, Artificial Sequence
  Description of Artificial Sequence: Synthetic peptide
  XENP019082 vlCDR1
RASQSVSNDVA

SEQ ID NO: 10173 - protein, 7 aa, Artificial Sequence
  Description of Artificial Sequence: Synthetic peptide
  XENP019082 vlCDR2
YASHRYT

SEQ ID NO: 10174 - protein, 9 aa, Artificial Sequence
  Description of Artificial Sequence: Synthetic peptide
  XENP019082 vlCDR3
QQDYSSPRT

SEQ ID NO: 10175 - protein, 249 aa, Artificial Sequence
  Description of Artificial Sequence: Synthetic polypeptide
  XENP019083 1G6_H1.258_L1_scFv(GKPGS)4
EVQLVESGGGLKKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10176 - protein, 122 aa, Artificial Sequence
  Description of Artificial Sequence: Synthetic polypeptide
  VH of XENP019083
EVQLVESGGGLKKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 10177 - protein, 107 aa, Artificial Sequence; identical to SEQ ID NO: 6247
  Description of Artificial Sequence: Synthetic polypeptide
  VL of XENP019083

SEQ ID NO: 10178 - protein, 5 aa, Artificial Sequence
  Description of Artificial Sequence: Synthetic peptide
  XENP019083 vhCDR1
NYWMN

SEQ ID NO: 10179 - protein, 19 aa, Artificial Sequence
  Description of Artificial Sequence: Synthetic peptide
  XENP019083 vhCDR2
EIRLKSNNYATHYAEPVKG

SEQ ID NO: 10180 - protein, 11 aa, Artificial Sequence
  Description of Artificial Sequence: Synthetic peptide
  XENP019083 vhCDR3
YYGNYGGYFDV

SEQ ID NO: 10181 - protein, 11 aa, Artificial Sequence
  Description of Artificial Sequence: Synthetic peptide
  XENP019083 vlCDR1
RASQSVSNDVA

SEQ ID NO: 10182 - protein, 7 aa, Artificial Sequence
  Description of Artificial Sequence: Synthetic peptide
  XENP019083 vlCDR2
YASHRYT

SEQ ID NO: 10183 - protein, 9 aa, Artificial Sequence
  Description of Artificial Sequence: Synthetic peptide
  XENP019083 vlCDR3
QQDYSSPRT

SEQ ID NO: 10184 - protein, 249 aa, Artificial Sequence
  Description of Artificial Sequence: Synthetic polypeptide
  XENP019084 1G6_H1.259_L1_scFv(GKPGS)4
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCKRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10185 - protein, 122 aa, Artificial Sequence
  Description of Artificial Sequence: Synthetic polypeptide
  VH of XENP019084
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCKRYYGNYGGYFDVWGAGTLVTVSS

SEQ ID NO: 10186 - protein, 107 aa, Artificial Sequence; identical to SEQ ID NO: 6247
  Description of Artificial Sequence: Synthetic polypeptide
  VL of XENP019084

SEQ ID NO: 10187 - protein, 5 aa, Artificial Sequence
  Description of Artificial Sequence: Synthetic peptide
  XENP019084 vhCDR1
NYWMD

SEQ ID NO: 10188 - protein, 19 aa, Artificial Sequence
  Description of Artificial Sequence: Synthetic peptide
  XENP019084 vhCDR2
EIRLKSNNYATHYAEPVKG

SEQ ID NO: 10189 - protein, 11 aa, Artificial Sequence
  Description of Artificial Sequence: Synthetic peptide
  XENP019084 vhCDR3
YYGNYGGYFDV

SEQ ID NO: 10190 - protein, 11 aa, Artificial Sequence
  Description of Artificial Sequence: Synthetic peptide
  XENP019084 vlCDR1
RASQSVSNDVA

SEQ ID NO: 10191 - protein, 7 aa, Artificial Sequence
  Description of Artificial Sequence: Synthetic peptide
  XENP019084 vlCDR2
YASHRYT

SEQ ID NO: 10192 - protein, 9 aa, Artificial Sequence
  Description of Artificial Sequence: Synthetic peptide
  XENP019084 vlCDR3
QQDYSSPRT

SEQ ID NO: 10193 - protein, 249 aa, Artificial Sequence
  Description of Artificial Sequence: Synthetic polypeptide
  XENP019085 1G6_H1.260_L1_scFv(GKPGS)4
EVQLVESGGGLVKPGESLRLSCAASGFTFSNYWMNWVRQAPGKGLEWVGEIRLKSNNYATHYAEPVKGRFTISRDDSKSTVYLQMNSRKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10194 - protein, 122 aa, Artificial Sequence
  Description of Artificial Sequence: Synthetic polypeptide
  VH of XENP019085
EVQLVESGGGLVKPGESLRLSCAASGFTFSNYWMNWVRQAPGKGLEWVGEIRLKSNNYATHYAEPVKGRFTISRDDSKSTVYLQMNSRKTEDTAVYYCTRYYGNYGGYFDVWGAGTLVTVSS

SEQ ID NO: 10195 - protein, 107 aa, Artificial Sequence; identical to SEQ ID NO: 6247
  Description of Artificial Sequence: Synthetic polypeptide
  VL of XENP019085

SEQ ID NO: 10196 - protein, 5 aa, Artificial Sequence
  Description of Artificial Sequence: Synthetic peptide
  XENP019085 vhCDR1
NYWMN

SEQ ID NO: 10197 - protein, 19 aa, Artificial Sequence
  Description of Artificial Sequence: Synthetic peptide
  XENP019085 vhCDR2
EIRLKSNNYATHYAEPVKG

SEQ ID NO: 10198 - protein, 11 aa, Artificial Sequence
  Description of Artificial Sequence: Synthetic peptide
  XENP019085 vhCDR3
YYGNYGGYFDV

SEQ ID NO: 10199 - protein, 11 aa, Artificial Sequence
  Description of Artificial Sequence: Synthetic peptide
  XENP019085 vlCDR1
RASQSVSNDVA

SEQ ID NO: 10200 - protein, 7 aa, Artificial Sequence
  Description of Artificial Sequence: Synthetic peptide
  XENP019085 vlCDR2
YASHRYT

SEQ ID NO: 10201 - protein, 9 aa, Artificial Sequence
  Description of Artificial Sequence: Synthetic peptide
  XENP019085 vlCDR3
QQDYSSPRT

SEQ ID NO: 10202 - protein, 249 aa, Artificial Sequence
  Description of Artificial Sequence: Synthetic polypeptide
  XENP019086 1G6_H1.261_L1_scFv(GKPGS)4
EVQLVESGGGLVKPGGSLRLSCKASGFTFSNYWMNWVRQAPGKGLEWVGEIRLKSNNYATHYAEPVKGRFTISRDDSKDTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10203 - protein, 122 aa, Artificial Sequence
  Description of Artificial Sequence: Synthetic polypeptide
  VH of XENP019086
EVQLVESGGGLVKPGGSLRLSCKASGFTFSNYWMNWVRQAPGKGLEWVGEIRLKSNNYATHYAEPVKGRFTISRDDSKDTVYLQMNSLKTEDTAVYYCTRYYGNYGGYFDVWGAGTLVTVSS

SEQ ID NO: 10204 - protein, 107 aa, Artificial Sequence; identical to SEQ ID NO: 6247
  Description of Artificial Sequence: Synthetic polypeptide
  VL of XENP019086

SEQ ID NO: 10205 - protein, 5 aa, Artificial Sequence
  Description of Artificial Sequence: Synthetic peptide
  XENP019086 vhCDR1
NYWMN

SEQ ID NO: 10206 - protein, 19 aa, Artificial Sequence
  Description of Artificial Sequence: Synthetic peptide
  XENP019086 vhCDR2
EIRLKSNNYATHYAEPVKG

SEQ ID NO: 10207 - protein, 11 aa, Artificial Sequence
  Description of Artificial Sequence: Synthetic peptide
  XENP019086 vhCDR3
YYGNYGGYFDV

SEQ ID NO: 10208 - protein, 11 aa, Artificial Sequence
  Description of Artificial Sequence: Synthetic peptide
  XENP019086 vlCDR1
RASQSVSNDVA

SEQ ID NO: 10209 - protein, 7 aa, Artificial Sequence
  Description of Artificial Sequence: Synthetic peptide
  XENP019086 vlCDR2
YASHRYT

SEQ ID NO: 10210 - protein, 9 aa, Artificial Sequence
  Description of Artificial Sequence: Synthetic peptide
  XENP019086 vlCDR3
QQDYSSPRT

SEQ ID NO: 10211 - protein, 249 aa, Artificial Sequence
  Description of Artificial Sequence: Synthetic polypeptide
  XENP019087 1G6_H1.262_L1_scFv(GKPGS)4
EVQLVESGGGLVKPGESLRLSCAASGFTFSNYWMNWVRQAPGKGLEWVGEIRLKSNNYATHYAEPVKGRFTISRDDSKSTVYLQMNRLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10212 - protein, 122 aa, Artificial Sequence
  Description of Artificial Sequence: Synthetic polypeptide
  VH of XENP019087
EVQLVESGGGLVKPGESLRLSCAASGFTFSNYWMNWVRQAPGKGLEWVGEIRLKSNNYATHYAEPVKGRFTISRDDSKSTVYLQMNRLKTEDTAVYYCTRYYGNYGGYFDVWGAGTLVTVSS

SEQ ID NO: 10213 - protein, 107 aa, Artificial Sequence; identical to SEQ ID NO: 6247
  Description of Artificial Sequence: Synthetic polypeptide
  VL of XENP019087

SEQ ID NO: 10214 - protein, 5 aa, Artificial Sequence
  Description of Artificial Sequence: Synthetic peptide
  XENP019087 vhCDR1
NYWMN

SEQ ID NO: 10215 - protein, 19 aa, Artificial Sequence
  Description of Artificial Sequence: Synthetic peptide
  XENP019087 vhCDR2
EIRLKSNNYATHYAEPVKG

SEQ ID NO: 10216 - protein, 11 aa, Artificial Sequence
  Description of Artificial Sequence: Synthetic peptide
  XENP019087 vhCDR3
YYGNYGGYFDV

SEQ ID NO: 10217 - protein, 11 aa, Artificial Sequence
  Description of Artificial Sequence: Synthetic peptide
  XENP019087 vlCDR1
RASQSVSNDVA

SEQ ID NO: 10218 - protein, 7 aa, Artificial Sequence
  Description of Artificial Sequence: Synthetic peptide
  XENP019087 vlCDR2
YASHRYT

SEQ ID NO: 10219 - protein, 9 aa, Artificial Sequence
  Description of Artificial Sequence: Synthetic peptide
  XENP019087 vlCDR3
QQDYSSPRT

SEQ ID NO: 10220 - protein, 249 aa, Artificial Sequence
  Description of Artificial Sequence: Synthetic polypeptide
  XENP019088 1G6_H1.263_L1_scFv(GKPGS)4
EVQLVESGGGLVKPGGSLRLSCAASGFTFSNYWMNWVRQAPGKGLEWVGEIRLKSNNYATHYAEKVKGLFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10221 - protein, 122 aa, Artificial Sequence
  Description of Artificial Sequence: Synthetic polypeptide
  VH of XENP019088
EVQLVESGGGLVKPGGSLRLSCAASGFTFSNYWMNWVRQAPGKGLEWVGEIRLKSNNYATHYAEKVKGLFTISRDDSKSTVYLQMNSLKTEDTAVYYCTRYYGNYGGYFDVWGAGTLVTVSS

SEQ ID NO: 10222 - protein, 107 aa, Artificial Sequence; identical to SEQ ID NO: 6247
  Description of Artificial Sequence: Synthetic polypeptide
  VL of XENP019088

SEQ ID NO: 10223 - protein, 5 aa, Artificial Sequence
  Description of Artificial Sequence: Synthetic peptide
  XENP019088 vhCDR1
NYWMN

SEQ ID NO: 10224 - protein, 19 aa, Artificial Sequence
  Description of Artificial Sequence: Synthetic peptide
  XENP019088 vhCDR2
EIRLKSNNYATHYAEKVKG

SEQ ID NO: 10225 - protein, 11 aa, Artificial Sequence
  Description of Artificial Sequence: Synthetic peptide
  XENP019088 vhCDR3
YYGNYGGYFDV

SEQ ID NO: 10226 - protein, 11 aa, Artificial Sequence
  Description of Artificial Sequence: Synthetic peptide
  XENP019088 vlCDR1
RASQSVSNDVA

SEQ ID NO: 10227 - protein, 7 aa, Artificial Sequence
  Description of Artificial Sequence: Synthetic peptide
  XENP019088 vlCDR2
YASHRYT

SEQ ID NO: 10228 - protein, 9 aa, Artificial Sequence
  Description of Artificial Sequence: Synthetic peptide
  XENP019088 vlCDR3
QQDYSSPRT

SEQ ID NO: 10229 - protein, 249 aa, Artificial Sequence
  Description of Artificial Sequence: Synthetic polypeptide
  XENP019089 1G6_H1.264_L1_scFv(GKPGS)4
EVQLVESGGGLVKPGGSLRLSCKASGDTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10230 - protein, 122 aa, Artificial Sequence
  Description of Artificial Sequence: Synthetic polypeptide
  VH of XENP019089
EVQLVESGGGLVKPGGSLRLSCKASGDTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 10231 - protein, 107 aa, Artificial Sequence; identical to SEQ ID NO: 6247
  Description of Artificial Sequence: Synthetic polypeptide
  VL of XENP019089

SEQ ID NO: 10232 - protein, 5 aa, Artificial Sequence
  Description of Artificial Sequence: Synthetic peptide
  XENP019089 vhCDR1
NYWMN

SEQ ID NO: 10233 - protein, 19 aa, Artificial Sequence
  Description of Artificial Sequence: Synthetic peptide
  XENP019089 vhCDR2
EIRLKSNNYATHYAEPVKG

SEQ ID NO: 10234 - protein, 11 aa, Artificial Sequence
  Description of Artificial Sequence: Synthetic peptide
  XENP019089 vhCDR3
YYGNYGGYFDV

SEQ ID NO: 10235 - protein, 11 aa, Artificial Sequence
  Description of Artificial Sequence: Synthetic peptide
  XENP019089 vlCDR1
RASQSVSNDVA

SEQ ID NO: 10236 - protein, 7 aa, Artificial Sequence
  Description of Artificial Sequence: Synthetic peptide
  XENP019089 vlCDR2
YASHRYT

SEQ ID NO: 10237 - protein, 9 aa, Artificial Sequence
  Description of Artificial Sequence: Synthetic peptide
  XENP019089 vlCDR3
QQDYSSPRT

SEQ ID NO: 10238 - protein, 249 aa, Artificial Sequence
  Description of Artificial Sequence: Synthetic polypeptide
  XENP019090 1G6_H1.265_L1_scFv(GKPGS)4
EVQLVESGGGLVKPGESLRLSCAASGFTFSNYWMNWVRQAPGKGLEWVGEIRLKSNNYATHYAEPVKGRFTISRDDSKSTVYLKMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10239 - protein, 122 aa, Artificial Sequence
  Description of Artificial Sequence: Synthetic polypeptide
  VH of XENP019090
EVQLVESGGGLVKPGESLRLSCAASGFTFSNYWMNWVRQAPGKGLEWVGEIRLKSNNYATHYAEPVKGRFTISRDDSKSTVYLKMNSLKTEDTAVYYCTRYYGNYGGYFDVWGAGTLVTVSS

SEQ ID NO: 10240 - protein, 107 aa, Artificial Sequence; identical to SEQ ID NO: 6247
  Description of Artificial Sequence: Synthetic polypeptide
  VL of XENP019090

SEQ ID NO: 10241 - protein, 5 aa, Artificial Sequence
  Description of Artificial Sequence: Synthetic peptide
  XENP019090 vhCDR1
NYWMN

SEQ ID NO: 10242 - protein, 19 aa, Artificial Sequence
  Description of Artificial Sequence: Synthetic peptide
  XENP019090 vhCDR2
EIRLKSNNYATHYAEPVKG

SEQ ID NO: 10243 - protein, 11 aa, Artificial Sequence
  Description of Artificial Sequence: Synthetic peptide
  XENP019090 vhCDR3
YYGNYGGYFDV

SEQ ID NO: 10244 - protein, 11 aa, Artificial Sequence
  Description of Artificial Sequence: Synthetic peptide
  XENP019090 vlCDR1
RASQSVSNDVA

SEQ ID NO: 10245 - protein, 7 aa, Artificial Sequence
  Description of Artificial Sequence: Synthetic peptide
  XENP019090 vlCDR2
YASHRYT

SEQ ID NO: 10246 - protein, 9 aa, Artificial Sequence
  Description of Artificial Sequence: Synthetic peptide
  XENP019090 vlCDR3
QQDYSSPRT

SEQ ID NO: 10247 - protein, 249 aa, Artificial Sequence
  Description of Artificial Sequence: Synthetic polypeptide
  XENP019091 1G6_H1.266_L1_scFv(GKPGS)4
EVQLVESGGGLVKPGGSLRLSCAASGFTFSNYWMNWVRQAPGKGLEWVGEIRLKSNNYATHYAQPVKDRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10248 - protein, 122 aa, Artificial Sequence
  Description of Artificial Sequence: Synthetic polypeptide
  VH of XENP019091
EVQLVESGGGLVKPGGSLRLSCAASGFTFSNYWMNWVRQAPGKGLEWVGEIRLKSNNYATHYAQPVKDRFTISRDDSKSTVYLQMNSLKTEDTAVYYCTRYYGNYGGYFDVWGAGTLVTVSS

SEQ ID NO: 10249 - protein, 107 aa, Artificial Sequence; identical to SEQ ID NO: 6247
  Description of Artificial Sequence: Synthetic polypeptide
  VL of XENP019091

SEQ ID NO: 10250 - protein, 5 aa, Artificial Sequence
  Description of Artificial Sequence: Synthetic peptide
  XENP019091 vhCDR1
NYWMN

SEQ ID NO: 10251 - protein, 19 aa, Artificial Sequence
  Description of Artificial Sequence: Synthetic peptide
  XENP019091 vhCDR2
EIRLKSNNYATHYAQPVKD

SEQ ID NO: 10252 - protein, 11 aa, Artificial Sequence
  Description of Artificial Sequence: Synthetic peptide
  XENP019091 vhCDR3
YYGNYGGYFDV

SEQ ID NO: 10253 - protein, 11 aa, Artificial Sequence
  Description of Artificial Sequence: Synthetic peptide
  XENP019091 vlCDR1
RASQSVSNDVA

SEQ ID NO: 10254 - protein, 7 aa, Artificial Sequence
  Description of Artificial Sequence: Synthetic peptide
  XENP019091 vlCDR2
YASHRYT

SEQ ID NO: 10255 - protein, 9 aa, Artificial Sequence
  Description of Artificial Sequence: Synthetic peptide
  XENP019091 vlCDR3
QQDYSSPRT

SEQ ID NO: 10256 - protein, 249 aa, Artificial Sequence
  Description of Artificial Sequence: Synthetic polypeptide
  XENP019092 1G6_H1.267_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLEMNSRKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10257 - protein, 122 aa, Artificial Sequence
  Description of Artificial Sequence: Synthetic polypeptide
  VH of XENP019092
EVQLVESGGGLVKPGGSLRLSCAASGFTFSNYWMNWVRQAPGKGLEWVGEIRLKSNNYATHYAEPVKGRFTISRDDSKSTVYLEMNSRKTEDTAVYYCTRYYGNYGGYFDVWGAGTLVTVSS

SEQ ID NO: 10258 - protein, 107 aa, Artificial Sequence; identical to SEQ ID NO: 6247
  Description of Artificial Sequence: Synthetic polypeptide
  VL of XENP019092

SEQ ID NO: 10259 - protein, 5 aa, Artificial Sequence
  Description of Artificial Sequence: Synthetic peptide
  XENP019092 vhCDR1
NYWMN

SEQ ID NO: 10260 - protein, 19 aa, Artificial Sequence
  Description of Artificial Sequence: Synthetic peptide
  XENP019092 vhCDR2
EIRLKSNNYATHYAEPVKG

SEQ ID NO: 10261 - protein, 11 aa, Artificial Sequence
  Description of Artificial Sequence: Synthetic peptide
  XENP019092 vhCDR3
YYGNYGGYFDV

SEQ ID NO: 10262 - protein, 11 aa, Artificial Sequence
  Description of Artificial Sequence: Synthetic peptide
  XENP019092 vlCDR1
RASQSVSNDVA

SEQ ID NO: 10263 - protein, 7 aa, Artificial Sequence
  Description of Artificial Sequence: Synthetic peptide
  XENP019092 vlCDR2
YASHRYT

SEQ ID NO: 10264 - protein, 9 aa, Artificial Sequence
  Description of Artificial Sequence: Synthetic peptide
  XENP019092 vlCDR3
QQDYSSPRT

SEQ ID NO: 10265 - protein, 249 aa, Artificial Sequence
  Description of Artificial Sequence: Synthetic polypeptide
  XENP019093 1G6_H1.268_L1_scFv(GKPGS)4
EVQLVESGGGLVKPGESLRLSCAASGFTFSNYWMNWVRQAPGKGLEWVGEIRLKSNNYATHYAEPVKGRFTISRDDSKSTVYLQMRSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10266 - protein, 122 aa, Artificial Sequence
  Description of Artificial Sequence: Synthetic polypeptide
  VH of XENP019093
EVQLVESGGGLVKPGESLRLSCAASGFTFSNYWMNWVRQAPGKGLEWVGEIRLKSNNYATHYAEPVKGRFTISRDDSKSTVYLQMRSLKTEDTAVYYCTRYYGNYGGYFDVWGAGTLVTVSS

SEQ ID NO: 10267 - protein, 107 aa, Artificial Sequence; identical to SEQ ID NO: 6247
  Description of Artificial Sequence: Synthetic polypeptide
  VL of XENP019093

SEQ ID NO: 10268 - protein, 5 aa, Artificial Sequence
  Description of Artificial Sequence: Synthetic peptide
  XENP019093 vhCDR1
NYWMN

SEQ ID NO: 10269 - protein, 19 aa, Artificial Sequence
  Description of Artificial Sequence: Synthetic peptide
  XENP019093 vhCDR2
EIRLKSNNYATHYAEPVKG

SEQ ID NO: 10270 - protein, 11 aa, Artificial Sequence
  Description of Artificial Sequence: Synthetic peptide
  XENP019093 vhCDR3
YYGNYGGYFDV

SEQ ID NO: 10271 - protein, 11 aa, Artificial Sequence
  Description of Artificial Sequence: Synthetic peptide
  XENP019093 vlCDR1
RASQSVSNDVA

SEQ ID NO: 10272 - protein, 7 aa, Artificial Sequence
  Description of Artificial Sequence: Synthetic peptide
  XENP019093 vlCDR2
YASHRYT

SEQ ID NO: 10273 - protein, 9 aa, Artificial Sequence
  Description of Artificial Sequence: Synthetic peptide
  XENP019093 vlCDR3
QQDYSSPRT

SEQ ID NO: 10274 - protein, 249 aa, Artificial Sequence
  Description of Artificial Sequence: Synthetic polypeptide
  XENP019094 1G6_H1.269_L1_scFv(GKPGS)4
EVQLVESGGGLVKPGGSLRLSCAASGFTFSNFWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10275 - protein, 122 aa, Artificial Sequence
  Description of Artificial Sequence: Synthetic polypeptide
  VH of XENP019094
EVQLVESGGGLVKPGGSLRLSCAASGFTFSNFWMNWVRQAPGKGLEWVGEIRLYSNNYATHYAEPVKGRFTISRDDSKSTVYLQMNSLKTEDTAVYYCTRYYGNYGGYFDVWGAGTLVTVSS

SEQ ID NO: 10276 - protein, 107 aa, Artificial Sequence; identical to SEQ ID NO: 6247
  Description of Artificial Sequence: Synthetic polypeptide
  VL of XENP019094

SEQ ID NO: 10277 - protein, 5 aa, Artificial Sequence
  Description of Artificial Sequence: Synthetic peptide
  XENP019094 vhCDR1
NFWMN

SEQ ID NO: 10278 - protein, 19 aa, Artificial Sequence
  Description of Artificial Sequence: Synthetic peptide
  XENP019094 vhCDR2
EIRLYSNNYATHYAEPVKG

SEQ ID NO: 10279 - protein, 11 aa, Artificial Sequence
  Description of Artificial Sequence: Synthetic peptide
  XENP019094 vhCDR3
YYGNYGGYFDV

SEQ ID NO: 10280 - protein, 11 aa, Artificial Sequence
  Description of Artificial Sequence: Synthetic peptide
  XENP019094 vlCDR1
RASQSVSNDVA

SEQ ID NO: 10281 - protein, 7 aa, Artificial Sequence
  Description of Artificial Sequence: Synthetic peptide
  XENP019094 vlCDR2
YASHRYT

SEQ ID NO: 10282 - protein, 9 aa, Artificial Sequence
  Description of Artificial Sequence: Synthetic peptide
  XENP019094 vlCDR3
QQDYSSPRT

SEQ ID NO: 10283 - protein, 249 aa, Artificial Sequence
  Description of Artificial Sequence: Synthetic polypeptide
  XENP019095 1G6_H1.270_L1_scFv(GKPGS)4
EVQLVESGGGLVKPGGSLRLSCAASGFTFSNYWMNWVRQAPGKGLEWVGEIRWYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10284 - protein, 122 aa, Artificial Sequence
  Description of Artificial Sequence: Synthetic polypeptide
  VH of XENP019095
EVQLVESGGGLVKPGGSLRLSCAASGFTFSNYWMNWVRQAPGKGLEWVGEIRWYSNNYATHYAEPVKGRFTISRDDSKSTVYLQMNSLKTEDTAVYYCTRYYGNYGGYFDVWGAGTLVTVSS

SEQ ID NO: 10285 - protein, 107 aa, Artificial Sequence; identical to SEQ ID NO: 6247
  Description of Artificial Sequence: Synthetic polypeptide
  VL of XENP019095

SEQ ID NO: 10286 - protein, 5 aa, Artificial Sequence
  Description of Artificial Sequence: Synthetic peptide
  XENP019095 vhCDR1
NYWMN

SEQ ID NO: 10287 - protein, 19 aa, Artificial Sequence
  Description of Artificial Sequence: Synthetic peptide
  XENP019095 vhCDR2
EIRWYSNNYATHYAEPVKG

SEQ ID NO: 10288 - protein, 11 aa, Artificial Sequence
  Description of Artificial Sequence: Synthetic peptide
  XENP019095 vhCDR3
YYGNYGGYFDV

SEQ ID NO: 10289 - protein, 11 aa, Artificial Sequence
  Description of Artificial Sequence: Synthetic peptide
  XENP019095 vlCDR1
RASQSVSNDVA

SEQ ID NO: 10290 - protein, 7 aa, Artificial Sequence
  Description of Artificial Sequence: Synthetic peptide
  XENP019095 vlCDR2
YASHRYT

SEQ ID NO: 10291 - protein, 9 aa, Artificial Sequence
  Description of Artificial Sequence: Synthetic peptide
  XENP019095 vlCDR3
QQDYSSPRT

SEQ ID NO: 10292 - protein, 249 aa, Artificial Sequence
  Description of Artificial Sequence: Synthetic polypeptide
  XENP019096 1G6_H1.271_L1_scFv(GKPGS)4
EVQLVESGGGLVKPGGSLRLSCAASGFTFSNYWMNWVRQAPGKGLEWVGEIRLYSNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10293 - protein, 122 aa, Artificial Sequence
  Description of Artificial Sequence: Synthetic polypeptide
  VH of XENP019096
EVQLVESGGGLVKPGGSLRLSCAASGFTFSNYWMNWVRQAPGKGLEWVGEIRLYSNNYATHYAEPVKGRFTISRDDSKSTLYLQMNSLKTEDTAVYYCTRYYGNYGGYFDVWGAGTLVTVSS

SEQ ID NO: 10294 - protein, 107 aa, Artificial Sequence; identical to SEQ ID NO: 6247
  Description of Artificial Sequence: Synthetic polypeptide
  VL of XENP019096

SEQ ID NO: 10295 - protein, 5 aa, Artificial Sequence
  Description of Artificial Sequence: Synthetic peptide
  XENP019096 vhCDR1
NYWMN

SEQ ID NO: 10296 - protein, 19 aa, Artificial Sequence
  Description of Artificial Sequence: Synthetic peptide
  XENP019096 vhCDR2
EIRLYSNNYATHYAEPVKG

SEQ ID NO: 10297 - protein, 11 aa, Artificial Sequence
  Description of Artificial Sequence: Synthetic peptide
  XENP019096 vhCDR3
YYGNYGGYFDV

SEQ ID NO: 10298 - protein, 11 aa, Artificial Sequence
  Description of Artificial Sequence: Synthetic peptide
  XENP019096 vlCDR1
RASQSVSNDVA

SEQ ID NO: 10299 - protein, 7 aa, Artificial Sequence
  Description of Artificial Sequence: Synthetic peptide
  XENP019096 vlCDR2
YASHRYT

SEQ ID NO: 10300 - protein, 9 aa, Artificial Sequence
  Description of Artificial Sequence: Synthetic peptide
  XENP019096 vlCDR3
QQDYSSPRT

SEQ ID NO: 10301 - protein, 249 aa, Artificial Sequence
  Description of Artificial Sequence: Synthetic polypeptide
  XENP019101 1G6_H1.272_L1_scFv(GKPGS)4
EVQLVESGGGLVKPGGSLRLSCAASGFTFSNFWMNWVRQAPGKGLEWVGEIRLYSNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10302 - protein, 122 aa, Artificial Sequence
  Description of Artificial Sequence: Synthetic polypeptide
  VH of XENP019101
EVQLVESGGGLVKPGGSLRLSCAASGFTFSNFWMNWVRQAPGKGLEWVGEIRLYSNNYATHYAEPVKGRFTISRDDSKSTLYLQMNSLKTEDTAVYYCTRYYGNYGGYFDVWGAGTLVTVSS

SEQ ID NO: 10303 - protein, 107 aa, Artificial Sequence; identical to SEQ ID NO: 6247
  Description of Artificial Sequence: Synthetic polypeptide
  VL of XENP019101

SEQ ID NO: 10304 - protein, 5 aa, Artificial Sequence
  Description of Artificial Sequence: Synthetic peptide
  XENP019101 vhCDR1
NFWMN

SEQ ID NO: 10305 - protein, 19 aa, Artificial Sequence
  Description of Artificial Sequence: Synthetic peptide
  XENP019101 vhCDR2
EIRLYSNNYATHYAEPVKG

SEQ ID NO: 10306 - protein, 11 aa, Artificial Sequence
  Description of Artificial Sequence: Synthetic peptide
  XENP019101 vhCDR3
YYGNYGGYFDV

SEQ ID NO: 10307 - protein, 11 aa, Artificial Sequence
  Description of Artificial Sequence: Synthetic peptide
  XENP019101 vlCDR1
RASQSVSNDVA

SEQ ID NO: 10308 - protein, 7 aa, Artificial Sequence
  Description of Artificial Sequence: Synthetic peptide
  XENP019101 vlCDR2
YASHRYT

SEQ ID NO: 10309 - protein, 9 aa, Artificial Sequence
  Description of Artificial Sequence: Synthetic peptide
  XENP019101 vlCDR3
QQDYSSPRT

SEQ ID NO: 10310 - protein, 249 aa, Artificial Sequence
  Description of Artificial Sequence: Synthetic polypeptide
  XENP019102 1G6_H1.273_L1_scFv(GKPGS)4
EVQLVESGGGLVKPGGSLRLSCAASGFTFSNFWMNWVRQAPGKGLEWVGEIRWKSNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10311 - protein, 122 aa, Artificial Sequence
  Description of Artificial Sequence: Synthetic polypeptide
  VH of XENP019102
EVQLVESGGGLVKPGGSLRLSCAASGFTFSNFWMNWVRQAPGKGLEWVGEIRWKSNNYATHYAEPVKGRFTISRDDSKSTLYLQMNSLKTEDTAVYYCTRYYGNYGGYFDVWGAGTLVTVSS

SEQ ID NO: 10312 - protein, 107 aa, Artificial Sequence; identical to SEQ ID NO: 6247
  Description of Artificial Sequence: Synthetic polypeptide
  VL of XENP019102

SEQ ID NO: 10313 - protein, 5 aa, Artificial Sequence
  Description of Artificial Sequence: Synthetic peptide
  XENP019102 vhCDR1
NFWMN

SEQ ID NO: 10314 - protein, 19 aa, Artificial Sequence
  Description of Artificial Sequence: Synthetic peptide
  XENP019102 vhCDR2
EIRWKSNNYATHYAEPVKG

SEQ ID NO: 10315 - protein, 11 aa, Artificial Sequence
  Description of Artificial Sequence: Synthetic peptide
  XENP019102 vhCDR3
YYGNYGGYFDV

SEQ ID NO: 10316 - protein, 11 aa, Artificial Sequence
  Description of Artificial Sequence: Synthetic peptide
  XENP019102 vlCDR1
RASQSVSNDVA

SEQ ID NO: 10317 - protein, 7 aa, Artificial Sequence
  Description of Artificial Sequence: Synthetic peptide
  XENP019102 vlCDR2
YASHRYT

SEQ ID NO: 10318 - protein, 9 aa, Artificial Sequence
  Description of Artificial Sequence: Synthetic peptide
  XENP019102 vlCDR3
QQDYSSPRT

SEQ ID NO: 10319 - protein, 249 aa, Artificial Sequence
  Description of Artificial Sequence: Synthetic polypeptide
  XENP019103 1G6_H1.274_L1_scFv(GKPGS)4
EVQLVESGGGLVKPGGSLRLSCAASGFTFSNFWMNWVRQAPGKGLEWVGEIRLKKNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10320 - protein, 122 aa, Artificial Sequence
  Description of Artificial Sequence: Synthetic polypeptide
  VH of XENP019103
EVQLVESGGGLVKPGGSLRLSCAASGFTFSNFWMNWVRQAPGKGLEWVGEIRLKKNNYATHYAEPVKGRFTISRDDSKSTLYLQMNSLKTEDTAVYYCTRYYGNYGGYFDVWGAGTLVTVSS

SEQ ID NO: 10321 - protein, 107 aa, Artificial Sequence; identical to SEQ ID NO: 6247
  Description of Artificial Sequence: Synthetic polypeptide
  VL of XENP019103

SEQ ID NO: 10322 - protein, 5 aa, Artificial Sequence
  Description of Artificial Sequence: Synthetic peptide
  XENP019103 vhCDR1
NFWMN

SEQ ID NO: 10323 - protein, 19 aa, Artificial Sequence
  Description of Artificial Sequence: Synthetic peptide
  XENP019103 vhCDR2
EIRLKKNNYATHYAEPVKG

SEQ ID NO: 10324 - protein, 11 aa, Artificial Sequence
  Description of Artificial Sequence: Synthetic peptide
  XENP019103 vhCDR3
YYGNYGGYFDV

SEQ ID NO: 10325 - protein, 11 aa, Artificial Sequence
  Description of Artificial Sequence: Synthetic peptide
  XENP019103 vlCDR1
RASQSVSNDVA

SEQ ID NO: 10326 - protein, 7 aa, Artificial Sequence
  Description of Artificial Sequence: Synthetic peptide
  XENP019103 vlCDR2
YASHRYT

SEQ ID NO: 10327 - protein, 9 aa, Artificial Sequence
  Description of Artificial Sequence: Synthetic peptide
  XENP019103 vlCDR3
QQDYSSPRT

SEQ ID NO: 10328 - protein, 249 aa, Artificial Sequence
  Description of Artificial Sequence: Synthetic polypeptide
  XENP019104 1G6_H1.275_L1_scFv(GKPGS)4
EVQLVESGGGLVKPGGSLRLSCAASGFTFSNFWMNWVRQAPGKGLEWVGEIRWYSNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10329 - protein, 122 aa, Artificial Sequence
  Description of Artificial Sequence: Synthetic polypeptide
  VH of XENP019104
EVQLVESGGGLVKPGGSLRLSCAASGFTFSNFWMNWVRQAPGKGLEWVGEIRWYSNNYATHYAEPVKGRFTISRDDSKSTLYLQMNSLKTEDTAVYYCTRYYGNYGGYFDVWGAGTLVTVSS

SEQ ID NO: 10330 - protein, 107 aa, Artificial Sequence; identical to SEQ ID NO: 6247
  Description of Artificial Sequence: Synthetic polypeptide
  VL of XENP019104

SEQ ID NO: 10331 - protein, 5 aa, Artificial Sequence
  Description of Artificial Sequence: Synthetic peptide
  XENP019104 vhCDR1
NFWMN

SEQ ID NO: 10332 - protein, 19 aa, Artificial Sequence
  Description of Artificial Sequence: Synthetic peptide
  XENP019104 vhCDR2
EIRWYSNNYATHYAEPVKG

SEQ ID NO: 10333 - protein, 11 aa, Artificial Sequence
  Description of Artificial Sequence: Synthetic peptide
  XENP019104 vhCDR3
YYGNYGGYFDV

SEQ ID NO: 10334 - protein, 11 aa, Artificial Sequence
  Description of Artificial Sequence: Synthetic peptide
  XENP019104 vlCDR1
RASQSVSNDVA

SEQ ID NO: 10335 - protein, 7 aa, Artificial Sequence
  Description of Artificial Sequence: Synthetic peptide
  XENP019104 vlCDR2
YASHRYT

SEQ ID NO: 10336 - protein, 9 aa, Artificial Sequence
  Description of Artificial Sequence: Synthetic peptide
  XENP019104 vlCDR3
QQDYSSPRT

SEQ ID NO: 10337 - protein, 249 aa, Artificial Sequence
  Description of Artificial Sequence: Synthetic polypeptide
  XENP019105 1G6_H1.276_L1_scFv(GKPGS)4
EVQLVESGGGLVQPGGSLKLSCAASGFTFSNYWMNWVRQAPGKGLEWVGEIRLKSNNYATHYAASVKGRFTISRDDSKSTLYLQMNSLKTEDTAVYYCTRYYGNYGGYFDVWGQGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10338 - protein, 122 aa, Artificial Sequence
  Description of Artificial Sequence: Synthetic polypeptide
  VH of XENP019105
EVQLVESGGGLVQPGGSLKLSCAASGFTFSNYWMNWVRQAPGKGLEWVGEIRLKSNNYATHYAASVKGRFTISRDDSKSTLYLQMNSLKTEDTAVYYCTRYYGNYGGYFDVWGQGTLVTVSS

SEQ ID NO: 10339 - protein, 107 aa, Artificial Sequence; identical to SEQ ID NO: 6247
  Description of Artificial Sequence: Synthetic polypeptide
  VL of XENP019105

SEQ ID NO: 10340 - protein, 5 aa, Artificial Sequence
  Description of Artificial Sequence: Synthetic peptide
  XENP019105 vhCDR1
NYWMN

SEQ ID NO: 10341 - protein, 19 aa, Artificial Sequence
  Description of Artificial Sequence: Synthetic peptide
  XENP019105 vhCDR2
EIRLKSNNYATHYAASVKG

SEQ ID NO: 10342 - protein, 11 aa, Artificial Sequence
  Description of Artificial Sequence: Synthetic peptide
  XENP019105 vhCDR3
YYGNYGGYFDV

SEQ ID NO: 10343 - protein, 11 aa, Artificial Sequence
  Description of Artificial Sequence: Synthetic peptide
  XENP019105 vlCDR1
RASQSVSNDVA

SEQ ID NO: 10344 - protein, 7 aa, Artificial Sequence
  Description of Artificial Sequence: Synthetic peptide
  XENP019105 vlCDR2
YASHRYT

SEQ ID NO: 10345 - protein, 9 aa, Artificial Sequence
  Description of Artificial Sequence: Synthetic peptide
  XENP019105 vlCDR3
QQDYSSPRT

SEQ ID NO: 10346 - protein, 249 aa, Artificial Sequence
  Description of Artificial Sequence: Synthetic polypeptide
  XENP019106 1G6_H1.277_L1_scFv(GKPGS)4
EVQLVESGGGLVKPGGSLKLSCAASGFTFSNYWMNWVRQAPGKGLEWVGEIRLKSNNYATHYADSVKGRFTISRDDSKSTLYLQMNSLKTEDTAVYYCTRYYGNYGGYFDVWGQGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10347 - protein, 122 aa, Artificial Sequence
  Description of Artificial Sequence: Synthetic polypeptide
  VH of XENP019106
EVQLVESGGGLVKPGGSLKLSCAASGFTFSNYWMNWVRQAPGKGLEWVGEIRLKSNNYATHYADSVKGRFTISRDDSKSTLYLQMNSLKTEDTAVYYCTRYYGNYGGYFDVWGQGTLVTVSS

SEQ ID NO: 10348 - protein, 107 aa, Artificial Sequence; identical to SEQ ID NO: 6247
  Description of Artificial Sequence: Synthetic polypeptide
  VL of XENP019106

SEQ ID NO: 10349 - protein, 5 aa, Artificial Sequence
  Description of Artificial Sequence: Synthetic peptide
  XENP019106 vhCDR1
NYWMN

SEQ ID NO: 10350 - protein, 19 aa, Artificial Sequence
  Description of Artificial Sequence: Synthetic peptide
  XENP019106 vhCDR2
EIRLKSNNYATHYADSVKG

SEQ ID NO: 10351 - protein, 11 aa, Artificial Sequence
  Description of Artificial Sequence: Synthetic peptide
  XENP019106 vhCDR3
YYGNYGGYFDV

SEQ ID NO: 10352 - protein, 11 aa, Artificial Sequence
  Description of Artificial Sequence: Synthetic peptide
  XENP019106 vlCDR1
RASQSVSNDVA

SEQ ID NO: 10353 - protein, 7 aa, Artificial Sequence
  Description of Artificial Sequence: Synthetic peptide
  XENP019106 vlCDR2
YASHRYT

SEQ ID NO: 10354 - protein, 9 aa, Artificial Sequence
  Description of Artificial Sequence: Synthetic peptide
  XENP019106 vlCDR3
QQDYSSPRT

SEQ ID NO: 10355 - protein, 249 aa, Artificial Sequence
  Description of Artificial Sequence: Synthetic polypeptide
  XENP019107 1G6_H1_L1.146_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLAVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10356 - protein, 122 aa, Artificial Sequence; identical to SEQ ID NO: 6246
  Description of Artificial Sequence: Synthetic polypeptide
  VH of XENP019107

SEQ ID NO: 10357 - protein, 107 aa, Artificial Sequence
  Description of Artificial Sequence: Synthetic polypeptide
  VL of XENP019107
SIVMTQSPATLAVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10358 - protein, 5 aa, Artificial Sequence
  Description of Artificial Sequence: Synthetic peptide
  XENP019107 vhCDR1
NYWMN

SEQ ID NO: 10359 - protein, 19 aa, Artificial Sequence
  Description of Artificial Sequence: Synthetic peptide
  XENP019107 vhCDR2
EIRLKSNNYATHYAEPVKG

SEQ ID NO: 10360 - protein, 11 aa, Artificial Sequence
  Description of Artificial Sequence: Synthetic peptide
  XENP019107 vhCDR3
YYGNYGGYFDV

SEQ ID NO: 10361 - protein, 11 aa, Artificial Sequence
  Description of Artificial Sequence: Synthetic peptide
  XENP019107 vlCDR1
RASQSVSNDVA

SEQ ID NO: 10362 - protein, 7 aa, Artificial Sequence
  Description of Artificial Sequence: Synthetic peptide
  XENP019107 vlCDR2
YASHRYT

SEQ ID NO: 10363 - protein, 9 aa, Artificial Sequence
  Description of Artificial Sequence: Synthetic peptide
  XENP019107 vlCDR3
QQDYSSPRT

SEQ ID NO: 10364 - protein, 249 aa, Artificial Sequence
  Description of Artificial Sequence: Synthetic polypeptide
  XENP019108 1G6_H1_L1.147_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLPVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10365 - protein, 122 aa, Artificial Sequence; identical to SEQ ID NO: 6246
  Description of Artificial Sequence: Synthetic polypeptide
  VH of XENP019108

SEQ ID NO: 10366 - protein, 107 aa, Artificial Sequence
  Description of Artificial Sequence: Synthetic polypeptide
  VL of XENP019108
SIVMTQSPATLPVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10367 - protein, 5 aa, Artificial Sequence
  Description of Artificial Sequence: Synthetic peptide
  XENP019108 vhCDR1
NYWMN

SEQ ID NO: 10368 - protein, 19 aa, Artificial Sequence
  Description of Artificial Sequence: Synthetic peptide
  XENP019108 vhCDR2
EIRLKSNNYATHYAEPVKG

SEQ ID NO: 10369 - protein, 11 aa, Artificial Sequence
  Description of Artificial Sequence: Synthetic peptide
  XENP019108 vhCDR3
YYGNYGGYFDV

SEQ ID NO: 10370 - protein, 11 aa, Artificial Sequence
  Description of Artificial Sequence: Synthetic peptide
  XENP019108 vlCDR1
RASQSVSNDVA

SEQ ID NO: 10371 - protein, 7 aa, Artificial Sequence
  Description of Artificial Sequence: Synthetic peptide
  XENP019108 vlCDR2
YASHRYT

SEQ ID NO: 10372 - protein, 9 aa, Artificial Sequence
  Description of Artificial Sequence: Synthetic peptide
  XENP019108 vlCDR3
QQDYSSPRT

SEQ ID NO: 10373 - protein, 249 aa, Artificial Sequence
  Description of Artificial Sequence: Synthetic polypeptide
  XENP019109 1G6_H1_L1.148_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSASPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10374 - protein, 122 aa, Artificial Sequence; identical to SEQ ID NO: 6246
  Description of Artificial Sequence: Synthetic polypeptide
  VH of XENP019109

SEQ ID NO: 10375 - protein, 107 aa, Artificial Sequence
  Description of Artificial Sequence: Synthetic polypeptide
  VL of XENP019109
SIVMTQSPATLSASPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10376 - protein, 5 aa, Artificial Sequence
  Description of Artificial Sequence: Synthetic peptide
  XENP019109 vhCDR1
NYWMN

SEQ ID NO: 10377 - protein, 19 aa, Artificial Sequence
  Description of Artificial Sequence: Synthetic peptide
  XENP019109 vhCDR2
EIRLKSNNYATHYAEPVKG

SEQ ID NO: 10378 - protein, 11 aa, Artificial Sequence
  Description of Artificial Sequence: Synthetic peptide
  XENP019109 vhCDR3
YYGNYGGYFDV

SEQ ID NO: 10379 - protein, 11 aa, Artificial Sequence
  Description of Artificial Sequence: Synthetic peptide
  XENP019109 vlCDR1
RASQSVSNDVA

SEQ ID NO: 10380 - protein, 7 aa, Artificial Sequence
  Description of Artificial Sequence: Synthetic peptide
  XENP019109 vlCDR2
YASHRYT

SEQ ID NO: 10381 - protein, 9 aa, Artificial Sequence
  Description of Artificial Sequence: Synthetic peptide
  XENP019109 vlCDR3
QQDYSSPRT

SEQ ID NO: 10382 - protein, 249 aa, Artificial Sequence
  Description of Artificial Sequence: Synthetic polypeptide
  XENP019110 1G6_H1_L1.149_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERASLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10383 - protein, 122 aa, Artificial Sequence; identical to SEQ ID NO: 6246
  Description of Artificial Sequence: Synthetic polypeptide
  VH of XENP019110

SEQ ID NO: 10384 - protein, 107 aa, Artificial Sequence
  Description of Artificial Sequence: Synthetic polypeptide
  VL of XENP019110
SIVMTQSPATLSVSPGERASLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10385 - protein, 5 aa, Artificial Sequence
  Description of Artificial Sequence: Synthetic peptide
  XENP019110 vhCDR1
NYWMN

SEQ ID NO: 10386 - protein, 19 aa, Artificial Sequence
  Description of Artificial Sequence: Synthetic peptide
  XENP019110 vhCDR2
EIRLKSNNYATHYAEPVKG

SEQ ID NO: 10387 - protein, 11 aa, Artificial Sequence
  Description of Artificial Sequence: Synthetic peptide
  XENP019110 vhCDR3
YYGNYGGYFDV

SEQ ID NO: 10388 - protein, 11 aa, Artificial Sequence
  Description of Artificial Sequence: Synthetic peptide
  XENP019110 vlCDR1
RASQSVSNDVA

SEQ ID NO: 10389 - protein, 7 aa, Artificial Sequence
  Description of Artificial Sequence: Synthetic peptide
  XENP019110 vlCDR2
YASHRYT

SEQ ID NO: 10390 - protein, 9 aa, Artificial Sequence
  Description of Artificial Sequence: Synthetic peptide
  XENP019110 vlCDR3
QQDYSSPRT

SEQ ID NO: 10391 - protein, 249 aa, Artificial Sequence
  Description of Artificial Sequence: Synthetic polypeptide
  XENP019111 1G6_H1_L1.150_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLKCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10392 - protein, 122 aa, Artificial Sequence; identical to SEQ ID NO: 6246
  Description of Artificial Sequence: Synthetic polypeptide
  VH of XENP019111

SEQ ID NO: 10393 - protein, 107 aa, Artificial Sequence
  Description of Artificial Sequence: Synthetic polypeptide
  VL of XENP019111
SIVMTQSPATLSVSPGERATLKCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10394 - protein, 5 aa, Artificial Sequence
  Description of Artificial Sequence: Synthetic peptide
  XENP019111 vhCDR1
NYWMN

SEQ ID NO: 10395 - protein, 19 aa, Artificial Sequence
  Description of Artificial Sequence: Synthetic peptide
  XENP019111 vhCDR2
EIRLKSNNYATHYAEPVKG

SEQ ID NO: 10396 - protein, 11 aa, Artificial Sequence
  Description of Artificial Sequence: Synthetic peptide
  XENP019111 vhCDR3
YYGNYGGYFDV

SEQ ID NO: 10397 - protein, 11 aa, Artificial Sequence
  Description of Artificial Sequence: Synthetic peptide
  XENP019111 vlCDR1
RASQSVSNDVA

SEQ ID NO: 10398 - protein, 7 aa, Artificial Sequence
  Description of Artificial Sequence: Synthetic peptide
  XENP019111 vlCDR2
YASHRYT

SEQ ID NO: 10399 - protein, 9 aa, Artificial Sequence
  Description of Artificial Sequence: Synthetic peptide
  XENP019111 vlCDR3
QQDYSSPRT

SEQ ID NO: 10400 - protein, 249 aa, Artificial Sequence
  Description of Artificial Sequence: Synthetic polypeptide
  XENP019112 1G6_H1_L1.151_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPEQSPRLLINYASHRYTGVPDRFTGSGYGTEFTLTISSLQSEDFAVYFCQQDYSSPRTFGGGTKVEIK

SEQ ID NO: 10401 - protein, 122 aa, Artificial Sequence; identical to SEQ ID NO: 6246
  Description of Artificial Sequence: Synthetic polypeptide
  VH of XENP019112

SEQ ID NO: 10402 - protein, 107 aa, Artificial Sequence
  Description of Artificial Sequence: Synthetic polypeptide
  VL of XENP019112
SIVMTQSPATLSVSPGERATLSCRASQSVSNDVAWYQQKPEQSPRLLINYASHRYTGVPDRFTGSGYGTEFTLTISSLQSEDFAVYFCQQDYSSPRTFGGGTKVEIK

SEQ ID NO: 10403 - protein, 5 aa, Artificial Sequence
  Description of Artificial Sequence: Synthetic peptide
  XENP019112 vhCDR1
NYWMN

SEQ ID NO: 10404 - protein, 19 aa, Artificial Sequence
  Description of Artificial Sequence: Synthetic peptide
  XENP019112 vhCDR2
EIRLKSNNYATHYAEPVKG

SEQ ID NO: 10405 - protein, 11 aa, Artificial Sequence
  Description of Artificial Sequence: Synthetic peptide
  XENP019112 vhCDR3
YYGNYGGYFDV

SEQ ID NO: 10406 - protein, 11 aa, Artificial Sequence
  Description of Artificial Sequence: Synthetic peptide
  XENP019112 vlCDR1
RASQSVSNDVA

SEQ ID NO: 10407 - protein, 7 aa, Artificial Sequence
  Description of Artificial Sequence: Synthetic peptide
  XENP019112 vlCDR2
YASHRYT

SEQ ID NO: 10408 - protein, 9 aa, Artificial Sequence
  Description of Artificial Sequence: Synthetic peptide
  XENP019112 vlCDR3
QQDYSSPRT

SEQ ID NO: 10409 - protein, 249 aa, Artificial Sequence
  Description of Artificial Sequence: Synthetic polypeptide
  XENP019113 1G6_H1_L1.152_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGESPRLLINYASHRYTGVPDRFTGSGYGTEFTLTISSLQSEDFAVYFCQQDYSSPRTFGGGTKVEIK

SEQ ID NO: 10410 - protein, 122 aa, Artificial Sequence; identical to SEQ ID NO: 6246
  Description of Artificial Sequence: Synthetic polypeptide
  VH of XENP019113

SEQ ID NO: 10411 - protein, 107 aa, Artificial Sequence
  Description of Artificial Sequence: Synthetic polypeptide
  VL of XENP019113
SIVMTQSPATLSVSPGERATLSCRASQSVSNDVAWYQQKPGESPRLLINYASHRYTGVPDRFTGSGYGTEFTLTISSLQSEDFAVYFCQQDYSSPRTFGGGTKVEIK

SEQ ID NO: 10412 - protein, 5 aa, Artificial Sequence
  Description of Artificial Sequence: Synthetic peptide
  XENP019113 vhCDR1
NYWMN

SEQ ID NO: 10413 - protein, 19 aa, Artificial Sequence
  Description of Artificial Sequence: Synthetic peptide
  XENP019113 vhCDR2
EIRLKSNNYATHYAEPVKG

SEQ ID NO: 10414 - protein, 11 aa, Artificial Sequence
  Description of Artificial Sequence: Synthetic peptide
  XENP019113 vhCDR3
YYGNYGGYFDV

SEQ ID NO: 10415 - protein, 11 aa, Artificial Sequence
  Description of Artificial Sequence: Synthetic peptide
  XENP019113 vlCDR1
RASQSVSNDVA

SEQ ID NO: 10416 - protein, 7 aa, Artificial Sequence
  Description of Artificial Sequence: Synthetic peptide
  XENP019113 vlCDR2
YASHRYT

SEQ ID NO: 10417 - protein, 9 aa, Artificial Sequence
  Description of Artificial Sequence: Synthetic peptide
  XENP019113 vlCDR3
QQDYSSPRT

SEQ ID NO: 10418 - protein, 249 aa, Artificial Sequence
  Description of Artificial Sequence: Synthetic polypeptide
  XENP019114 1G6_H1_L1.153_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRVLINYASHRYTGVPDRFTGSGYGTEFTLTISSLQSEDFAVYFCQQDYSSPRTFGGGTKVEIK

SEQ ID NO: 10419 - protein, 122 aa, Artificial Sequence; identical to SEQ ID NO: 6246
  Description of Artificial Sequence: Synthetic polypeptide
  VH of XENP019114

SEQ ID NO: 10420 - protein, 107 aa, Artificial Sequence
  Description of Artificial Sequence: Synthetic polypeptide
  VL of XENP019114
SIVMTQSPATLSVSPGERATLSCRASQSVSNDVAWYQQKPGQSPRVLINYASHRYTGVPDRFTGSGYGTEFTLTISSLQSEDFAVYFCQQDYSSPRTFGGGTKVEIK

SEQ ID NO: 10421 - protein, 5 aa, Artificial Sequence
  Description of Artificial Sequence: Synthetic peptide
  XENP019114 vhCDR1
NYWMN

SEQ ID NO: 10422 - protein, 19 aa, Artificial Sequence
  Description of Artificial Sequence: Synthetic peptide
  XENP019114 vhCDR2
EIRLKSNNYATHYAEPVKG

SEQ ID NO: 10423 - protein, 11 aa, Artificial Sequence
  Description of Artificial Sequence: Synthetic peptide
  XENP019114 vhCDR3
YYGNYGGYFDV

SEQ ID NO: 10424 - protein, 11 aa, Artificial Sequence
  Description of Artificial Sequence: Synthetic peptide
  XENP019114 vlCDR1
RASQSVSNDVA

SEQ ID NO: 10425 - protein, 7 aa, Artificial Sequence
  Description of Artificial Sequence: Synthetic peptide
  XENP019114 vlCDR2
YASHRYT

SEQ ID NO: 10426 - protein, 9 aa, Artificial Sequence
  Description of Artificial Sequence: Synthetic peptide
  XENP019114 vlCDR3
QQDYSSPRT

SEQ ID NO: 10427 - protein, 249 aa, Artificial Sequence
  Description of Artificial Sequence: Synthetic polypeptide
  XENP019115 1G6_H1_L1.154_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLVNYASHRYTGVPDRFTGSGYGTEFTLTISSLQSEDFAVYFCQQDYSSPRTFGGGTKVEIK

SEQ ID NO: 10428 - protein, 122 aa, Artificial Sequence; identical to SEQ ID NO: 6246
  Description of Artificial Sequence: Synthetic polypeptide
  VH of XENP019115

SEQ ID NO: 10429 - protein, 107 aa, Artificial Sequence
  Description of Artificial Sequence: Synthetic polypeptide
  VL of XENP019115
SIVMTQSPATLSVSPGERATLSCRASQSVSNDVAWYQQKPGQSPRLLVNYASHRYTGVPDRFTGSGYGTEFTLTISSLQSEDFAVYFCQQDYSSPRTFGGGTKVEIK

SEQ ID NO: 10430 - protein, 5 aa, Artificial Sequence
  Description of Artificial Sequence: Synthetic peptide
  XENP019115 vhCDR1
NYWMN

SEQ ID NO: 10431 - protein, 19 aa, Artificial Sequence
  Description of Artificial Sequence: Synthetic peptide
  XENP019115 vhCDR2
EIRLKSNNYATHYAEPVKG

SEQ ID NO: 10432 - protein, 11 aa, Artificial Sequence
  Description of Artificial Sequence: Synthetic peptide
  XENP019115 vhCDR3
YYGNYGGYFDV

SEQ ID NO: 10433 - protein, 11 aa, Artificial Sequence
  Description of Artificial Sequence: Synthetic peptide
  XENP019115 vlCDR1
RASQSVSNDVA

SEQ ID NO: 10434 - protein, 9 aa, Artificial Sequence
  Description of Artificial Sequence: Synthetic peptide
  XENP019115 vlCDR2
VNYASHRYT

SEQ ID NO: 10435 - protein, 9 aa, Artificial Sequence
  Description of Artificial Sequence: Synthetic peptide
  XENP019115 vlCDR3
QQDYSSPRT

SEQ ID NO: 10436 - protein, 249 aa, Artificial Sequence
  Description of Artificial Sequence: Synthetic polypeptide
  XENP019116 1G6_H1_L1.155_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYANHRYTGVPDRFTGSGYGTEFTLTISSLQSEDFAVYFCQQDYSSPRTFGGGTKVEIK

SEQ ID NO: 10437 - protein, 122 aa, Artificial Sequence; identical to SEQ ID NO: 6246
  Description of Artificial Sequence: Synthetic polypeptide
  VH of XENP019116

SEQ ID NO: 10438 - protein, 107 aa, Artificial Sequence
  Description of Artificial Sequence: Synthetic polypeptide
  VL of XENP019116
SIVMTQSPATLSVSPGERATLSCRASQSVSNDVAWYQQKPGQSPRLLINYANHRYTGVPDRFTGSGYGTEFTLTISSLQSEDFAVYFCQQDYSSPRTFGGGTKVEIK

SEQ ID NO: 10439 - protein, 5 aa, Artificial Sequence
  Description of Artificial Sequence: Synthetic peptide
  XENP019116 vhCDR1
NYWMN

SEQ ID NO: 10440 - protein, 19 aa, Artificial Sequence
  Description of Artificial Sequence: Synthetic peptide
  XENP019116 vhCDR2
EIRLKSNNYATHYAEPVKG

SEQ ID NO: 10441 - protein, 11 aa, Artificial Sequence
  Description of Artificial Sequence: Synthetic peptide
  XENP019116 vhCDR3
YYGNYGGYFDV

SEQ ID NO: 10442 - protein, 11 aa, Artificial Sequence
  Description of Artificial Sequence: Synthetic peptide
  XENP019116 vlCDR1
RASQSVSNDVA

SEQ ID NO: 10443 - protein, 7 aa, Artificial Sequence
  Description of Artificial Sequence: Synthetic peptide
  XENP019116 vlCDR2
YANHRYT

SEQ ID NO: 10444 - protein, 9 aa, Artificial Sequence
  Description of Artificial Sequence: Synthetic peptide
  XENP019116 vlCDR3
QQDYSSPRT

SEQ ID NO: 10445 - protein, 249 aa, Artificial Sequence
  Description of Artificial Sequence: Synthetic polypeptide
  XENP019117 1G6_H1_L1.156_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLESEDFAVYFCQQDYSSPRTFGGGTKVEIK

SEQ ID NO: 10446 - protein, 122 aa, Artificial Sequence; identical to SEQ ID NO: 6246
  Description of Artificial Sequence: Synthetic polypeptide
  VH of XENP019117

SEQ ID NO: 10447 - protein, 107 aa, Artificial Sequence
  Description of Artificial Sequence: Synthetic polypeptide
  VL of XENP019117
SIVMTQSPATLSVSPGERATLSCRASQSVSNDVAWYQQKPGQSPRLLINYASHRYTGVPDRFTGSGYGTEFTLTISSLESEDFAVYFCQQDYSSPRTFGGGTKVEIK

SEQ ID NO: 10448 - protein, 5 aa, Artificial Sequence
  Description of Artificial Sequence: Synthetic peptide
  XENP019117 vhCDR1
NYWMN

SEQ ID NO: 10449 - protein, 19 aa, Artificial Sequence
  Description of Artificial Sequence: Synthetic peptide
  XENP019117 vhCDR2
EIRLKSNNYATHYAEPVKG

SEQ ID NO: 10450 - protein, 11 aa, Artificial Sequence
  Description of Artificial Sequence: Synthetic peptide
  XENP019117 vhCDR3
YYGNYGGYFDV

SEQ ID NO: 10451 - protein, 11 aa, Artificial Sequence
  Description of Artificial Sequence: Synthetic peptide
  XENP019117 vlCDR1
RASQSVSNDVA

SEQ ID NO: 10452 - protein, 7 aa, Artificial Sequence
  Description of Artificial Sequence: Synthetic peptide
  XENP019117 vlCDR2
YASHRYT

SEQ ID NO: 10453 - protein, 9 aa, Artificial Sequence
  Description of Artificial Sequence: Synthetic peptide
  XENP019117 vlCDR3
QQDYSSPRT

SEQ ID NO: 10454 - protein, 249 aa, Artificial Sequence
  Description of Artificial Sequence: Synthetic polypeptide
  XENP019118 1G6_H1_L1.157_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLKSEDFAVYFCQQDYSSPRTFGGGTKVEIK

SEQ ID NO: 10455 - protein, 122 aa, Artificial Sequence; identical to SEQ ID NO: 6246
  Description of Artificial Sequence: Synthetic polypeptide
  VH of XENP019118

SEQ ID NO: 10456 - protein, 107 aa, Artificial Sequence
  Description of Artificial Sequence: Synthetic polypeptide
  VL of XENP019118
SIVMTQSPATLSVSPGERATLSCRASQSVSNDVAWYQQKPGQSPRLLINYASHRYTGVPDRFTGSGYGTEFTLTISSLKSEDFAVYFCQQDYSSPRTFGGGTKVEIK

SEQ ID NO: 10457 - protein, 5 aa, Artificial Sequence
  Description of Artificial Sequence: Synthetic peptide
  XENP019118 vhCDR1
NYWMN

SEQ ID NO: 10458 - protein, 19 aa, Artificial Sequence
  Description of Artificial Sequence: Synthetic peptide
  XENP019118 vhCDR2
EIRLKSNNYATHYAEPVKG

SEQ ID NO: 10459 - protein, 11 aa, Artificial Sequence
  Description of Artificial Sequence: Synthetic peptide
  XENP019118 vhCDR3
YYGNYGGYFDV

SEQ ID NO: 10460 - protein, 11 aa, Artificial Sequence
  Description of Artificial Sequence: Synthetic peptide
  XENP019118 vlCDR1
RASQSVSNDVA

SEQ ID NO: 10461 - protein, 7 aa, Artificial Sequence
  Description of Artificial Sequence: Synthetic peptide
  XENP019118 vlCDR2
YASHRYT

SEQ ID NO: 10462 - protein, 9 aa, Artificial Sequence
  Description of Artificial Sequence: Synthetic peptide
  XENP019118 vlCDR3
QQDYSSPRT

SEQ ID NO: 10463 - protein, 249 aa, Artificial Sequence
  Description of Artificial Sequence: Synthetic polypeptide
  XENP019119 1G6_H1_L1.158_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFGVYFCQQDYSSPRTFGGGTKVEIK

SEQ ID NO: 10464 - protein, 122 aa, Artificial Sequence; identical to SEQ ID NO: 6246
  Description of Artificial Sequence: Synthetic polypeptide
  VH of XENP019119

SEQ ID NO: 10465 - protein, 107 aa, Artificial Sequence
  Description of Artificial Sequence: Synthetic polypeptide
  VL of XENP019119
SIVMTQSPATLSVSPGERATLSCRASQSVSNDVAWYQQKPGQSPRLLINYASHRYTGVPDRFTGSGYGTEFTLTISSLQSEDFGVYFCQQDYSSPRTFGGGTKVEIK

SEQ ID NO: 10466 - protein, 5 aa, Artificial Sequence
  Description of Artificial Sequence: Synthetic peptide
  XENP019119 vhCDR1
NYWMN

SEQ ID NO: 10467 - protein, 19 aa, Artificial Sequence
  Description of Artificial Sequence: Synthetic peptide
  XENP019119 vhCDR2
EIRLKSNNYATHYAEPVKG

SEQ ID NO: 10468 - protein, 11 aa, Artificial Sequence
  Description of Artificial Sequence: Synthetic peptide
  XENP019119 vhCDR3
YYGNYGGYFDV

SEQ ID NO: 10469 - protein, 11 aa, Artificial Sequence
  Description of Artificial Sequence: Synthetic peptide
  XENP019119 vlCDR1
RASQSVSNDVA

SEQ ID NO: 10470 - protein, 7 aa, Artificial Sequence
  Description of Artificial Sequence: Synthetic peptide
  XENP019119 vlCDR2
YASHRYT

SEQ ID NO: 10471 - protein, 9 aa, Artificial Sequence
  Description of Artificial Sequence: Synthetic peptide
  XENP019119 vlCDR3
QQDYSSPRT

SEQ ID NO: 10472 - protein, 249 aa, Artificial Sequence
  Description of Artificial Sequence: Synthetic polypeptide
  XENP019120 1G6_H1_L1.159_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCKQDYSSPRTFGGGTKVEIK

SEQ ID NO: 10473 - protein, 122 aa, Artificial Sequence; identical to SEQ ID NO: 6246
  Description of Artificial Sequence: Synthetic polypeptide
  VH of XENP019120

SEQ ID NO: 10474 - protein, 107 aa, Artificial Sequence
  Description of Artificial Sequence: Synthetic polypeptide
  VL of XENP019120
SIVMTQSPATLSVSPGERATLSCRASQSVSNDVAWYQQKPGQSPRLLINYASHRYTGVPDRFTGSGYGTEFTLTISSLQSEDFAVYFCKQDYSSPRTFGGGTKVEIK

SEQ ID NO: 10475 - protein, 5 aa, Artificial Sequence
  Description of Artificial Sequence: Synthetic peptide
  XENP019120 vhCDR1
NYWMN

SEQ ID NO: 10476 - protein, 19 aa, Artificial Sequence
  Description of Artificial Sequence: Synthetic peptide
  XENP019120 vhCDR2
EIRLKSNNYATHYAEPVKG

SEQ ID NO: 10477 - protein, 11 aa, Artificial Sequence
  Description of Artificial Sequence: Synthetic peptide
  XENP019120 vhCDR3
YYGNYGGYFDV

SEQ ID NO: 10478 - protein, 11 aa, Artificial Sequence
  Description of Artificial Sequence: Synthetic peptide
  XENP019120 vlCDR1
RASQSVSNDVA

SEQ ID NO: 10479 - protein, 7 aa, Artificial Sequence
  Description of Artificial Sequence: Synthetic peptide
  XENP019120 vlCDR2
YASHRYT

SEQ ID NO: 10480 - protein, 9 aa, Artificial Sequence
  Description of Artificial Sequence: Synthetic peptide
  XENP019120 vlCDR3
KQDYSSPRT

SEQ ID NO: 10481 - protein, 249 aa, Artificial Sequence
  Description of Artificial Sequence: Synthetic polypeptide
  XENP019121 1G6_H1_L1.160_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQKDYSSPRTFGGGTKVEIK

SEQ ID NO: 10482 - protein, 122 aa, Artificial Sequence; identical to SEQ ID NO: 6246
  Description of Artificial Sequence: Synthetic polypeptide
  VH of XENP019121

SEQ ID NO: 10483 - protein, 107 aa, Artificial Sequence
  Description of Artificial Sequence: Synthetic polypeptide
  VL of XENP019121
SIVMTQSPATLSVSPGERATLSCRASQSVSNDVAWYQQKPGQSPRLLINYASHRYTGVPDRFTGSGYGTEFTLTISSLQSEDFAVYFCQKDYSSPRTFGGGTKVEIK

SEQ ID NO: 10484 - protein, 5 aa, Artificial Sequence
  Description of Artificial Sequence: Synthetic peptide
  XENP019121 vhCDR1
NYWMN

SEQ ID NO: 10485 - protein, 19 aa, Artificial Sequence
  Description of Artificial Sequence: Synthetic peptide
  XENP019121 vhCDR2
EIRLKSNNYATHYAEPVKG

SEQ ID NO: 10486 - protein, 11 aa, Artificial Sequence
  Description of Artificial Sequence: Synthetic peptide
  XENP019121 vhCDR3
YYGNYGGYFDV

SEQ ID NO: 10487 - protein, 11 aa, Artificial Sequence
  Description of Artificial Sequence: Synthetic peptide
  XENP019121 vlCDR1
RASQSVSNDVA

SEQ ID NO: 10488 - protein, 7 aa, Artificial Sequence
  Description of Artificial Sequence: Synthetic peptide
  XENP019121 vlCDR2
YASHRYT

SEQ ID NO: 10489 - protein, 9 aa, Artificial Sequence
  Description of Artificial Sequence: Synthetic peptide
  XENP019121 vlCDR3
QKDYSSPRT

SEQ ID NO: 10490 - protein, 249 aa, Artificial Sequence
  Description of Artificial Sequence: Synthetic polypeptide
  XENP019122 1G6_H1_L1.161_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQNDYSSPRTFGGGTKVEIK

SEQ ID NO: 10491 - protein, 122 aa, Artificial Sequence; identical to SEQ ID NO: 6246
  Description of Artificial Sequence: Synthetic polypeptide
  VH of XENP019122

SEQ ID NO: 10492 - protein, 107 aa, Artificial Sequence
  Description of Artificial Sequence: Synthetic polypeptide
  VL of XENP019122
SIVMTQSPATLSVSPGERATLSCRASQSVSNDVAWYQQKPGQSPRLLINYASHRYTGVPDRFTGSGYGTEFTLTISSLQSEDFAVYFCQNDYSSPRTFGGGTKVEIK

SEQ ID NO: 10493 - protein, 5 aa, Artificial Sequence
  Description of Artificial Sequence: Synthetic peptide
  XENP019122 vhCDR1
NYWMN

SEQ ID NO: 10494 - protein, 19 aa, Artificial Sequence
  Description of Artificial Sequence: Synthetic peptide
  XENP019122 vhCDR2
EIRLKSNNYATHYAEPVKG

SEQ ID NO: 10495 - protein, 11 aa, Artificial Sequence
  Description of Artificial Sequence: Synthetic peptide
  XENP019122 vhCDR3
YYGNYGGYFDV

SEQ ID NO: 10496 - protein, 11 aa, Artificial Sequence
  Description of Artificial Sequence: Synthetic peptide
  XENP019122 vlCDR1
RASQSVSNDVA

SEQ ID NO: 10497 - protein, 7 aa, Artificial Sequence
  Description of Artificial Sequence: Synthetic peptide
  XENP019122 vlCDR2
YASHRYT

SEQ ID NO: 10498 - protein, 9 aa, Artificial Sequence
  Description of Artificial Sequence: Synthetic peptide
  XENP019122 vlCDR3
QNDYSSPRT

SEQ ID NO: 10499 - protein, 249 aa, Artificial Sequence
  Description of Artificial Sequence: Synthetic polypeptide
  XENP019123 1G6_H1_L1.162_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQRDYSSPRTFGGGTKVEIK

SEQ ID NO: 10500 - protein, 122 aa, Artificial Sequence; identical to SEQ ID NO: 6246
  Description of Artificial Sequence: Synthetic polypeptide
  VH of XENP019123

SEQ ID NO: 10501 - protein, 107 aa, Artificial Sequence
  Description of Artificial Sequence: Synthetic polypeptide
  VL of XENP019123
SIVMTQSPATLSVSPGERATLSCRASQSVSNDVAWYQQKPGQSPRLLINYASHRYTGVPDRFTGSGYGTEFTLTISSLQSEDFAVYFCQRDYSSPRTFGGGTKVEIK

SEQ ID NO: 10502 - protein, 5 aa, Artificial Sequence
  Description of Artificial Sequence: Synthetic peptide
  XENP019123 vhCDR1
NYWMN

SEQ ID NO: 10503 - protein, 19 aa, Artificial Sequence
  Description of Artificial Sequence: Synthetic peptide
  XENP019123 vhCDR2
EIRLKSNNYATHYAEPVKG

SEQ ID NO: 10504 - protein, 11 aa, Artificial Sequence
  Description of Artificial Sequence: Synthetic peptide
  XENP019123 vhCDR3
YYGNYGGYFDV

SEQ ID NO: 10505 - protein, 11 aa, Artificial Sequence
  Description of Artificial Sequence: Synthetic peptide
  XENP019123 vlCDR1
RASQSVSNDVA

SEQ ID NO: 10506 - protein, 7 aa, Artificial Sequence
  Description of Artificial Sequence: Synthetic peptide
  XENP019123 vlCDR2
YASHRYT

SEQ ID NO: 10507 - protein, 9 aa, Artificial Sequence
  Description of Artificial Sequence: Synthetic peptide
  XENP019123 vlCDR3
QRDYSSPRT

SEQ ID NO: 10508 - protein, 249 aa, Artificial Sequence
  Description of Artificial Sequence: Synthetic polypeptide
  XENP019124 1G6_H1_L1.163_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGEPATLSCRASQSVSNDVAWYQQKPGQSPRLLINYASHRYTGVPDRFTGSGYGTEFTLTISRLQSEDFAVYFCQQDYSSPRTFGGGTKVEIK

SEQ ID NO: 10509 - protein, 122 aa, Artificial Sequence; identical to SEQ ID NO: 6246
  Description of Artificial Sequence: Synthetic polypeptide
  VH of XENP019124

SEQ ID NO: 10510 - protein, 107 aa, Artificial Sequence
  Description of Artificial Sequence: Synthetic polypeptide
  VL of XENP019124
SIVMTQSPATLSVSPGEPATLSCRASQSVSNDVAWYQQKPGQSPRLLINYASHRYTGVPDRFTGSGYGTEFTLTISRLQSEDFAVYFCQQDYSSPRTFGGGTKVEIK

SEQ ID NO: 10511 - protein, 5 aa, Artificial Sequence
  Description of Artificial Sequence: Synthetic peptide
  XENP019124 vhCDR1
NYWMN

SEQ ID NO: 10512 - protein, 19 aa, Artificial Sequence
  Description of Artificial Sequence: Synthetic peptide
  XENP019124 vhCDR2
EIRLKSNNYATHYAEPVKG

SEQ ID NO: 10513 - protein, 11 aa, Artificial Sequence
  Description of Artificial Sequence: Synthetic peptide
  XENP019124 vhCDR3
YYGNYGGYFDV

SEQ ID NO: 10514 - protein, 11 aa, Artificial Sequence
  Description of Artificial Sequence: Synthetic peptide
  XENP019124 vlCDR1
RASQSVSNDVA

SEQ ID NO: 10515 - protein, 7 aa, Artificial Sequence
  Description of Artificial Sequence: Synthetic peptide
  XENP019124 vlCDR2
YASHRYT

SEQ ID NO: 10516 - protein, 9 aa, Artificial Sequence
  Description of Artificial Sequence: Synthetic peptide
  XENP019124 vlCDR3
QQDYSSPRT

SEQ ID NO: 10517 - protein, 249 aa, Artificial Sequence
  Description of Artificial Sequence: Synthetic polypeptide
  XENP019125 1G6_H1_L1.164_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASESVSNDVAWYQQKPGQSPRLLINYASHRYTGVPDRFTGSGYGTEFTLTISSLQSEDFAVYFCQKDYSSPRTFGGGTKVEIK

SEQ ID NO: 10518 - protein, 122 aa, Artificial Sequence; identical to SEQ ID NO: 6246
  Description of Artificial Sequence: Synthetic polypeptide
  VH of XENP019125

SEQ ID NO: 10519 - protein, 107 aa, Artificial Sequence
  Description of Artificial Sequence: Synthetic polypeptide
  VL of XENP019125
SIVMTQSPATLSVSPGERATLSCRASESVSNDVAWYQQKPGQSPRLLINYASHRYTGVPDRFTGSGYGTEFTLTISSLQSEDFAVYFCQKDYSSPRTFGGGTKVEIK

SEQ ID NO: 10520 - protein, 5 aa, Artificial Sequence
  Description of Artificial Sequence: Synthetic peptide
  XENP019125 vhCDR1
NYWMN

SEQ ID NO: 10521 - protein, 19 aa, Artificial Sequence
  Description of Artificial Sequence: Synthetic peptide
  XENP019125 vhCDR2
EIRLKSNNYATHYAEPVKG

SEQ ID NO: 10522 - protein, 11 aa, Artificial Sequence
  Description of Artificial Sequence: Synthetic peptide
  XENP019125 vhCDR3
YYGNYGGYFDV

SEQ ID NO: 10523 - protein, 11 aa, Artificial Sequence
  Description of Artificial Sequence: Synthetic peptide
  XENP019125 vlCDR1
RASESVSNDVA

SEQ ID NO: 10524 - protein, 7 aa, Artificial Sequence
  Description of Artificial Sequence: Synthetic peptide
  XENP019125 vlCDR2
YASHRYT

SEQ ID NO: 10525 - protein, 9 aa, Artificial Sequence
  Description of Artificial Sequence: Synthetic peptide
  XENP019125 vlCDR3
QKDYSSPRT

SEQ ID NO: 10526 - protein, 249 aa, Artificial Sequence
  Description of Artificial Sequence: Synthetic polypeptide
  XENP019126 1G6_H1_L1.165_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASESVSNDVAWYQQKPGQSPRLLINYASHRYTGVPDRFTGSGYGTEFTLTISSLQSEDFAVYFCQQDYKSPRTFGGGTKVEIK

SEQ ID NO: 10527 - protein, 122 aa, Artificial Sequence; identical to SEQ ID NO: 6246
  Description of Artificial Sequence: Synthetic polypeptide
  VH of XENP019126

SEQ ID NO: 10528 - protein, 107 aa, Artificial Sequence
  Description of Artificial Sequence: Synthetic polypeptide
  VL of XENP019126
SIVMTQSPATLSVSPGERATLSCRASESVSNDVAWYQQKPGQSPRLLINYASHRYTGVPDRFTGSGYGTEFTLTISSLQSEDFAVYFCQQDYKSPRTFGGGTKVEIK

SEQ ID NO: 10529 - protein, 5 aa, Artificial Sequence
  Description of Artificial Sequence: Synthetic peptide
  XENP019126 vhCDR1
NYWMN

SEQ ID NO: 10530 - protein, 19 aa, Artificial Sequence
  Description of Artificial Sequence: Synthetic peptide
  XENP019126 vhCDR2
EIRLKSNNYATHYAEPVKG

SEQ ID NO: 10531 - protein, 11 aa, Artificial Sequence
  Description of Artificial Sequence: Synthetic peptide
  XENP019126 vhCDR3
YYGNYGGYFDV

SEQ ID NO: 10532 - protein, 11 aa, Artificial Sequence
  Description of Artificial Sequence: Synthetic peptide
  XENP019126 vlCDR1
RASESVSNDVA

SEQ ID NO: 10533 - protein, 7 aa, Artificial Sequence
  Description of Artificial Sequence: Synthetic peptide
  XENP019126 vlCDR2
YASHRYT

SEQ ID NO: 10534 - protein, 9 aa, Artificial Sequence
  Description of Artificial Sequence: Synthetic peptide
  XENP019126 vlCDR3
QQDYKSPRT

SEQ ID NO: 10535 - protein, 249 aa, Artificial Sequence
  Description of Artificial Sequence: Synthetic polypeptide
  XENP019127 1G6_H1_L1.166_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYRQKPEQSPRLLINYASHRYTGVPDRFTGSGYGTEFTLTISSLQSEDFAVYFCQQDYSSPRTFGGGTKVEIK

SEQ ID NO: 10536 - protein, 122 aa, Artificial Sequence; identical to SEQ ID NO: 6246
  Description of Artificial Sequence: Synthetic polypeptide
  VH of XENP019127

SEQ ID NO: 10537 - protein, 107 aa, Artificial Sequence
  Description of Artificial Sequence: Synthetic polypeptide
  VL of XENP019127
SIVMTQSPATLSVSPGERATLSCRASQSVSNDVAWYRQKPEQSPRLLINYASHRYTGVPDRFTGSGYGTEFTLTISSLQSEDFAVYFCQQDYSSPRTFGGGTKVEIK

SEQ ID NO: 10538 - protein, 5 aa, Artificial Sequence
  Description of Artificial Sequence: Synthetic peptide
  XENP019127 vhCDR1
NYWMN

SEQ ID NO: 10539 - protein, 19 aa, Artificial Sequence
  Description of Artificial Sequence: Synthetic peptide
  XENP019127 vhCDR2
EIRLKSNNYATHYAEPVKG

SEQ ID NO: 10540 - protein, 11 aa, Artificial Sequence
  Description of Artificial Sequence: Synthetic peptide
  XENP019127 vhCDR3
YYGNYGGYFDV

SEQ ID NO: 10541 - protein, 11 aa, Artificial Sequence
  Description of Artificial Sequence: Synthetic peptide
  XENP019127 vlCDR1
RASQSVSNDVA

SEQ ID NO: 10542 - protein, 7 aa, Artificial Sequence
  Description of Artificial Sequence: Synthetic peptide
  XENP019127 vlCDR2
YASHRYT

SEQ ID NO: 10543 - protein, 9 aa, Artificial Sequence
  Description of Artificial Sequence: Synthetic peptide
  XENP019127 vlCDR3
QQDYSSPRT

SEQ ID NO: 10544 - protein, 249 aa, Artificial Sequence
  Description of Artificial Sequence: Synthetic polypeptide
  XENP019128 1G6_H1_L1.167_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYRQKPGESPRLLINYASHRYTGVPDRFTGSGYGTEFTLTISSLQSEDFAVYFCQQDYSSPRTFGGGTKVEIK

SEQ ID NO: 10545 - protein, 122 aa, Artificial Sequence; identical to SEQ ID NO: 6246
  Description of Artificial Sequence: Synthetic polypeptide
  VH of XENP019128

SEQ ID NO: 10546 - protein, 107 aa, Artificial Sequence
  Description of Artificial Sequence: Synthetic polypeptide
  VL of XENP019128
SIVMTQSPATLSVSPGERATLSCRASQSVSNDVAWYRQKPGESPRLLINYASHRYTGVPDRFTGSGYGTEFTLTISSLQSEDFAVYFCQQDYSSPRTFGGGTKVEIK

SEQ ID NO: 10547 - protein, 5 aa, Artificial Sequence
  Description of Artificial Sequence: Synthetic peptide
  XENP019128 vhCDR1
NYWMN

SEQ ID NO: 10548 - protein, 19 aa, Artificial Sequence
  Description of Artificial Sequence: Synthetic peptide
  XENP019128 vhCDR2
EIRLKSNNYATHYAEPVKG

SEQ ID NO: 10549 - protein, 11 aa, Artificial Sequence
  Description of Artificial Sequence: Synthetic peptide
  XENP019128 vhCDR3
YYGNYGGYFDV

SEQ ID NO: 10550 - protein, 11 aa, Artificial Sequence
  Description of Artificial Sequence: Synthetic peptide
  XENP019128 vlCDR1
RASQSVSNDVA

SEQ ID NO: 10551 - protein, 7 aa, Artificial Sequence
  Description of Artificial Sequence: Synthetic peptide
  XENP019128 vlCDR2
YASHRYT

SEQ ID NO: 10552 - protein, 9 aa, Artificial Sequence
  Description of Artificial Sequence: Synthetic peptide
  XENP019128 vlCDR3
QQDYSSPRT

SEQ ID NO: 10553 - protein, 249 aa, Artificial Sequence
  Description of Artificial Sequence: Synthetic polypeptide
  XENP019129 1G6_H1_L1.168_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTGVPDRFTGSGYGTEFTLTISSLQSEDFAVYFCQQDFSSPRTFGGGTKVEIK

SEQ ID NO: 10554 - protein, 122 aa, Artificial Sequence; identical to SEQ ID NO: 6246
  Description of Artificial Sequence: Synthetic polypeptide
  VH of XENP019129

SEQ ID NO: 10555 - protein, 107 aa, Artificial Sequence
  Description of Artificial Sequence: Synthetic polypeptide
  VL of XENP019129
SIVMTQSPATLSVSPGERATLSCRASQSVSNDVAWYQQKPGQSPRLLINYASWRYTGVPDRFTGSGYGTEFTLTISSLQSEDFAVYFCQQDFSSPRTFGGGTKVEIK

SEQ ID NO: 10556 - protein, 5 aa, Artificial Sequence
  Description of Artificial Sequence: Synthetic peptide
  XENP019129 vhCDR1
NYWMN

SEQ ID NO: 10557 - protein, 19 aa, Artificial Sequence
  Description of Artificial Sequence: Synthetic peptide
  XENP019129 vhCDR2
EIRLKSNNYATHYAEPVKG

SEQ ID NO: 10558 - protein, 11 aa, Artificial Sequence
  Description of Artificial Sequence: Synthetic peptide
  XENP019129 vhCDR3
YYGNYGGYFDV

SEQ ID NO: 10559 - protein, 11 aa, Artificial Sequence
  Description of Artificial Sequence: Synthetic peptide
  XENP019129 vlCDR1
RASQSVSNDVA

SEQ ID NO: 10560 - protein, 7 aa, Artificial Sequence
  Description of Artificial Sequence: Synthetic peptide
  XENP019129 vlCDR2
YASWRYT

SEQ ID NO: 10561 - protein, 9 aa, Artificial Sequence
  Description of Artificial Sequence: Synthetic peptide
  XENP019129 vlCDR3
QQDFSSPRT

SEQ ID NO: 10562 - protein, 249 aa, Artificial Sequence
  Description of Artificial Sequence: Synthetic polypeptide
  XENP019130 1G6_H1_L1.169_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTGVPDRFTGSGYGTEFTLTISSLQSEDFAVYFCQQDWSSPRTFGGGTKVEIK

SEQ ID NO: 10563 - protein, 122 aa, Artificial Sequence; identical to SEQ ID NO: 6246
  Description of Artificial Sequence: Synthetic polypeptide
  VH of XENP019130

SEQ ID NO: 10564 - protein, 107 aa, Artificial Sequence
  Description of Artificial Sequence: Synthetic polypeptide
  VL of XENP019130
SIVMTQSPATLSVSPGERATLSCRASQSVSNDVAWYQQKPGQSPRLLINYASWRYTGVPDRFTGSGYGTEFTLTISSLQSEDFAVYFCQQDWSSPRTFGGGTKVEIK

SEQ ID NO: 10565 - protein, 5 aa, Artificial Sequence
  Description of Artificial Sequence: Synthetic peptide
  XENP019130 vhCDR1
NYWMN

SEQ ID NO: 10566 - protein, 19 aa, Artificial Sequence
  Description of Artificial Sequence: Synthetic peptide
  XENP019130 vhCDR2
EIRLKSNNYATHYAEPVKG

SEQ ID NO: 10567 - protein, 11 aa, Artificial Sequence
  Description of Artificial Sequence: Synthetic peptide
  XENP019130 vhCDR3
YYGNYGGYFDV

SEQ ID NO: 10568 - protein, 11 aa, Artificial Sequence
  Description of Artificial Sequence: Synthetic peptide
  XENP019130 vlCDR1
RASQSVSNDVA

SEQ ID NO: 10569 - protein, 7 aa, Artificial Sequence
  Description of Artificial Sequence: Synthetic peptide
  XENP019130 vlCDR2
YASWRYT

SEQ ID NO: 10570 - protein, 9 aa, Artificial Sequence
  Description of Artificial Sequence: Synthetic peptide
  XENP019130 vlCDR3
QQDWSSPRT

SEQ ID NO: 10571 - protein, 249 aa, Artificial Sequence
  Description of Artificial Sequence: Synthetic polypeptide
  XENP019131 1G6_H1_L1.170_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTGVPDRFTGSGYGTEFTLTISSLQSEDFAVYFCQQDGSSPRTFGGGTKVEIK

SEQ ID NO: 10572 - protein, 122 aa, Artificial Sequence; identical to SEQ ID NO: 6246
  Description of Artificial Sequence: Synthetic polypeptide
  VH of XENP019131

SEQ ID NO: 10573 - protein, 107 aa, Artificial Sequence
  Description of Artificial Sequence: Synthetic polypeptide
  VL of XENP019131
SIVMTQSPATLSVSPGERATLSCRASQSVSNDVAWYQQKPGQSPRLLINYASWRYTGVPDRFTGSGYGTEFTLTISSLQSEDFAVYFCQQDGSSPRTFGGGTKVEIK

SEQ ID NO: 10574 - protein, 5 aa, Artificial Sequence
  Description of Artificial Sequence: Synthetic peptide
  XENP019131 vhCDR1
NYWMN

SEQ ID NO: 10575 - protein, 19 aa, Artificial Sequence
  Description of Artificial Sequence: Synthetic peptide
  XENP019131 vhCDR2
EIRLKSNNYATHYAEPVKG

SEQ ID NO: 10576 - protein, 11 aa, Artificial Sequence
  Description of Artificial Sequence: Synthetic peptide
  XENP019131 vhCDR3
YYGNYGGYFDV

SEQ ID NO: 10577 - protein, 11 aa, Artificial Sequence
  Description of Artificial Sequence: Synthetic peptide
  XENP019131 vlCDR1
RASQSVSNDVA

SEQ ID NO: 10578 - protein, 7 aa, Artificial Sequence
  Description of Artificial Sequence: Synthetic peptide
  XENP019131 vlCDR2
YASWRYT

SEQ ID NO: 10579 - protein, 9 aa, Artificial Sequence
  Description of Artificial Sequence: Synthetic peptide
  XENP019131 vlCDR3
QQDGSSPRT

SEQ ID NO: 10580 - protein, 249 aa, Artificial Sequence
  Description of Artificial Sequence: Synthetic polypeptide
  XENP019132 1G6_H1_L1.171_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTSVPDRFTGSGYGTEFTLTISSLQSEDFAVYFCQQDWSSPRTFGGGTKVEIK

SEQ ID NO: 10581 - protein, 122 aa, Artificial Sequence; identical to SEQ ID NO: 6246
  Description of Artificial Sequence: Synthetic polypeptide
  VH of XENP019132

SEQ ID NO: 10582 - protein, 107 aa, Artificial Sequence
  Description of Artificial Sequence: Synthetic polypeptide
  VL of XENP019132
SIVMTQSPATLSVSPGERATLSCRASQSVSNDVAWYQQKPGQSPRLLINYASHRYTSVPDRFTGSGYGTEFTLTISSLQSEDFAVYFCQQDWSSPRTFGGGTKVEIK

SEQ ID NO: 10583 - protein, 5 aa, Artificial Sequence
  Description of Artificial Sequence: Synthetic peptide
  XENP019132 vhCDR1
NYWMN

SEQ ID NO: 10584 - protein, 19 aa, Artificial Sequence
  Description of Artificial Sequence: Synthetic peptide
  XENP019132 vhCDR2
EIRLKSNNYATHYAEPVKG

SEQ ID NO: 10585 - protein, 11 aa, Artificial Sequence
  Description of Artificial Sequence: Synthetic peptide
  XENP019132 vhCDR3
YYGNYGGYFDV

SEQ ID NO: 10586 - protein, 11 aa, Artificial Sequence
  Description of Artificial Sequence: Synthetic peptide
  XENP019132 vlCDR1
RASQSVSNDVA

SEQ ID NO: 10587 - protein, 7 aa, Artificial Sequence
  Description of Artificial Sequence: Synthetic peptide
  XENP019132 vlCDR2
YASHRYT

SEQ ID NO: 10588 - protein, 9 aa, Artificial Sequence
  Description of Artificial Sequence: Synthetic peptide
  XENP019132 vlCDR3
QQDWSSPRT

SEQ ID NO: 10589 - protein, 249 aa, Artificial Sequence
  Description of Artificial Sequence: Synthetic polypeptide
  XENP019133 1G6_H1_L1.172_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTSVPDRFTGSGYGTEFTLTISSLQSEDFAVYFCQQDFSSPRTFGGGTKVEIK

SEQ ID NO: 10590 - protein, 122 aa, Artificial Sequence; identical to SEQ ID NO: 6246
  Description of Artificial Sequence: Synthetic polypeptide
  VH of XENP019133

SEQ ID NO: 10591 - protein, 107 aa, Artificial Sequence
  Description of Artificial Sequence: Synthetic polypeptide
  VL of XENP019133
SIVMTQSPATLSVSPGERATLSCRASQSVSNDVAWYQQKPGQSPRLLINYASHRYTSVPDRFTGSGYGTEFTLTISSLQSEDFAVYFCQQDFSSPRTFGGGTKVEIK

SEQ ID NO: 10592 - protein, 5 aa, Artificial Sequence
  Description of Artificial Sequence: Synthetic peptide
  XENP019133 vhCDR1
NYWMN

SEQ ID NO: 10593 - protein, 19 aa, Artificial Sequence
  Description of Artificial Sequence: Synthetic peptide
  XENP019133 vhCDR2
EIRLKSNNYATHYAEPVKG

SEQ ID NO: 10594 - protein, 11 aa, Artificial Sequence
  Description of Artificial Sequence: Synthetic peptide
  XENP019133 vhCDR3
YYGNYGGYFDV

SEQ ID NO: 10595 - protein, 11 aa, Artificial Sequence
  Description of Artificial Sequence: Synthetic peptide
  XENP019133 vlCDR1
RASQSVSNDVA

SEQ ID NO: 10596 - protein, 7 aa, Artificial Sequence
  Description of Artificial Sequence: Synthetic peptide
  XENP019133 vlCDR2
YASHRYT

SEQ ID NO: 10597 - protein, 9 aa, Artificial Sequence
  Description of Artificial Sequence: Synthetic peptide
  XENP019133 vlCDR3
QQDFSSPRT

SEQ ID NO: 10598 - protein, 249 aa, Artificial Sequence
  Description of Artificial Sequence: Synthetic polypeptide
  XENP019134 1G6_H1_L1.173_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDFGSPRTFGGGTKVEIK

SEQ ID NO: 10599 - protein, 122 aa, Artificial Sequence; identical to SEQ ID NO: 6246
  Description of Artificial Sequence: Synthetic polypeptide
  VH of XENP019134

SEQ ID NO: 10600 - protein, 107 aa, Artificial Sequence
  Description of Artificial Sequence: Synthetic polypeptide
  VL of XENP019134
SIVMTQSPATLSVSPGERATLSCRASQSVSNDVAWYQQKPGQSPRLLINYASHRYTGVPDRFTGSGYGTEFTLTISSLQSEDFAVYFCQQDFGSPRTFGGGTKVEIK

SEQ ID NO: 10601 - protein, 5 aa, Artificial Sequence
  Description of Artificial Sequence: Synthetic peptide
  XENP019134 vhCDR1
NYWMN

SEQ ID NO: 10602 - protein, 19 aa, Artificial Sequence
  Description of Artificial Sequence: Synthetic peptide
  XENP019134 vhCDR2
EIRLKSNNYATHYAEPVKG

SEQ ID NO: 10603 - protein, 11 aa, Artificial Sequence
  Description of Artificial Sequence: Synthetic peptide
  XENP019134 vhCDR3
YYGNYGGYFDV

SEQ ID NO: 10604 - protein, 11 aa, Artificial Sequence
  Description of Artificial Sequence: Synthetic peptide
  XENP019134 vlCDR1
RASQSVSNDVA

SEQ ID NO: 10605 - protein, 7 aa, Artificial Sequence
  Description of Artificial Sequence: Synthetic peptide
  XENP019134 vlCDR2
YASHRYT

SEQ ID NO: 10606 - protein, 9 aa, Artificial Sequence
  Description of Artificial Sequence: Synthetic peptide
  XENP019134 vlCDR3
QQDFGSPRT

SEQ ID NO: 10607 - protein, 249 aa, Artificial Sequence
  Description of Artificial Sequence: Synthetic polypeptide
  XENP019135 1G6_H1_L1.174_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDWGSPRTFGGGTKVEIK

SEQ ID NO: 10608 - protein, 122 aa, Artificial Sequence; identical to SEQ ID NO: 6246
  Description of Artificial Sequence: Synthetic polypeptide
  VH of XENP019135

SEQ ID NO: 10609 - protein, 107 aa, Artificial Sequence
  Description of Artificial Sequence: Synthetic polypeptide
  VL of XENP019135
SIVMTQSPATLSVSPGERATLSCRASQSVSNDVAWYQQKPGQSPRLLINYASHRYTGVPDRFTGSGYGTEFTLTISSLQSEDFAVYFCQQDWGSPRTFGGGTKVEIK

SEQ ID NO: 10610 - protein, 5 aa, Artificial Sequence
  Description of Artificial Sequence: Synthetic peptide
  XENP019135 vhCDR1
NYWMN

SEQ ID NO: 10611 - protein, 19 aa, Artificial Sequence
  Description of Artificial Sequence: Synthetic peptide
  XENP019135 vhCDR2
EIRLKSNNYATHYAEPVKG

SEQ ID NO: 10612 - protein, 11 aa, Artificial Sequence
  Description of Artificial Sequence: Synthetic peptide
  XENP019135 vhCDR3
YYGNYGGYFDV

SEQ ID NO: 10613 - protein, 11 aa, Artificial Sequence
  Description of Artificial Sequence: Synthetic peptide
  XENP019135 vlCDR1
RASQSVSNDVA

SEQ ID NO: 10614 - protein, 7 aa, Artificial Sequence
  Description of Artificial Sequence: Synthetic peptide
  XENP019135 vlCDR2
YASHRYT

SEQ ID NO: 10615 - protein, 9 aa, Artificial Sequence
  Description of Artificial Sequence: Synthetic peptide
  XENP019135 vlCDR3
QQDWGSPRT

SEQ ID NO: 10616 - protein, 249 aa, Artificial Sequence
  Description of Artificial Sequence: Synthetic polypeptide
  XENP019136 1G6_H1_L1.175_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTSVPDRFTGSGYGTEFTLTISSLQSEDFAVYFCQQDWSSPRTFGGGTKVEIK

SEQ ID NO: 10617 - protein, 122 aa, Artificial Sequence; identical to SEQ ID NO: 6246
  Description of Artificial Sequence: Synthetic polypeptide
  VH of XENP019136

SEQ ID NO: 10618 - protein, 107 aa, Artificial Sequence
  Description of Artificial Sequence: Synthetic polypeptide
  VL of XENP019136
SIVMTQSPATLSVSPGERATLSCRASQSVGNDVAWYQQKPGQSPRLLINYASHRYTSVPDRFTGSGYGTEFTLTISSLQSEDFAVYFCQQDWSSPRTFGGGTKVEIK

SEQ ID NO: 10619 - protein, 5 aa, Artificial Sequence
  Description of Artificial Sequence: Synthetic peptide
  XENP019136 vhCDR1
NYWMN

SEQ ID NO: 10620 - protein, 19 aa, Artificial Sequence
  Description of Artificial Sequence: Synthetic peptide
  XENP019136 vhCDR2
EIRLKSNNYATHYAEPVKG

SEQ ID NO: 10621 - protein, 11 aa, Artificial Sequence
  Description of Artificial Sequence: Synthetic peptide
  XENP019136 vhCDR3
YYGNYGGYFDV

SEQ ID NO: 10622 - protein, 11 aa, Artificial Sequence
  Description of Artificial Sequence: Synthetic peptide
  XENP019136 vlCDR1
RASQSVGNDVA

SEQ ID NO: 10623 - protein, 7 aa, Artificial Sequence
  Description of Artificial Sequence: Synthetic peptide
  XENP019136 vlCDR2
YASHRYT

SEQ ID NO: 10624 - protein, 9 aa, Artificial Sequence
  Description of Artificial Sequence: Synthetic peptide
  XENP019136 vlCDR3
QQDWSSPRT

SEQ ID NO: 10625 - protein, 249 aa, Artificial Sequence
  Description of Artificial Sequence: Synthetic polypeptide
  XENP019137 1G6_H1_L1.176_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASWRYTSVPDRFTGSGYGTEFTLTISSLQSEDFAVYFCQQDYSSPRTFGGGTKVEIK

SEQ ID NO: 10626 - protein, 122 aa, Artificial Sequence; identical to SEQ ID NO: 6246
  Description of Artificial Sequence: Synthetic polypeptide
  VH of XENP019137

SEQ ID NO: 10627 - protein, 107 aa, Artificial Sequence
  Description of Artificial Sequence: Synthetic polypeptide
  VL of XENP019137
SIVMTQSPATLSVSPGERATLSCRASQSVGNDVAWYQQKPGQSPRLLINYASWRYTSVPDRFTGSGYGTEFTLTISSLQSEDFAVYFCQQDYSSPRTFGGGTKVEIK

SEQ ID NO: 10628 - protein, 5 aa, Artificial Sequence
  Description of Artificial Sequence: Synthetic peptide
  XENP019137 vhCDR1
NYWMN

SEQ ID NO: 10629 - protein, 19 aa, Artificial Sequence
  Description of Artificial Sequence: Synthetic peptide
  XENP019137 vhCDR2
EIRLKSNNYATHYAEPVKG

SEQ ID NO: 10630 - protein, 11 aa, Artificial Sequence
  Description of Artificial Sequence: Synthetic peptide
  XENP019137 vhCDR3
YYGNYGGYFDV

SEQ ID NO: 10631 - protein, 11 aa, Artificial Sequence
  Description of Artificial Sequence: Synthetic peptide
  XENP019137 vlCDR1
RASQSVGNDVA

SEQ ID NO: 10632 - protein, 7 aa, Artificial Sequence
  Description of Artificial Sequence: Synthetic peptide
  XENP019137 vlCDR2
YASWRYT

SEQ ID NO: 10633 - protein, 9 aa, Artificial Sequence
  Description of Artificial Sequence: Synthetic peptide
  XENP019137 vlCDR3
QQDYSSPRT

SEQ ID NO: 10634 - protein, 249 aa, Artificial Sequence
  Description of Artificial Sequence: Synthetic polypeptide
  XENP019138 1G6_H1_L1.177_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTSVPDRFTGSGYGTEFTLTISSLQSEDFAVYFCQQDFSSPRTFGGGTKVEIK

SEQ ID NO: 10635 - protein, 122 aa, Artificial Sequence; identical to SEQ ID NO: 6246
  Description of Artificial Sequence: Synthetic polypeptide
  VH of XENP019138

SEQ ID NO: 10636 - protein, 107 aa, Artificial Sequence
  Description of Artificial Sequence: Synthetic polypeptide
  VL of XENP019138
SIVMTQSPATLSVSPGERATLSCRASQSVGNDVAWYQQKPGQSPRLLINYASHRYTSVPDRFTGSGYGTEFTLTISSLQSEDFAVYFCQQDFSSPRTFGGGTKVEIK

SEQ ID NO: 10637 - protein, 5 aa, Artificial Sequence
  Description of Artificial Sequence: Synthetic peptide
  XENP019138 vhCDR1
NYWMN

SEQ ID NO: 10638 - protein, 19 aa, Artificial Sequence
  Description of Artificial Sequence: Synthetic peptide
  XENP019138 vhCDR2
EIRLKSNNYATHYAEPVKG

SEQ ID NO: 10639 - protein, 11 aa, Artificial Sequence
  Description of Artificial Sequence: Synthetic peptide
  XENP019138 vhCDR3
YYGNYGGYFDV

SEQ ID NO: 10640 - protein, 11 aa, Artificial Sequence
  Description of Artificial Sequence: Synthetic peptide
  XENP019138 vlCDR1
RASQSVGNDVA

SEQ ID NO: 10641 - protein, 7 aa, Artificial Sequence
  Description of Artificial Sequence: Synthetic peptide
  XENP019138 vlCDR2
YASHRYT

SEQ ID NO: 10642 - protein, 9 aa, Artificial Sequence
  Description of Artificial Sequence: Synthetic peptide
  XENP019138 vlCDR3
QQDFSSPRT

SEQ ID NO: 10643 - protein, 249 aa, Artificial Sequence
  Description of Artificial Sequence: Synthetic polypeptide
  XENP019139 1G6_H1_L1.178_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTSVPDRFTGSGYGTEFTLTISSLQSEDFAVYFCQQDGSSPRTFGGGTKVEIK

SEQ ID NO: 10644 - protein, 122 aa, Artificial Sequence; identical to SEQ ID NO: 6246
  Description of Artificial Sequence: Synthetic polypeptide
  VH of XENP019139

SEQ ID NO: 10645 - protein, 107 aa, Artificial Sequence
  Description of Artificial Sequence: Synthetic polypeptide
  VL of XENP019139
SIVMTQSPATLSVSPGERATLSCRASQSVGNDVAWYQQKPGQSPRLLINYASHRYTSVPDRFTGSGYGTEFTLTISSLQSEDFAVYFCQQDGSSPRTFGGGTKVEIK

SEQ ID NO: 10646 - protein, 5 aa, Artificial Sequence
  Description of Artificial Sequence: Synthetic peptide
  XENP019139 vhCDR1
NYWMN

SEQ ID NO: 10647 - protein, 19 aa, Artificial Sequence
  Description of Artificial Sequence: Synthetic peptide
  XENP019139 vhCDR2
EIRLKSNNYATHYAEPVKG

SEQ ID NO: 10648 - protein, 11 aa, Artificial Sequence
  Description of Artificial Sequence: Synthetic peptide
  XENP019139 vhCDR3
YYGNYGGYFDV

SEQ ID NO: 10649 - protein, 11 aa, Artificial Sequence
  Description of Artificial Sequence: Synthetic peptide
  XENP019139 vlCDR1
RASQSVGNDVA

SEQ ID NO: 10650 - protein, 7 aa, Artificial Sequence
  Description of Artificial Sequence: Synthetic peptide
  XENP019139 vlCDR2
YASHRYT

SEQ ID NO: 10651 - protein, 9 aa, Artificial Sequence
  Description of Artificial Sequence: Synthetic peptide
  XENP019139 vlCDR3
QQDGSSPRT

SEQ ID NO: 10652 - protein, 249 aa, Artificial Sequence
  Description of Artificial Sequence: Synthetic polypeptide
  XENP019140 1G6_H1_L1.179_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTSVPDRFTGSGYGTEFTLTISSLQSEDFAVYFCQQDFSSPRTFGGGTKVEIK

SEQ ID NO: 10653 - protein, 122 aa, Artificial Sequence; identical to SEQ ID NO: 6246
  Description of Artificial Sequence: Synthetic polypeptide
  VH of XENP019140

SEQ ID NO: 10654 - protein, 107 aa, Artificial Sequence
  Description of Artificial Sequence: Synthetic polypeptide
  VL of XENP019140
SIVMTQSPATLSVSPGERATLSCRASQSVSNDVAWYQQKPGQSPRLLINYASWRYTSVPDRFTGSGYGTEFTLTISSLQSEDFAVYFCQQDFSSPRTFGGGTKVEIK

SEQ ID NO: 10655 - protein, 5 aa, Artificial Sequence
  Description of Artificial Sequence: Synthetic peptide
  XENP019140 vhCDR1
NYWMN

SEQ ID NO: 10656 - protein, 19 aa, Artificial Sequence
  Description of Artificial Sequence: Synthetic peptide
  XENP019140 vhCDR2
EIRLKSNNYATHYAEPVKG

SEQ ID NO: 10657 - protein, 11 aa, Artificial Sequence
  Description of Artificial Sequence: Synthetic peptide
  XENP019140 vhCDR3
YYGNYGGYFDV

SEQ ID NO: 10658 - protein, 11 aa, Artificial Sequence
  Description of Artificial Sequence: Synthetic peptide
  XENP019140 vlCDR1
RASQSVSNDVA

SEQ ID NO: 10659 - protein, 7 aa, Artificial Sequence
  Description of Artificial Sequence: Synthetic peptide
  XENP019140 vlCDR2
YASWRYT

SEQ ID NO: 10660 - protein, 9 aa, Artificial Sequence
  Description of Artificial Sequence: Synthetic peptide
  XENP019140 vlCDR3
QQDFSSPRT

SEQ ID NO: 10661 - protein, 249 aa, Artificial Sequence
  Description of Artificial Sequence: Synthetic polypeptide
  XENP019141 1G6_H1_L1.180_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTSVPDRFTGSGYGTEFTLTISSLQSEDFAVYFCQQDWSSPRTFGGGTKVEIK

SEQ ID NO: 10662 - protein, 122 aa, Artificial Sequence; identical to SEQ ID NO: 6246
  Description of Artificial Sequence: Synthetic polypeptide
  VH of XENP019141

SEQ ID NO: 10663 - protein, 107 aa, Artificial Sequence
  Description of Artificial Sequence: Synthetic polypeptide
  VL of XENP019141
SIVMTQSPATLSVSPGERATLSCRASQSVSNDVAWYQQKPGQSPRLLINYASWRYTSVPDRFTGSGYGTEFTLTISSLQSEDFAVYFCQQDWSSPRTFGGGTKVEIK

SEQ ID NO: 10664 - protein, 5 aa, Artificial Sequence
  Description of Artificial Sequence: Synthetic peptide
  XENP019141 vhCDR1
NYWMN

SEQ ID NO: 10665 - protein, 19 aa, Artificial Sequence
  Description of Artificial Sequence: Synthetic peptide
  XENP019141 vhCDR2
EIRLKSNNYATHYAEPVKG

SEQ ID NO: 10666 - protein, 11 aa, Artificial Sequence
  Description of Artificial Sequence: Synthetic peptide
  XENP019141 vhCDR3
YYGNYGGYFDV

SEQ ID NO: 10667 - protein, 11 aa, Artificial Sequence
  Description of Artificial Sequence: Synthetic peptide
  XENP019141 vlCDR1
RASQSVSNDVA

SEQ ID NO: 10668 - protein, 7 aa, Artificial Sequence
  Description of Artificial Sequence: Synthetic peptide
  XENP019141 vlCDR2
YASWRYT

SEQ ID NO: 10669 - protein, 9 aa, Artificial Sequence
  Description of Artificial Sequence: Synthetic peptide
  XENP019141 vlCDR3
QQDWSSPRT

SEQ ID NO: 10670 - protein, 249 aa, Artificial Sequence
  Description of Artificial Sequence: Synthetic polypeptide
  XENP019142 1G6_H1_L1.181_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTSVPDRFTGSGYGTEFTLTISSLQSEDFAVYFCQQDGSSPRTFGGGTKVEIK

SEQ ID NO: 10671 - protein, 122 aa, Artificial Sequence; identical to SEQ ID NO: 6246
  Description of Artificial Sequence: Synthetic polypeptide
  VH of XENP019142

SEQ ID NO: 10672 - protein, 107 aa, Artificial Sequence
  Description of Artificial Sequence: Synthetic polypeptide
  VL of XENP019142
SIVMTQSPATLSVSPGERATLSCRASQSVSNDVAWYQQKPGQSPRLLINYASWRYTSVPDRFTGSGYGTEFTLTISSLQSEDFAVYFCQQDGSSPRTFGGGTKVEIK

SEQ ID NO: 10673 - protein, 5 aa, Artificial Sequence
  Description of Artificial Sequence: Synthetic peptide
  XENP019142 vhCDR1
NYWMN

SEQ ID NO: 10674 - protein, 19 aa, Artificial Sequence
  Description of Artificial Sequence: Synthetic peptide
  XENP019142 vhCDR2
EIRLKSNNYATHYAEPVKG

SEQ ID NO: 10675 - protein, 11 aa, Artificial Sequence
  Description of Artificial Sequence: Synthetic peptide
  XENP019142 vhCDR3
YYGNYGGYFDV

SEQ ID NO: 10676 - protein, 11 aa, Artificial Sequence
  Description of Artificial Sequence: Synthetic peptide
  XENP019142 vlCDR1
RASQSVSNDVA

SEQ ID NO: 10677 - protein, 7 aa, Artificial Sequence
  Description of Artificial Sequence: Synthetic peptide
  XENP019142 vlCDR2
YASWRYT

SEQ ID NO: 10678 - protein, 9 aa, Artificial Sequence
  Description of Artificial Sequence: Synthetic peptide
  XENP019142 vlCDR3
QQDGSSPRT

SEQ ID NO: 10679 - protein, 249 aa, Artificial Sequence
  Description of Artificial Sequence: Synthetic polypeptide
  XENP019143 1G6_H1_L1.182_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASWRYTSVPDRFTGSGYGTEFTLTISSLQSEDFAVYFCQQDWSSPRTFGGGTKVEIK

SEQ ID NO: 10680 - protein, 122 aa, Artificial Sequence; identical to SEQ ID NO: 6246
  Description of Artificial Sequence: Synthetic polypeptide
  VH of XENP019143

SEQ ID NO: 10681 - protein, 107 aa, Artificial Sequence
  Description of Artificial Sequence: Synthetic polypeptide
  VL of XENP019143
SIVMTQSPATLSVSPGERATLSCRASQSVGNDVAWYQQKPGQSPRLLINYASWRYTSVPDRFTGSGYGTEFTLTISSLQSEDFAVYFCQQDWSSPRTFGGGTKVEIK

SEQ ID NO: 10682 - protein, 5 aa, Artificial Sequence
  Description of Artificial Sequence: Synthetic peptide
  XENP019143 vhCDR1
NYWMN

SEQ ID NO: 10683 - protein, 19 aa, Artificial Sequence
  Description of Artificial Sequence: Synthetic peptide
  XENP019143 vhCDR2
EIRLKSNNYATHYAEPVKG

SEQ ID NO: 10684 - protein, 11 aa, Artificial Sequence
  Description of Artificial Sequence: Synthetic peptide
  XENP019143 vhCDR3
YYGNYGGYFDV

SEQ ID NO: 10685 - protein, 11 aa, Artificial Sequence
  Description of Artificial Sequence: Synthetic peptide
  XENP019143 vlCDR1
RASQSVGNDVA

SEQ ID NO: 10686 - protein, 7 aa, Artificial Sequence
  Description of Artificial Sequence: Synthetic peptide
  XENP019143 vlCDR2
YASWRYT

SEQ ID NO: 10687 - protein, 9 aa, Artificial Sequence
  Description of Artificial Sequence: Synthetic peptide
  XENP019143 vlCDR3
QQDWSSPRT

SEQ ID NO: 10688 - protein, 249 aa, Artificial Sequence
  Description of Artificial Sequence: Synthetic polypeptide
  XENP019144 1G6_H1_L1.183_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASWRYTSVPDRFTGSGYGTEFTLTISSLQSEDFAVYFCQQDFSSPRTFGGGTKVEIK

SEQ ID NO: 10689 - protein, 122 aa, Artificial Sequence; identical to SEQ ID NO: 6246
  Description of Artificial Sequence: Synthetic polypeptide
  VH of XENP019144

SEQ ID NO: 10690 - protein, 107 aa, Artificial Sequence
  Description of Artificial Sequence: Synthetic polypeptide
  VL of XENP019144
SIVMTQSPATLSVSPGERATLSCRASQSVGNDVAWYQQKPGQSPRLLINYASWRYTSVPDRFTGSGYGTEFTLTISSLQSEDFAVYFCQQDFSSPRTFGGGTKVEIK

SEQ ID NO: 10691 - protein, 5 aa, Artificial Sequence
  Description of Artificial Sequence: Synthetic peptide
  XENP019144 vhCDR1
NYWMN

SEQ ID NO: 10692 - protein, 19 aa, Artificial Sequence
  Description of Artificial Sequence: Synthetic peptide
  XENP019144 vhCDR2
EIRLKSNNYATHYAEPVKG

SEQ ID NO: 10693 - protein, 11 aa, Artificial Sequence
  Description of Artificial Sequence: Synthetic peptide
  XENP019144 vhCDR3
YYGNYGGYFDV

SEQ ID NO: 10694 - protein, 11 aa, Artificial Sequence
  Description of Artificial Sequence: Synthetic peptide
  XENP019144 vlCDR1
RASQSVGNDVA

SEQ ID NO: 10695 - protein, 7 aa, Artificial Sequence
  Description of Artificial Sequence: Synthetic peptide
  XENP019144 vlCDR2
YASWRYT

SEQ ID NO: 10696 - protein, 9 aa, Artificial Sequence
  Description of Artificial Sequence: Synthetic peptide
  XENP019144 vlCDR3
QQDFSSPRT

SEQ ID NO: 10697 - protein, 249 aa, Artificial Sequence
  Description of Artificial Sequence: Synthetic polypeptide
  XENP019145 1G6_H1_L1.184_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASWRYTSVPDRFTGSGYGTEFTLTISSLQSEDFAVYFCQQDGSSPRTFGGGTKVEIK

SEQ ID NO: 10698 - protein, 122 aa, Artificial Sequence; identical to SEQ ID NO: 6246
  Description of Artificial Sequence: Synthetic polypeptide
  VH of XENP019145

SEQ ID NO: 10699 - protein, 107 aa, Artificial Sequence
  Description of Artificial Sequence: Synthetic polypeptide
  VL of XENP019145
SIVMTQSPATLSVSPGERATLSCRASQSVGNDVAWYQQKPGQSPRLLINYASWRYTSVPDRFTGSGYGTEFTLTISSLQSEDFAVYFCQQDGSSPRTFGGGTKVEIK

SEQ ID NO: 10700 - protein, 5 aa, Artificial Sequence
  Description of Artificial Sequence: Synthetic peptide
  XENP019145 vhCDR1
NYWMN

SEQ ID NO: 10701 - protein, 19 aa, Artificial Sequence
  Description of Artificial Sequence: Synthetic peptide
  XENP019145 vhCDR2
EIRLKSNNYATHYAEPVKG

SEQ ID NO: 10702 - protein, 11 aa, Artificial Sequence
  Description of Artificial Sequence: Synthetic peptide
  XENP019145 vhCDR3
YYGNYGGYFDV

SEQ ID NO: 10703 - protein, 11 aa, Artificial Sequence
  Description of Artificial Sequence: Synthetic peptide
  XENP019145 vlCDR1
RASQSVGNDVA

SEQ ID NO: 10704 - protein, 7 aa, Artificial Sequence
  Description of Artificial Sequence: Synthetic peptide
  XENP019145 vlCDR2
YASWRYT

SEQ ID NO: 10705 - protein, 9 aa, Artificial Sequence
  Description of Artificial Sequence: Synthetic peptide
  XENP019145 vlCDR3
QQDGSSPRT

SEQ ID NO: 10706 - protein, 249 aa, Artificial Sequence
  Description of Artificial Sequence: Synthetic polypeptide
  XENP019146 1G6_H1_L1.185_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSEIVMTQSPATLSVSPGERATLSCRASQSVSNDLAWYQQKPGQSPRLLINYASHRYTGVPARFSGSGYGTEFTLTISSLQSEDFAVYYCQQDYSSPRTFGGGTKVEIK

SEQ ID NO: 10707 - protein, 122 aa, Artificial Sequence; identical to SEQ ID NO: 6246
  Description of Artificial Sequence: Synthetic polypeptide
  VH of XENP019146

SEQ ID NO: 10708 - protein, 107 aa, Artificial Sequence
  Description of Artificial Sequence: Synthetic polypeptide
  VL of XENP019146
EIVMTQSPATLSVSPGERATLSCRASQSVSNDLAWYQQKPGQSPRLLINYASHRYTGVPARFSGSGYGTEFTLTISSLQSEDFAVYYCQQDYSSPRTFGGGTKVEIK

SEQ ID NO: 10709 - protein, 5 aa, Artificial Sequence
  Description of Artificial Sequence: Synthetic peptide
  XENP019146 vhCDR1
NYWMN

SEQ ID NO: 10710 - protein, 19 aa, Artificial Sequence
  Description of Artificial Sequence: Synthetic peptide
  XENP019146 vhCDR2
EIRLKSNNYATHYAEPVKG

SEQ ID NO: 10711 - protein, 11 aa, Artificial Sequence
  Description of Artificial Sequence: Synthetic peptide
  XENP019146 vhCDR3
YYGNYGGYFDV

SEQ ID NO: 10712 - protein, 11 aa, Artificial Sequence
  Description of Artificial Sequence: Synthetic peptide
  XENP019146 vlCDR1
RASQSVSNDLA

SEQ ID NO: 10713 - protein, 7 aa, Artificial Sequence
  Description of Artificial Sequence: Synthetic peptide
  XENP019146 vlCDR2
YASHRYT

SEQ ID NO: 10714 - protein, 9 aa, Artificial Sequence
  Description of Artificial Sequence: Synthetic peptide
  XENP019146 vlCDR3
QQDYSSPRT

SEQ ID NO: 10715 - protein, 249 aa, Artificial Sequence
  Description of Artificial Sequence: Synthetic polypeptide
  XENP019147 1G6_H1_L1.186_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSDIVMTQSPATLSVSPGERATLSCRASQSVSNDLAWYQQKPGQSPRLLINYASHRYTGVPDRFSGSGYGTEFTLTISSLQSEDFAVYYCQQDYSSPRTFGGGTKVEIK

SEQ ID NO: 10716 - protein, 122 aa, Artificial Sequence; identical to SEQ ID NO: 6246
  Description of Artificial Sequence: Synthetic polypeptide
  VH of XENP019147

SEQ ID NO: 10717 - protein, 107 aa, Artificial Sequence
  Description of Artificial Sequence: Synthetic polypeptide
  VL of XENP019147
DIVMTQSPATLSVSPGERATLSCRASQSVSNDLAWYQQKPGQSPRLLINYASHRYTGVPDRFSGSGYGTEFTLTISSLQSEDFAVYYCQQDYSSPRTFGGGTKVEIK

SEQ ID NO: 10718 - protein, 5 aa, Artificial Sequence
  Description of Artificial Sequence: Synthetic peptide
  XENP019147 vhCDR1
NYWMN

SEQ ID NO: 10719 - protein, 19 aa, Artificial Sequence
  Description of Artificial Sequence: Synthetic peptide
  XENP019147 vhCDR2
EIRLKSNNYATHYAEPVKG

SEQ ID NO: 10720 - protein, 11 aa, Artificial Sequence
  Description of Artificial Sequence: Synthetic peptide
  XENP019147 vhCDR3
YYGNYGGYFDV

SEQ ID NO: 10721 - protein, 11 aa, Artificial Sequence
  Description of Artificial Sequence: Synthetic peptide
  XENP019147 vlCDR1
RASQSVSNDLA

SEQ ID NO: 10722 - protein, 7 aa, Artificial Sequence
  Description of Artificial Sequence: Synthetic peptide
  XENP019147 vlCDR2
YASHRYT

SEQ ID NO: 10723 - protein, 9 aa, Artificial Sequence
  Description of Artificial Sequence: Synthetic peptide
  XENP019147 vlCDR3
QQDYSSPRT

SEQ ID NO: 10724 - protein, 249 aa, Artificial Sequence
  Description of Artificial Sequence: Synthetic polypeptide
  XENP019148 1G6_H1.257_L1.152_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGRGTLVTVSSGKPGSGKPGSGKPGSGKPGSSIVMTQSPATLSVSPGERATLSCRASQSVSNDVAWYQQKPGESPRLLINYASHRYTGVPDRFTGSGYGTEFTLTISSLQSEDFAVYFCQQDYSSPRTFGGGTKVEIK

SEQ ID NO: 10725 - protein, 122 aa, Artificial Sequence; identical to SEQ ID NO: 10167
  Description of Artificial Sequence: Synthetic polypeptide
  VH of XENP019148

SEQ ID NO: 10726 - protein, 107 aa, Artificial Sequence; identical to SEQ ID NO: 10411
  Description of Artificial Sequence: Synthetic polypeptide
  VL of XENP019148

SEQ ID NO: 10727 - protein, 5 aa, Artificial Sequence
  Description of Artificial Sequence: Synthetic peptide
  XENP019148 vhCDR1
NYWMN

SEQ ID NO: 10728 - protein, 19 aa, Artificial Sequence
  Description of Artificial Sequence: Synthetic peptide
  XENP019148 vhCDR2
EIRLKSNNYATHYAEPVKG

SEQ ID NO: 10729 - protein, 11 aa, Artificial Sequence
  Description of Artificial Sequence: Synthetic peptide
  XENP019148 vhCDR3
YYGNYGGYFDV

SEQ ID NO: 10730 - protein, 11 aa, Artificial Sequence
  Description of Artificial Sequence: Synthetic peptide
  XENP019148 vlCDR1
RASQSVSNDVA

SEQ ID NO: 10731 - protein, 7 aa, Artificial Sequence
  Description of Artificial Sequence: Synthetic peptide
  XENP019148 vlCDR2
YASHRYT

SEQ ID NO: 10732 - protein, 9 aa, Artificial Sequence
  Description of Artificial Sequence: Synthetic peptide
  XENP019148 vlCDR3
QQDYSSPRT

SEQ ID NO: 10733 - protein, 249 aa, Artificial Sequence
  Description of Artificial Sequence: Synthetic polypeptide
  XENP019149 1G6_H1.257_L1.151_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGRGTLVTVSSGKPGSGKPGSGKPGSGKPGSSIVMTQSPATLSVSPGERATLSCRASQSVSNDVAWYQQKPEQSPRLLINYASHRYTGVPDRFTGSGYGTEFTLTISSLQSEDFAVYFCQQDYSSPRTFGGGTKVEIK

SEQ ID NO: 10734 - protein, 122 aa, Artificial Sequence; identical to SEQ ID NO: 10167
  Description of Artificial Sequence: Synthetic polypeptide
  VH of XENP019149

SEQ ID NO: 10735 - protein, 107 aa, Artificial Sequence; identical to SEQ ID NO: 10402
  Description of Artificial Sequence: Synthetic polypeptide
  VL of XENP019149

SEQ ID NO: 10736 - protein, 5 aa, Artificial Sequence
  Description of Artificial Sequence: Synthetic peptide
  XENP019149 vhCDR1
NYWMN

SEQ ID NO: 10737 - protein, 19 aa, Artificial Sequence
  Description of Artificial Sequence: Synthetic peptide
  XENP019149 vhCDR2
EIRLKSNNYATHYAEPVKG

SEQ ID NO: 10738 - protein, 11 aa, Artificial Sequence
  Description of Artificial Sequence: Synthetic peptide
  XENP019149 vhCDR3
YYGNYGGYFDV

SEQ ID NO: 10739 - protein, 11 aa, Artificial Sequence
  Description of Artificial Sequence: Synthetic peptide
  XENP019149 vlCDR1
RASQSVSNDVA

SEQ ID NO: 10740 - protein, 7 aa, Artificial Sequence
  Description of Artificial Sequence: Synthetic peptide
  XENP019149 vlCDR2
YASHRYT

SEQ ID NO: 10741 - protein, 9 aa, Artificial Sequence
  Description of Artificial Sequence: Synthetic peptide
  XENP019149 vlCDR3
QQDYSSPRT

SEQ ID NO: 10742 - protein, 249 aa, Artificial Sequence
  Description of Artificial Sequence: Synthetic polypeptide
  XENP019150 1G6_H1.139_L1.134_scFv(GKPGS)4
EVQLVESGGGLVKPGGSLRLSCAASGFTFSNYWMNWVRQAPGKGLEWVGEIRLKSNNYATDYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYKSPRTFGGGTKVEIK

SEQ ID NO: 10743 - protein, 122 aa, Artificial Sequence; identical to SEQ ID NO: 7602
  Description of Artificial Sequence: Synthetic polypeptide
  VH of XENP019150

SEQ ID NO: 10744 - protein, 107 aa, Artificial Sequence; identical to SEQ ID NO: 9700
  Description of Artificial Sequence: Synthetic polypeptide
  VL of XENP019150

SEQ ID NO: 10745 - protein, 5 aa, Artificial Sequence
  Description of Artificial Sequence: Synthetic peptide
  XENP019150 vhCDR1
NYWMN

SEQ ID NO: 10746 - protein, 19 aa, Artificial Sequence
  Description of Artificial Sequence: Synthetic peptide
  XENP019150 vhCDR2
EIRLKSNNYATDYAEPVKG

SEQ ID NO: 10747 - protein, 11 aa, Artificial Sequence
  Description of Artificial Sequence: Synthetic peptide
  XENP019150 vhCDR3
YYGNYGGYFDV

SEQ ID NO: 10748 - protein, 11 aa, Artificial Sequence
  Description of Artificial Sequence: Synthetic peptide
  XENP019150 vlCDR1
RASQSVSNDVA

SEQ ID NO: 10749 - protein, 7 aa, Artificial Sequence
  Description of Artificial Sequence: Synthetic peptide
  XENP019150 vlCDR2
YASHRYT

SEQ ID NO: 10750 - protein, 9 aa, Artificial Sequence
  Description of Artificial Sequence: Synthetic peptide
  XENP019150 vlCDR3
QQDYKSPRT

SEQ ID NO: 10751 - protein, 249 aa, Artificial Sequence
  Description of Artificial Sequence: Synthetic polypeptide
  XENP019151 1G6_H1.48_L1.187_scFv(GKPGS)4
EVQLVESGGGLVKPGGSLRLSCAASGFTFSNYWMNWVRKAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGESPRLLINYASHRYTGVPDRFTGSGYGTEFTLTISSLQSEDFAVYFCQQDYSSPRTFGGGTKVEIK

SEQ ID NO: 10752 - protein, 122 aa, Artificial Sequence; identical to SEQ ID NO: 6786
  Description of Artificial Sequence: Synthetic polypeptide
  VH of XENP019151

SEQ ID NO: 10753 - protein, 107 aa, Artificial Sequence; identical to SEQ ID NO: 10411
  Description of Artificial Sequence: Synthetic polypeptide
  VL of XENP019151

SEQ ID NO: 10754 - protein, 11 aa, Artificial Sequence
  Description of Artificial Sequence: Synthetic peptide
  XENP019151 vlCDR1
RASQSVSNDVA

SEQ ID NO: 10755 - protein, 7 aa, Artificial Sequence
  Description of Artificial Sequence: Synthetic peptide
  XENP019151 vlCDR2
YASHRYT

SEQ ID NO: 10756 - protein, 9 aa, Artificial Sequence
  Description of Artificial Sequence: Synthetic peptide
  XENP019151 vlCDR3
QQDYSSPRT

SEQ ID NO: 10757 - protein, 249 aa, Artificial Sequence
  Description of Artificial Sequence: Synthetic polypeptide
  XENP019152 1G6_H1.48_L1.151_scFv(GKPGS)4
EVQLVESGGGLVKPGGSLRLSCAASGFTFSNYWMNWVRKAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPEQSPRLLINYASHRYTGVPDRFTGSGYGTEFTLTISSLQSEDFAVYFCQQDYSSPRTFGGGTKVEIK

SEQ ID NO: 10758 - protein, 122 aa, Artificial Sequence; identical to SEQ ID NO: 6786
  Description of Artificial Sequence: Synthetic polypeptide
  VH of XENP019152

SEQ ID NO: 10759 - protein, 107 aa, Artificial Sequence; identical to SEQ ID NO: 10402
  Description of Artificial Sequence: Synthetic polypeptide
  VL of XENP019152

SEQ ID NO: 10760 - protein, 11 aa, Artificial Sequence
  Description of Artificial Sequence: Synthetic peptide
  XENP019152 vlCDR1
RASQSVSNDVA

SEQ ID NO: 10761 - protein, 7 aa, Artificial Sequence
  Description of Artificial Sequence: Synthetic peptide
  XENP019152 vlCDR2
YASHRYT

SEQ ID NO: 10762 - protein, 9 aa, Artificial Sequence
  Description of Artificial Sequence: Synthetic peptide
  XENP019152 vlCDR3
QQDYSSPRT

SEQ ID NO: 10763 - protein, 249 aa, Artificial Sequence
  Description of Artificial Sequence: Synthetic polypeptide
  XENP019153 1G6_H1.43_L1.159_scFv(GKPGS)4
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCKQDYSSPRTFGGGTKVEIK

SEQ ID NO: 10764 - protein, 122 aa, Artificial Sequence; identical to SEQ ID NO: 6741
  Description of Artificial Sequence: Synthetic polypeptide
  VH of XENP019153

SEQ ID NO: 10765 - protein, 107 aa, Artificial Sequence; identical to SEQ ID NO: 10474
  Description of Artificial Sequence: Synthetic polypeptide
  VL of XENP019153

SEQ ID NO: 10766 - protein, 5 aa, Artificial Sequence
  Description of Artificial Sequence: Synthetic peptide
  XENP019153 vhCDR1
NYWMD

SEQ ID NO: 10767 - protein, 19 aa, Artificial Sequence
  Description of Artificial Sequence: Synthetic peptide
  XENP019153 vhCDR2
EIRLKSNNYATHYAEPVKG

SEQ ID NO: 10768 - protein, 11 aa, Artificial Sequence
  Description of Artificial Sequence: Synthetic peptide
  XENP019153 vhCDR3
YYGNYGGYFDV

SEQ ID NO: 10769 - protein, 11 aa, Artificial Sequence
  Description of Artificial Sequence: Synthetic peptide
  XENP019153 vlCDR1
RASQSVSNDVA

SEQ ID NO: 10770 - protein, 7 aa, Artificial Sequence
  Description of Artificial Sequence: Synthetic peptide
  XENP019153 vlCDR2
YASHRYT

SEQ ID NO: 10771 - protein, 9 aa, Artificial Sequence
  Description of Artificial Sequence: Synthetic peptide
  XENP019153 vlCDR3
KQDYSSPRT

SEQ ID NO: 10772 - protein, 249 aa, Artificial Sequence
  Description of Artificial Sequence: Synthetic polypeptide
  XENP019154 1G6_H1.90_L1.119_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDWSSPRTFGGGTKVEIK

SEQ ID NO: 10773 - protein, 122 aa, Artificial Sequence; identical to SEQ ID NO: 7161
  Description of Artificial Sequence: Synthetic polypeptide
  VH of XENP019154

SEQ ID NO: 10774 - protein, 107 aa, Artificial Sequence; identical to SEQ ID NO: 9565
  Description of Artificial Sequence: Synthetic polypeptide
  VL of XENP019154

SEQ ID NO: 10775 - protein, 5 aa, Artificial Sequence
  Description of Artificial Sequence: Synthetic peptide
  XENP019154 vhCDR1
NYWMN

SEQ ID NO: 10776 - protein, 19 aa, Artificial Sequence
  Description of Artificial Sequence: Synthetic peptide
  XENP019154 vhCDR2
EIRLYSNNYATHYAEPVKG

SEQ ID NO: 10777 - protein, 11 aa, Artificial Sequence
  Description of Artificial Sequence: Synthetic peptide
  XENP019154 vhCDR3
YYGNYGGYFDV

SEQ ID NO: 10778 - protein, 11 aa, Artificial Sequence
  Description of Artificial Sequence: Synthetic peptide
  XENP019154 vlCDR1
RASQSVSNDVA

SEQ ID NO: 10779 - protein, 7 aa, Artificial Sequence
  Description of Artificial Sequence: Synthetic peptide
  XENP019154 vlCDR2
YASHRYT

SEQ ID NO: 10780 - protein, 9 aa, Artificial Sequence
  Description of Artificial Sequence: Synthetic peptide
  XENP019154 vlCDR3
QQDWSSPRT

SEQ ID NO: 10781 - protein, 249 aa, Artificial Sequence
  Description of Artificial Sequence: Synthetic polypeptide
  XENP019155 1G6_H1.90_L1.23_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTGVPDRFTGSGYGTEFTLTISSLQSEDFAVYFCQQDYSSPRTFGGGTKVEIK

SEQ ID NO: 10782 - protein, 122 aa, Artificial Sequence; identical to SEQ ID NO: 7161
  Description of Artificial Sequence: Synthetic polypeptide
  VH of XENP019155

SEQ ID NO: 10783 - protein, 107 aa, Artificial Sequence; identical to SEQ ID NO: 8701
  Description of Artificial Sequence: Synthetic polypeptide
  VL of XENP019155

SEQ ID NO: 10784 - protein, 5 aa, Artificial Sequence
  Description of Artificial Sequence: Synthetic peptide
  XENP019155 vhCDR1
NYWMN

SEQ ID NO: 10785 - protein, 19 aa, Artificial Sequence
  Description of Artificial Sequence: Synthetic peptide
  XENP019155 vhCDR2
EIRLYSNNYATHYAEPVKG

SEQ ID NO: 10786 - protein, 11 aa, Artificial Sequence
  Description of Artificial Sequence: Synthetic peptide
  XENP019155 vhCDR3
YYGNYGGYFDV

SEQ ID NO: 10787 - protein, 11 aa, Artificial Sequence
  Description of Artificial Sequence: Synthetic peptide
  XENP019155 vlCDR1
RASQSVGNDVA

SEQ ID NO: 10788 - protein, 7 aa, Artificial Sequence
  Description of Artificial Sequence: Synthetic peptide
  XENP019155 vlCDR2
YASHRYT

SEQ ID NO: 10789 - protein, 9 aa, Artificial Sequence
  Description of Artificial Sequence: Synthetic peptide
  XENP019155 vlCDR3
QQDYSSPRT

SEQ ID NO: 10790 - protein, 249 aa, Artificial Sequence
  Description of Artificial Sequence: Synthetic polypeptide
  XENP019156 1G6_H1.90_L1.67_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTGVPDRFTGSGYGTEFTLTISSLQSEDFAVYFCQQDYSSPRTFGGGTKVEIK

SEQ ID NO: 10791 - protein, 122 aa, Artificial Sequence; identical to SEQ ID NO: 7161
  Description of Artificial Sequence: Synthetic polypeptide
  VH of XENP019156

SEQ ID NO: 10792 - protein, 107 aa, Artificial Sequence; identical to SEQ ID NO: 9097
  Description of Artificial Sequence: Synthetic polypeptide
  VL of XENP019156

SEQ ID NO: 10793 - protein, 5 aa, Artificial Sequence
  Description of Artificial Sequence: Synthetic peptide
  XENP019156 vhCDR1
NYWMN

SEQ ID NO: 10794 - protein, 19 aa, Artificial Sequence
  Description of Artificial Sequence: Synthetic peptide
  XENP019156 vhCDR2
EIRLYSNNYATHYAEPVKG

SEQ ID NO: 10795 - protein, 11 aa, Artificial Sequence
  Description of Artificial Sequence: Synthetic peptide
  XENP019156 vhCDR3
YYGNYGGYFDV

SEQ ID NO: 10796 - protein, 11 aa, Artificial Sequence
  Description of Artificial Sequence: Synthetic peptide
  XENP019156 vlCDR1
RASQSVSNDVA

SEQ ID NO: 10797 - protein, 7 aa, Artificial Sequence
  Description of Artificial Sequence: Synthetic peptide
  XENP019156 vlCDR2
YASWRYT

SEQ ID NO: 10798 - protein, 9 aa, Artificial Sequence
  Description of Artificial Sequence: Synthetic peptide
  XENP019156 vlCDR3
QQDYSSPRT

SEQ ID NO: 10799 - protein, 249 aa, Artificial Sequence
  Description of Artificial Sequence: Synthetic polypeptide
  XENP019157 1G6_H1.90_L1.94_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTSVPDRFTGSGYGTEFTLTISSLQSEDFAVYFCQQDYSSPRTFGGGTKVEIK

SEQ ID NO: 10800 - protein, 122 aa, Artificial Sequence; identical to SEQ ID NO: 7161
  Description of Artificial Sequence: Synthetic polypeptide
  VH of XENP019157

SEQ ID NO: 10801 - protein, 107 aa, Artificial Sequence; identical to SEQ ID NO: 9340
  Description of Artificial Sequence: Synthetic polypeptide
  VL of XENP019157

SEQ ID NO: 10802 - protein, 5 aa, Artificial Sequence
  Description of Artificial Sequence: Synthetic peptide
  XENP019157 vhCDR1
NYWMN

SEQ ID NO: 10803 - protein, 19 aa, Artificial Sequence
  Description of Artificial Sequence: Synthetic peptide
  XENP019157 vhCDR2
EIRLYSNNYATHYAEPVKG

SEQ ID NO: 10804 - protein, 11 aa, Artificial Sequence
  Description of Artificial Sequence: Synthetic peptide
  XENP019157 vhCDR3
YYGNYGGYFDV

SEQ ID NO: 10805 - protein, 11 aa, Artificial Sequence
  Description of Artificial Sequence: Synthetic peptide
  XENP019157 vlCDR1
RASQSVSNDVA

SEQ ID NO: 10806 - protein, 7 aa, Artificial Sequence
  Description of Artificial Sequence: Synthetic peptide
  XENP019157 vlCDR2
YASHRYT

SEQ ID NO: 10807 - protein, 9 aa, Artificial Sequence
  Description of Artificial Sequence: Synthetic peptide
  XENP019157 vlCDR3
QQDYSSPRT

SEQ ID NO: 10808 - protein, 249 aa, Artificial Sequence
  Description of Artificial Sequence: Synthetic polypeptide
  XENP019158 1G6_H1.90_L1.116_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDFSSPRTFGGGTKVEIK

SEQ ID NO: 10809 - protein, 122 aa, Artificial Sequence; identical to SEQ ID NO: 7161
  Description of Artificial Sequence: Synthetic polypeptide
  VH of XENP019158

SEQ ID NO: 10810 - protein, 107 aa, Artificial Sequence; identical to SEQ ID NO: 9538
  Description of Artificial Sequence: Synthetic polypeptide
  VL of XENP019158

SEQ ID NO: 10811 - protein, 5 aa, Artificial Sequence
  Description of Artificial Sequence: Synthetic peptide
  XENP019158 vhCDR1
NYWMN

SEQ ID NO: 10812 - protein, 19 aa, Artificial Sequence
  Description of Artificial Sequence: Synthetic peptide
  XENP019158 vhCDR2
EIRLYSNNYATHYAEPVKG

SEQ ID NO: 10813 - protein, 11 aa, Artificial Sequence
  Description of Artificial Sequence: Synthetic peptide
  XENP019158 vhCDR3
YYGNYGGYFDV

SEQ ID NO: 10814 - protein, 11 aa, Artificial Sequence
  Description of Artificial Sequence: Synthetic peptide
  XENP019158 vlCDR1
RASQSVSNDVA

SEQ ID NO: 10815 - protein, 7 aa, Artificial Sequence
  Description of Artificial Sequence: Synthetic peptide
  XENP019158 vlCDR2
YASHRYT

SEQ ID NO: 10816 - protein, 9 aa, Artificial Sequence
  Description of Artificial Sequence: Synthetic peptide
  XENP019158 vlCDR3
QQDFSSPRT

SEQ ID NO: 10817 - protein, 249 aa, Artificial Sequence; identical to SEQ ID NO: 10772
  Description of Artificial Sequence: Synthetic polypeptide
  XENP019159 1G6_H1.155_L1.119_scFv(GKPGS)4

SEQ ID NO: 10818 - protein, 122 aa, Artificial Sequence; identical to SEQ ID NO: 7161
  Description of Artificial Sequence: Synthetic polypeptide
  VH of XENP019159

SEQ ID NO: 10819 - protein, 107 aa, Artificial Sequence; identical to SEQ ID NO: 9565
  Description of Artificial Sequence: Synthetic polypeptide
  VL of XENP019159

SEQ ID NO: 10820 - protein, 5 aa, Artificial Sequence
  Description of Artificial Sequence: Synthetic peptide
  XENP019159 vhCDR1
NYWMN

SEQ ID NO: 10821 - protein, 19 aa, Artificial Sequence
  Description of Artificial Sequence: Synthetic peptide
  XENP019159 vhCDR2
EIRLYSNNYATHYAEPVKG

SEQ ID NO: 10822 - protein, 11 aa, Artificial Sequence
  Description of Artificial Sequence: Synthetic peptide
  XENP019159 vhCDR3
YYGNYGGYFDV

SEQ ID NO: 10823 - protein, 11 aa, Artificial Sequence
  Description of Artificial Sequence: Synthetic peptide
  XENP019159 vlCDR1
RASQSVSNDVA

SEQ ID NO: 10824 - protein, 7 aa, Artificial Sequence
  Description of Artificial Sequence: Synthetic peptide
  XENP019159 vlCDR2
YASHRYT

SEQ ID NO: 10825 - protein, 9 aa, Artificial Sequence
  Description of Artificial Sequence: Synthetic peptide
  XENP019159 vlCDR3
QQDWSSPRT

SEQ ID NO: 10826 - protein, 249 aa, Artificial Sequence
  Description of Artificial Sequence: Synthetic polypeptide
  XENP019182 1G6_H1_L1.190_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTGVPDRFTGSGYGTEFTLTISSLQSEDFAVYFCQQDFSSPRTFGGGTKVEIK

SEQ ID NO: 10827 - protein, 122 aa, Artificial Sequence; identical to SEQ ID NO: 6246
  Description of Artificial Sequence: Synthetic polypeptide
  VH of XENP019182

SEQ ID NO: 10828 - protein, 107 aa, Artificial Sequence
  Description of Artificial Sequence: Synthetic polypeptide
  VL of XENP019182
SIVMTQSPATLSVSPGERATLSCRASQSVGNDVAWYQQKPGQSPRLLINYASHRYTGVPDRFTGSGYGTEFTLTISSLQSEDFAVYFCQQDFSSPRTFGGGTKVEIK

SEQ ID NO: 10829 - protein, 5 aa, Artificial Sequence
  Description of Artificial Sequence: Synthetic peptide
  XENP019182 vhCDR1
NYWMN

SEQ ID NO: 10830 - protein, 19 aa, Artificial Sequence
  Description of Artificial Sequence: Synthetic peptide
  XENP019182 vhCDR2
EIRLKSNNYATHYAEPVKG

SEQ ID NO: 10831 - protein, 11 aa, Artificial Sequence
  Description of Artificial Sequence: Synthetic peptide
  XENP019182 vhCDR3
YYGNYGGYFDV

SEQ ID NO: 10832 - protein, 11 aa, Artificial Sequence
  Description of Artificial Sequence: Synthetic peptide
  XENP019182 vlCDR1
RASQSVGNDVA

SEQ ID NO: 10833 - protein, 7 aa, Artificial Sequence
  Description of Artificial Sequence: Synthetic peptide
  XENP019182 vlCDR2
YASHRYT

SEQ ID NO: 10834 - protein, 9 aa, Artificial Sequence
  Description of Artificial Sequence: Synthetic peptide
  XENP019182 vlCDR3
QQDFSSPRT

SEQ ID NO: 10835 - protein, 249 aa, Artificial Sequence
  Description of Artificial Sequence: Synthetic polypeptide
  XENP019183 1G6_H1_L1.191_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTGVPDRFTGSGYGTEFTLTISSLQSEDFAVYFCQQDWSSPRTFGGGTKVEIK

SEQ ID NO: 10836 - protein, 122 aa, Artificial Sequence; identical to SEQ ID NO: 6246
  Description of Artificial Sequence: Synthetic polypeptide
  VH of XENP019183

SEQ ID NO: 10837 - protein, 107 aa, Artificial Sequence
  Description of Artificial Sequence: Synthetic polypeptide
  VL of XENP019183
SIVMTQSPATLSVSPGERATLSCRASQSVGNDVAWYQQKPGQSPRLLINYASHRYTGVPDRFTGSGYGTEFTLTISSLQSEDFAVYFCQQDWSSPRTFGGGTKVEIK

SEQ ID NO: 10838 - protein, 5 aa, Artificial Sequence
  Description of Artificial Sequence: Synthetic peptide
  XENP019183 vhCDR1
NYWMN

SEQ ID NO: 10839 - protein, 19 aa, Artificial Sequence
  Description of Artificial Sequence: Synthetic peptide
  XENP019183 vhCDR2
EIRLKSNNYATHYAEPVKG

SEQ ID NO: 10840 - protein, 11 aa, Artificial Sequence
  Description of Artificial Sequence: Synthetic peptide
  XENP019183 vhCDR3
YYGNYGGYFDV

SEQ ID NO: 10841 - protein, 11 aa, Artificial Sequence
  Description of Artificial Sequence: Synthetic peptide
  XENP019183 vlCDR1
RASQSVGNDVA

SEQ ID NO: 10842 - protein, 7 aa, Artificial Sequence
  Description of Artificial Sequence: Synthetic peptide
  XENP019183 vlCDR2
YASHRYT

SEQ ID NO: 10843 - protein, 9 aa, Artificial Sequence
  Description of Artificial Sequence: Synthetic peptide
  XENP019183 vlCDR3
QQDWSSPRT

SEQ ID NO: 10844 - protein, 480 aa, Artificial Sequence
  Description of Artificial Sequence: Synthetic polypeptide
  XENP019202 1G6_H1.278_L1_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10845 - protein, 122 aa, Artificial Sequence
  Description of Artificial Sequence: Synthetic polypeptide
  VH of XENP019202
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 10846 - protein, 338 aa, Artificial Sequence
  Description of Artificial Sequence: Synthetic polypeptide
  VL of XENP019202
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10847 - protein, 5 aa, Artificial Sequence
  Description of Artificial Sequence: Synthetic peptide
  XENP019202 vhCDR1
NYWMN

SEQ ID NO: 10848 - protein, 19 aa, Artificial Sequence
  Description of Artificial Sequence: Synthetic peptide
  XENP019202 vhCDR2
EIRLYSNNYATHYAESVKG

SEQ ID NO: 10849 - protein, 11 aa, Artificial Sequence
  Description of Artificial Sequence: Synthetic peptide
  XENP019202 vhCDR3
YYGNYGGYFDV

SEQ ID NO: 10850 - protein, 11 aa, Artificial Sequence
  Description of Artificial Sequence: Synthetic peptide
  XENP019202 vlCDR1
RASQSVSNDVA

SEQ ID NO: 10851 - protein, 7 aa, Artificial Sequence
  Description of Artificial Sequence: Synthetic peptide
  XENP019202 vlCDR2
YASHRYT

SEQ ID NO: 10852 - protein, 9 aa, Artificial Sequence
  Description of Artificial Sequence: Synthetic peptide
  XENP019202 vlCDR3
QQDYSSPRT

SEQ ID NO: 10853 - protein, 249 aa, Artificial Sequence
  Description of Artificial Sequence: Synthetic polypeptide
  XENP019203 1G6_H1_L1.188_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSEIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIK

SEQ ID NO: 10854 - protein, 122 aa, Artificial Sequence; identical to SEQ ID NO: 6246
  Description of Artificial Sequence: Synthetic polypeptide
  VH of XENP019203

SEQ ID NO: 10855 - protein, 107 aa, Artificial Sequence
  Description of Artificial Sequence: Synthetic polypeptide
  VL of XENP019203
EIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIK

SEQ ID NO: 10856 - protein, 5 aa, Artificial Sequence
  Description of Artificial Sequence: Synthetic peptide
  XENP019203 vhCDR1
NYWMN

SEQ ID NO: 10857 - protein, 19 aa, Artificial Sequence
  Description of Artificial Sequence: Synthetic peptide
  XENP019203 vhCDR2
EIRLKSNNYATHYAEPVKG

SEQ ID NO: 10858 - protein, 11 aa, Artificial Sequence
  Description of Artificial Sequence: Synthetic peptide
  XENP019203 vhCDR3
YYGNYGGYFDV

SEQ ID NO: 10859 - protein, 11 aa, Artificial Sequence
  Description of Artificial Sequence: Synthetic peptide
  XENP019203 vlCDR1
RASQSVGNDVA

SEQ ID NO: 10860 - protein, 7 aa, Artificial Sequence
  Description of Artificial Sequence: Synthetic peptide
  XENP019203 vlCDR2
YASHRYT

SEQ ID NO: 10861 - protein, 9 aa, Artificial Sequence
  Description of Artificial Sequence: Synthetic peptide
  XENP019203 vlCDR3
QQDFSSPRT

SEQ ID NO: 10862 - protein, 249 aa, Artificial Sequence
  Description of Artificial Sequence: Synthetic polypeptide
  XENP019204 1G6_H1_L1.189_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10863 - protein, 122 aa, Artificial Sequence; identical to SEQ ID NO: 6246
  Description of Artificial Sequence: Synthetic polypeptide
  VH of XENP019204

SEQ ID NO: 10864 - protein, 107 aa, Artificial Sequence
  Description of Artificial Sequence: Synthetic polypeptide
  VL of XENP019204
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10865 - protein, 5 aa, Artificial Sequence
  Description of Artificial Sequence: Synthetic peptide
  XENP019204 vhCDR1
NYWMN

SEQ ID NO: 10866 - protein, 19 aa, Artificial Sequence
  Description of Artificial Sequence: Synthetic peptide
  XENP019204 vhCDR2
EIRLKSNNYATHYAEPVKG

SEQ ID NO: 10867 - protein, 11 aa, Artificial Sequence
  Description of Artificial Sequence: Synthetic peptide
  XENP019204 vhCDR3
YYGNYGGYFDV

SEQ ID NO: 10868 - protein, 11 aa, Artificial Sequence
  Description of Artificial Sequence: Synthetic peptide
  XENP019204 vlCDR1
RASQSVGNDVA

SEQ ID NO: 10869 - protein, 7 aa, Artificial Sequence
  Description of Artificial Sequence: Synthetic peptide
  XENP019204 vlCDR2
YASHRYT

SEQ ID NO: 10870 - protein, 9 aa, Artificial Sequence
  Description of Artificial Sequence: Synthetic peptide
  XENP019204 vlCDR3
QQDFSSPRT

SEQ ID NO: 10871 - protein, 249 aa, Artificial Sequence
  Description of Artificial Sequence: Synthetic polypeptide
  XENP019205 1G6_H1.278_L1.188_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIK

SEQ ID NO: 10872 - protein, 122 aa, Artificial Sequence; identical to SEQ ID NO: 10845
  Description of Artificial Sequence: Synthetic polypeptide
  VH of XENP019205

SEQ ID NO: 10873 - protein, 107 aa, Artificial Sequence; identical to SEQ ID NO: 10855
  Description of Artificial Sequence: Synthetic polypeptide
  VL of XENP019205

SEQ ID NO: 10874 - protein, 5 aa, Artificial Sequence
  Description of Artificial Sequence: Synthetic peptide
  XENP019205 vhCDR1
NYWMN

SEQ ID NO: 10875 - protein, 19 aa, Artificial Sequence
  Description of Artificial Sequence: Synthetic peptide
  XENP019205 vhCDR2
EIRLYSNNYATHYAESVKG

SEQ ID NO: 10876 - protein, 11 aa, Artificial Sequence
  Description of Artificial Sequence: Synthetic peptide
  XENP019205 vhCDR3
YYGNYGGYFDV

SEQ ID NO: 10877 - protein, 11 aa, Artificial Sequence
  Description of Artificial Sequence: Synthetic peptide
  XENP019205 vlCDR1
RASQSVGNDVA

SEQ ID NO: 10878 - protein, 7 aa, Artificial Sequence
  Description of Artificial Sequence: Synthetic peptide
  XENP019205 vlCDR2
YASHRYT

SEQ ID NO: 10879 - protein, 9 aa, Artificial Sequence
  Description of Artificial Sequence: Synthetic peptide
  XENP019205 vlCDR3
QQDFSSPRT

SEQ ID NO: 10880 - protein, 249 aa, Artificial Sequence
  Description of Artificial Sequence: Synthetic polypeptide
  XENP019206 1G6_H1.278_L1.189_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10881 - protein, 122 aa, Artificial Sequence; identical to SEQ ID NO: 10845
  Description of Artificial Sequence: Synthetic polypeptide
  VH of XENP019206

SEQ ID NO: 10882 - protein, 107 aa, Artificial Sequence; identical to SEQ ID NO: 10864
  Description of Artificial Sequence: Synthetic polypeptide
  VL of XENP019206

SEQ ID NO: 10883 - protein, 5 aa, Artificial Sequence
  Description of Artificial Sequence: Synthetic peptide
  XENP019206 vhCDR1
NYWMN

SEQ ID NO: 10884 - protein, 19 aa, Artificial Sequence
  Description of Artificial Sequence: Synthetic peptide
  XENP019206 vhCDR2
EIRLYSNNYATHYAESVKG

SEQ ID NO: 10885 - protein, 11 aa, Artificial Sequence
  Description of Artificial Sequence: Synthetic peptide
  XENP019206 vhCDR3
YYGNYGGYFDV

SEQ ID NO: 10886 - protein, 11 aa, Artificial Sequence
  Description of Artificial Sequence: Synthetic peptide
  XENP019206 vlCDR1
RASQSVGNDVA

SEQ ID NO: 10887 - protein, 7 aa, Artificial Sequence
  Description of Artificial Sequence: Synthetic peptide
  XENP019206 vlCDR2
YASHRYT

SEQ ID NO: 10888 - protein, 9 aa, Artificial Sequence
  Description of Artificial Sequence: Synthetic peptide
  XENP019206 vlCDR3
QQDFSSPRT

SEQ ID NO: 10889 - protein, 249 aa, Artificial Sequence
  Description of Artificial Sequence: Synthetic polypeptide
  XENP019207 1G6_L1.188_H1.278_scFv(GKPGS)4
EIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 10890 - protein, 107 aa, Artificial Sequence; identical to SEQ ID NO: 10855
  Description of Artificial Sequence: Synthetic polypeptide
  VH of XENP019207

SEQ ID NO: 10891 - protein, 122 aa, Artificial Sequence; identical to SEQ ID NO: 10845
  Description of Artificial Sequence: Synthetic polypeptide
  VL of XENP019207

SEQ ID NO: 10892 - protein, 11 aa, Artificial Sequence
  Description of Artificial Sequence: Synthetic peptide
  XENP019207 vhCDR1
RASQSVGNDVA

SEQ ID NO: 10893 - protein, 7 aa, Artificial Sequence
  Description of Artificial Sequence: Synthetic peptide
  XENP019207 vhCDR2
YASHRYT

SEQ ID NO: 10894 - protein, 9 aa, Artificial Sequence
  Description of Artificial Sequence: Synthetic peptide
  XENP019207 vhCDR3
QQDFSSPRT

SEQ ID NO: 10895 - protein, 5 aa, Artificial Sequence
  Description of Artificial Sequence: Synthetic peptide
  XENP019207 vlCDR1
NYWMN

SEQ ID NO: 10896 - protein, 19 aa, Artificial Sequence
  Description of Artificial Sequence: Synthetic peptide
  XENP019207 vlCDR2
EIRLYSNNYATHYAESVKG

SEQ ID NO: 10897 - protein, 11 aa, Artificial Sequence
  Description of Artificial Sequence: Synthetic peptide
  XENP019207 vlCDR3
YYGNYGGYFDV

SEQ ID NO: 10898 - protein, 249 aa, Artificial Sequence
  Description of Artificial Sequence: Synthetic polypeptide
  XENP019208 1G6_L1.189_H1.278_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 10899 - protein, 107 aa, Artificial Sequence; identical to SEQ ID NO: 10864
  Description of Artificial Sequence: Synthetic polypeptide
  VH of XENP019208

SEQ ID NO: 10900 - protein, 122 aa, Artificial Sequence; identical to SEQ ID NO: 10845
  Description of Artificial Sequence: Synthetic polypeptide
  VL of XENP019208

SEQ ID NO: 10901 - protein, 11 aa, Artificial Sequence
  Description of Artificial Sequence: Synthetic peptide
  XENP019208 vhCDR1
RASQSVGNDVA

SEQ ID NO: 10902 - protein, 7 aa, Artificial Sequence
  Description of Artificial Sequence: Synthetic peptide
  XENP019208 vhCDR2
YASHRYT

SEQ ID NO: 10903 - protein, 9 aa, Artificial Sequence
  Description of Artificial Sequence: Synthetic peptide
  XENP019208 vhCDR3
QQDFSSPRT

SEQ ID NO: 10904 - protein, 5 aa, Artificial Sequence
  Description of Artificial Sequence: Synthetic peptide
  XENP019208 vlCDR1
NYWMN

SEQ ID NO: 10905 - protein, 19 aa, Artificial Sequence
  Description of Artificial Sequence: Synthetic peptide
  XENP019208 vlCDR2
EIRLYSNNYATHYAESVKG

SEQ ID NO: 10906 - protein, 11 aa, Artificial Sequence
  Description of Artificial Sequence: Synthetic peptide
  XENP019208 vlCDR3
YYGNYGGYFDV

SEQ ID NO: 10907 - protein, 249 aa, Artificial Sequence
  Description of Artificial Sequence: Synthetic polypeptide
  XENP019618 1G6_H1.279_L1.189_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10908 - protein, 122 aa, Artificial Sequence
  Description of Artificial Sequence: Synthetic polypeptide
  VH of XENP019618
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 10909 - protein, 107 aa, Artificial Sequence; identical to SEQ ID NO: 10864
  Description of Artificial Sequence: Synthetic polypeptide
  VL of XENP019618

SEQ ID NO: 10910 - protein, 5 aa, Artificial Sequence
  Description of Artificial Sequence: Synthetic peptide
  XENP019618 vhCDR1
NYWMN

SEQ ID NO: 10911 - protein, 19 aa, Artificial Sequence
  Description of Artificial Sequence: Synthetic peptide
  XENP019618 vhCDR2
EIRLYSNNYATHYAESVKG

SEQ ID NO: 10912 - protein, 11 aa, Artificial Sequence
  Description of Artificial Sequence: Synthetic peptide
  XENP019618 vhCDR3
YYGNYGGYFDV

SEQ ID NO: 10913 - protein, 11 aa, Artificial Sequence
  Description of Artificial Sequence: Synthetic peptide
  XENP019618 vlCDR1
RASQSVGNDVA

SEQ ID NO: 10914 - protein, 7 aa, Artificial Sequence
  Description of Artificial Sequence: Synthetic peptide
  XENP019618 vlCDR2
YASHRYT

SEQ ID NO: 10915 - protein, 9 aa, Artificial Sequence
  Description of Artificial Sequence: Synthetic peptide
  XENP019618 vlCDR3
QQDFSSPRT

SEQ ID NO: 10916 - protein, 249 aa, Artificial Sequence
  Description of Artificial Sequence: Synthetic polypeptide
  XENP019619 1G6_H1.280_L1.189_scFv(GKPGS)4
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10917 - protein, 122 aa, Artificial Sequence
  Description of Artificial Sequence: Synthetic polypeptide
  VH of XENP019619
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 10918 - protein, 107 aa, Artificial Sequence; identical to SEQ ID NO: 10864
  Description of Artificial Sequence: Synthetic polypeptide
  VL of XENP019619

SEQ ID NO: 10919 - protein, 5 aa, Artificial Sequence
  Description of Artificial Sequence: Synthetic peptide
  XENP019619 vhCDR1
NYWMN

SEQ ID NO: 10920 - protein, 19 aa, Artificial Sequence
  Description of Artificial Sequence: Synthetic peptide
  XENP019619 vhCDR2
EIRLYSNNYATHYAESVKG

SEQ ID NO: 10921 - protein, 11 aa, Artificial Sequence
  Description of Artificial Sequence: Synthetic peptide
  XENP019619 vhCDR3
YYGNYGGYFDV

SEQ ID NO: 10922 - protein, 11 aa, Artificial Sequence
  Description of Artificial Sequence: Synthetic peptide
  XENP019619 vlCDR1
RASQSVGNDVA

SEQ ID NO: 10923 - protein, 7 aa, Artificial Sequence
  Description of Artificial Sequence: Synthetic peptide
  XENP019619 vlCDR2
YASHRYT

SEQ ID NO: 10924 - protein, 9 aa, Artificial Sequence
  Description of Artificial Sequence: Synthetic peptide
  XENP019619 vlCDR3
QQDFSSPRT

SEQ ID NO: 10925 - protein, 249 aa, Artificial Sequence
  Description of Artificial Sequence: Synthetic polypeptide
  XENP019620 1G6_H1.281_L1.189_scFv(GKPGS)4
EVQLVESGGGLVKPGGSLRLSCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10926 - protein, 122 aa, Artificial Sequence
  Description of Artificial Sequence: Synthetic polypeptide
  VH of XENP019620
EVQLVESGGGLVKPGGSLRLSCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSS

SEQ ID NO: 10927 - protein, 107 aa, Artificial Sequence; identical to SEQ ID NO: 10864
  Description of Artificial Sequence: Synthetic polypeptide
  VL of XENP019620

SEQ ID NO: 10928 - protein, 5 aa, Artificial Sequence
  Description of Artificial Sequence: Synthetic peptide
  XENP019620 vhCDR1
NYWMN

SEQ ID NO: 10929 - protein, 19 aa, Artificial Sequence
  Description of Artificial Sequence: Synthetic peptide
  XENP019620 vhCDR2
EIRLYSNNYATHYAESVKG

SEQ ID NO: 10930 - protein, 11 aa, Artificial Sequence
  Description of Artificial Sequence: Synthetic peptide
  XENP019620 vhCDR3
YYGNYGGYFDV

SEQ ID NO: 10931 - protein, 11 aa, Artificial Sequence
  Description of Artificial Sequence: Synthetic peptide
  XENP019620 vlCDR1
RASQSVGNDVA

SEQ ID NO: 10932 - protein, 7 aa, Artificial Sequence
  Description of Artificial Sequence: Synthetic peptide
  XENP019620 vlCDR2
YASHRYT

SEQ ID NO: 10933 - protein, 9 aa, Artificial Sequence
  Description of Artificial Sequence: Synthetic peptide
  XENP019620 vlCDR3
QQDFSSPRT

SEQ ID NO: 10934 - protein, 249 aa, Artificial Sequence
  Description of Artificial Sequence: Synthetic polypeptide
  XENP019621 1G6_H1.282_L1.189_scFv(GKPGS)4
EVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10935 - protein, 122 aa, Artificial Sequence
  Description of Artificial Sequence: Synthetic polypeptide
  VH of XENP019621
EVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSS

SEQ ID NO: 10936 - protein, 107 aa, Artificial Sequence; identical to SEQ ID NO: 10864
  Description of Artificial Sequence: Synthetic polypeptide
  VL of XENP019621

SEQ ID NO: 10937 - protein, 5 aa, Artificial Sequence
  Description of Artificial Sequence: Synthetic peptide
  XENP019621 vhCDR1
NYWMN

SEQ ID NO: 10938 - protein, 19 aa, Artificial Sequence
  Description of Artificial Sequence: Synthetic peptide
  XENP019621 vhCDR2
EIRLYSNNYATHYAESVKG

SEQ ID NO: 10939 - protein, 11 aa, Artificial Sequence
  Description of Artificial Sequence: Synthetic peptide
  XENP019621 vhCDR3
YYGNYGGYFDV

SEQ ID NO: 10940 - protein, 11 aa, Artificial Sequence
  Description of Artificial Sequence: Synthetic peptide
  XENP019621 vlCDR1
RASQSVGNDVA

SEQ ID NO: 10941 - protein, 7 aa, Artificial Sequence
  Description of Artificial Sequence: Synthetic peptide
  XENP019621 vlCDR2
YASHRYT

SEQ ID NO: 10942 - protein, 9 aa, Artificial Sequence
  Description of Artificial Sequence: Synthetic peptide
  XENP019621 vlCDR3
QQDFSSPRT

SEQ ID NO: 10943 - protein, 249 aa, Artificial Sequence
  Description of Artificial Sequence: Synthetic polypeptide
  XENP019622 1G6_H1.283_L1.189_scFv(GKPGS)4
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10944 - protein, 122 aa, Artificial Sequence
  Description of Artificial Sequence: Synthetic polypeptide
  VH of XENP019622
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGQGTLVTVSS

SEQ ID NO: 10945 - protein, 107 aa, Artificial Sequence; identical to SEQ ID NO: 10864
  Description of Artificial Sequence: Synthetic polypeptide
  VL of XENP019622

SEQ ID NO: 10946 - protein, 5 aa, Artificial Sequence
  Description of Artificial Sequence: Synthetic peptide
  XENP019622 vhCDR1
NYWMN

SEQ ID NO: 10947 - protein, 19 aa, Artificial Sequence
  Description of Artificial Sequence: Synthetic peptide
  XENP019622 vhCDR2
EIRLYSNNYATHYAESVKG

SEQ ID NO: 10948 - protein, 11 aa, Artificial Sequence
  Description of Artificial Sequence: Synthetic peptide
  XENP019622 vhCDR3
YYGNYGGYFDV

SEQ ID NO: 10949 - protein, 11 aa, Artificial Sequence
  Description of Artificial Sequence: Synthetic peptide
  XENP019622 vlCDR1
RASQSVGNDVA

SEQ ID NO: 10950 - protein, 7 aa, Artificial Sequence
  Description of Artificial Sequence: Synthetic peptide
  XENP019622 vlCDR2
YASHRYT

SEQ ID NO: 10951 - protein, 9 aa, Artificial Sequence
  Description of Artificial Sequence: Synthetic peptide
  XENP019622 vlCDR3
QQDFSSPRT

SEQ ID NO: 10952 - protein, 249 aa, Artificial Sequence
  Description of Artificial Sequence: Synthetic polypeptide
  XENP019623 1G6_H1.284_L1.189_scFv(GKPGS)4
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10953 - protein, 122 aa, Artificial Sequence
  Description of Artificial Sequence: Synthetic polypeptide
  VH of XENP019623
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSS

SEQ ID NO: 10954 - protein, 107 aa, Artificial Sequence; identical to SEQ ID NO: 10864
  Description of Artificial Sequence: Synthetic polypeptide
  VL of XENP019623

SEQ ID NO: 10955 - protein, 5 aa, Artificial Sequence
  Description of Artificial Sequence: Synthetic peptide
  XENP019623 vhCDR1
NYWMN

SEQ ID NO: 10956 - protein, 19 aa, Artificial Sequence
  Description of Artificial Sequence: Synthetic peptide
  XENP019623 vhCDR2
EIRLYSNNYATHYAESVKG

SEQ ID NO: 10957 - protein, 11 aa, Artificial Sequence
  Description of Artificial Sequence: Synthetic peptide
  XENP019623 vhCDR3
YYGNYGGYFDV

SEQ ID NO: 10958 - protein, 11 aa, Artificial Sequence
  Description of Artificial Sequence: Synthetic peptide
  XENP019623 vlCDR1
RASQSVGNDVA

SEQ ID NO: 10959 - protein, 7 aa, Artificial Sequence
  Description of Artificial Sequence: Synthetic peptide
  XENP019623 vlCDR2
YASHRYT

SEQ ID NO: 10960 - protein, 9 aa, Artificial Sequence
  Description of Artificial Sequence: Synthetic peptide
  XENP019623 vlCDR3
QQDFSSPRT

SEQ ID NO: 10961 - protein, 249 aa, Artificial Sequence
  Description of Artificial Sequence: Synthetic polypeptide
  XENP019624 1G6_H1.285_L1.189_scFv(GKPGS)4
EVQLVESGGGLVKPGGSLRLTCVASGFTFSNYWMNWVRQAPGKGLEWVCEIRLYSNNYATHYAESVKGRFTCSRDDSKSMLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10962 - protein, 122 aa, Artificial Sequence
  Description of Artificial Sequence: Synthetic polypeptide
  VH of XENP019624
EVQLVESGGGLVKPGGSLRLTCVASGFTFSNYWMNWVRQAPGKGLEWVCEIRLYSNNYATHYAESVKGRFTCSRDDSKSMLYLQMNNLKTEDTGVYYCTRYYGNYGGYFDVWGRGTLVTVSS

SEQ ID NO: 10963 - protein, 107 aa, Artificial Sequence; identical to SEQ ID NO: 10864
  Description of Artificial Sequence: Synthetic polypeptide
  VL of XENP019624

SEQ ID NO: 10964 - protein, 5 aa, Artificial Sequence
  Description of Artificial Sequence: Synthetic peptide
  XENP019624 vhCDR1
NYWMN

SEQ ID NO: 10965 - protein, 19 aa, Artificial Sequence
  Description of Artificial Sequence: Synthetic peptide
  XENP019624 vhCDR2
EIRLYSNNYATHYAESVKG

SEQ ID NO: 10966 - protein, 11 aa, Artificial Sequence
  Description of Artificial Sequence: Synthetic peptide
  XENP019624 vhCDR3
YYGNYGGYFDV

SEQ ID NO: 10967 - protein, 11 aa, Artificial Sequence
  Description of Artificial Sequence: Synthetic peptide
  XENP019624 vlCDR1
RASQSVGNDVA

SEQ ID NO: 10968 - protein, 7 aa, Artificial Sequence
  Description of Artificial Sequence: Synthetic peptide
  XENP019624 vlCDR2
YASHRYT

SEQ ID NO: 10969 - protein, 9 aa, Artificial Sequence
  Description of Artificial Sequence: Synthetic peptide
  XENP019624 vlCDR3
QQDFSSPRT

SEQ ID NO: 10970 - protein, 249 aa, Artificial Sequence
  Description of Artificial Sequence: Synthetic polypeptide
  XENP019625 1G6_H1.286_L1.189_scFv(GKPGS)4
EVQLVESGGGLVKPGGSLRLSCVASGFTFSNYWMNWVRQAPGKGLEWVAEIRLYSDNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10971 - protein, 122 aa, Artificial Sequence
  Description of Artificial Sequence: Synthetic polypeptide
  VH of XENP019625
EVQLVESGGGLVKPGGSLRLSCVASGFTFSNYWMNWVRQAPGKGLEWVAEIRLYSDNYATHYAESVKGRFTISRDDSKSTLYLQMNNLKTEDTGVYYCTRYYGNYGGYFDVWGQGTLVTVSS

SEQ ID NO: 10972 - protein, 107 aa, Artificial Sequence; identical to SEQ ID NO: 10864
  Description of Artificial Sequence: Synthetic polypeptide
  VL of XENP019625

SEQ ID NO: 10973 - protein, 5 aa, Artificial Sequence
  Description of Artificial Sequence: Synthetic peptide
  XENP019625 vhCDR1
NYWMN

SEQ ID NO: 10974 - protein, 19 aa, Artificial Sequence
  Description of Artificial Sequence: Synthetic peptide
  XENP019625 vhCDR2
EIRLYSDNYATHYAESVKG

SEQ ID NO: 10975 - protein, 11 aa, Artificial Sequence
  Description of Artificial Sequence: Synthetic peptide
  XENP019625 vhCDR3
YYGNYGGYFDV

SEQ ID NO: 10976 - protein, 11 aa, Artificial Sequence
  Description of Artificial Sequence: Synthetic peptide
  XENP019625 vlCDR1
RASQSVGNDVA

SEQ ID NO: 10977 - protein, 7 aa, Artificial Sequence
  Description of Artificial Sequence: Synthetic peptide
  XENP019625 vlCDR2
YASHRYT

SEQ ID NO: 10978 - protein, 9 aa, Artificial Sequence
  Description of Artificial Sequence: Synthetic peptide
  XENP019625 vlCDR3
QQDFSSPRT

SEQ ID NO: 10979 - protein, 249 aa, Artificial Sequence
  Description of Artificial Sequence: Synthetic polypeptide
  XENP019626 1G6_H1.278_L1.192_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10980 - protein, 122 aa, Artificial Sequence; identical to SEQ ID NO: 10845
  Description of Artificial Sequence: Synthetic polypeptide
  VH of XENP019626

SEQ ID NO: 10981 - protein, 107 aa, Artificial Sequence
  Description of Artificial Sequence: Synthetic polypeptide
  VL of XENP019626
EIVLTQSPATLSASPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10982 - protein, 5 aa, Artificial Sequence
  Description of Artificial Sequence: Synthetic peptide
  XENP019626 vhCDR1
NYWMN

SEQ ID NO: 10983 - protein, 19 aa, Artificial Sequence
  Description of Artificial Sequence: Synthetic peptide
  XENP019626 vhCDR2
EIRLYSNNYATHYAESVKG

SEQ ID NO: 10984 - protein, 11 aa, Artificial Sequence
  Description of Artificial Sequence: Synthetic peptide
  XENP019626 vhCDR3
YYGNYGGYFDV

SEQ ID NO: 10985 - protein, 11 aa, Artificial Sequence
  Description of Artificial Sequence: Synthetic peptide
  XENP019626 vlCDR1
RASQSVGNDVA

SEQ ID NO: 10986 - protein, 7 aa, Artificial Sequence
  Description of Artificial Sequence: Synthetic peptide
  XENP019626 vlCDR2
YASHRYT

SEQ ID NO: 10987 - protein, 9 aa, Artificial Sequence
  Description of Artificial Sequence: Synthetic peptide
  XENP019626 vlCDR3
QQDFSSPRT

SEQ ID NO: 10988 - protein, 249 aa, Artificial Sequence
  Description of Artificial Sequence: Synthetic polypeptide
  XENP019627 1G6_H1.278_L1.193_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 10989 - protein, 122 aa, Artificial Sequence; identical to SEQ ID NO: 10845
  Description of Artificial Sequence: Synthetic polypeptide
  VH of XENP019627

SEQ ID NO: 10990 - protein, 107 aa, Artificial Sequence
  Description of Artificial Sequence: Synthetic polypeptide
  VL of XENP019627
EIVLTQSPATLSVSPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 10991 - protein, 5 aa, Artificial Sequence
  Description of Artificial Sequence: Synthetic peptide
  XENP019627 vhCDR1
NYWMN

SEQ ID NO: 10992 - protein, 19 aa, Artificial Sequence
  Description of Artificial Sequence: Synthetic peptide
  XENP019627 vhCDR2
EIRLYSNNYATHYAESVKG

SEQ ID NO: 10993 - protein, 11 aa, Artificial Sequence
  Description of Artificial Sequence: Synthetic peptide
  XENP019627 vhCDR3
YYGNYGGYFDV

SEQ ID NO: 10994 - protein, 11 aa, Artificial Sequence
  Description of Artificial Sequence: Synthetic peptide
  XENP019627 vlCDR1
RASQSVGNDVA

SEQ ID NO: 10995 - protein, 7 aa, Artificial Sequence
  Description of Artificial Sequence: Synthetic peptide
  XENP019627 vlCDR2
YASHRYT

SEQ ID NO: 10996 - protein, 9 aa, Artificial Sequence
  Description of Artificial Sequence: Synthetic peptide
  XENP019627 vlCDR3
QQDFSSPRT

SEQ ID NO: 10997 - protein, 249 aa, Artificial Sequence
  Description of Artificial Sequence: Synthetic polypeptide
  XENP019628 1G6_H1.278_L1.194_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 10998 - protein, 122 aa, Artificial Sequence; identical to SEQ ID NO: 10845
  Description of Artificial Sequence: Synthetic polypeptide
  VH of XENP019628

SEQ ID NO: 10999 - protein, 107 aa, Artificial Sequence
  Description of Artificial Sequence: Synthetic polypeptide
  VL of XENP019628
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 11000 - protein, 5 aa, Artificial Sequence
  Description of Artificial Sequence: Synthetic peptide
  XENP019628 vhCDR1
NYWMN

SEQ ID NO: 11001 - protein, 19 aa, Artificial Sequence
  Description of Artificial Sequence: Synthetic peptide
  XENP019628 vhCDR2
EIRLYSNNYATHYAESVKG

SEQ ID NO: 11002 - protein, 11 aa, Artificial Sequence
  Description of Artificial Sequence: Synthetic peptide
  XENP019628 vhCDR3
YYGNYGGYFDV

SEQ ID NO: 11003 - protein, 11 aa, Artificial Sequence
  Description of Artificial Sequence: Synthetic peptide
  XENP019628 vlCDR1
RASQSVGNDVA

SEQ ID NO: 11004 - protein, 7 aa, Artificial Sequence
  Description of Artificial Sequence: Synthetic peptide
  XENP019628 vlCDR2
YASHRYT

SEQ ID NO: 11005 - protein, 9 aa, Artificial Sequence
  Description of Artificial Sequence: Synthetic peptide
  XENP019628 vlCDR3
QQDFSSPRT

SEQ ID NO: 11006 - protein, 249 aa, Artificial Sequence
  Description of Artificial Sequence: Synthetic polypeptide
  XENP019629 1G6_H1.278_L1.195_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLCNYASHRYTGVPDRFTCSGYGTEFTLTISSVQSEDFAVYYCQQDFSSPRTFGGGTKVEIK

SEQ ID NO: 11007 - protein, 122 aa, Artificial Sequence; identical to SEQ ID NO: 10845
  Description of Artificial Sequence: Synthetic polypeptide
  VH of XENP019629

SEQ ID NO: 11008 - protein, 107 aa, Artificial Sequence
  Description of Artificial Sequence: Synthetic polypeptide
  VL of XENP019629
EIVLTQSPATLSVSPGERVTLTCRASQSVGNDVAWYQQKPGQAPRLLCNYASHRYTGVPDRFTCSGYGTEFTLTISSVQSEDFAVYYCQQDFSSPRTFGGGTKVEIK

SEQ ID NO: 11009 - protein, 5 aa, Artificial Sequence
  Description of Artificial Sequence: Synthetic peptide
  XENP019629 vhCDR1
NYWMN

SEQ ID NO: 11010 - protein, 19 aa, Artificial Sequence
  Description of Artificial Sequence: Synthetic peptide
  XENP019629 vhCDR2
EIRLYSNNYATHYAESVKG

SEQ ID NO: 11011 - protein, 11 aa, Artificial Sequence
  Description of Artificial Sequence: Synthetic peptide
  XENP019629 vhCDR3
YYGNYGGYFDV

SEQ ID NO: 11012 - protein, 11 aa, Artificial Sequence
  Description of Artificial Sequence: Synthetic peptide
  XENP019629 vlCDR1
RASQSVGNDVA

SEQ ID NO: 11013 - protein, 9 aa, Artificial Sequence
  Description of Artificial Sequence: Synthetic peptide
  XENP019629 vlCDR2
CNYASHRYT

SEQ ID NO: 11014 - protein, 9 aa, Artificial Sequence
  Description of Artificial Sequence: Synthetic peptide
  XENP019629 vlCDR3
QQDFSSPRT

SEQ ID NO: 11015 - protein, 249 aa, Artificial Sequence
  Description of Artificial Sequence: Synthetic polypeptide
  XENP019630 1G6_H1.278_L1.196_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSASPGERVTLTCRASQSVGNDVAWYQQKPGQAPRLLCNYASHRYTGVPDRFTCSGYGTEFTLTISSVQSEDFGVYYCQQDFSSPRTFGGGTKVEIK

SEQ ID NO: 11016 - protein, 122 aa, Artificial Sequence; identical to SEQ ID NO: 10845
  Description of Artificial Sequence: Synthetic polypeptide
  VH of XENP019630

SEQ ID NO: 11017 - protein, 107 aa, Artificial Sequence
  Description of Artificial Sequence: Synthetic polypeptide
  VL of XENP019630
EIVLTQSPATLSASPGERVTLTCRASQSVGNDVAWYQQKPGQAPRLLCNYASHRYTGVPDRFTCSGYGTEFTLTISSVQSEDFGVYYCQQDFSSPRTFGGGTKVEIK

SEQ ID NO: 11018 - protein, 5 aa, Artificial Sequence
  Description of Artificial Sequence: Synthetic peptide
  XENP019630 vhCDR1
NYWMN

SEQ ID NO: 11019 - protein, 19 aa, Artificial Sequence
  Description of Artificial Sequence: Synthetic peptide
  XENP019630 vhCDR2
EIRLYSNNYATHYAESVKG

SEQ ID NO: 11020 - protein, 11 aa, Artificial Sequence
  Description of Artificial Sequence: Synthetic peptide
  XENP019630 vhCDR3
YYGNYGGYFDV

SEQ ID NO: 11021 - protein, 11 aa, Artificial Sequence
  Description of Artificial Sequence: Synthetic peptide
  XENP019630 vlCDR1
RASQSVGNDVA

SEQ ID NO: 11022 - protein, 9 aa, Artificial Sequence
  Description of Artificial Sequence: Synthetic peptide
  XENP019630 vlCDR2
CNYASHRYT

SEQ ID NO: 11023 - protein, 9 aa, Artificial Sequence
  Description of Artificial Sequence: Synthetic peptide
  XENP019630 vlCDR3
QQDFSSPRT

SEQ ID NO: 11024 - protein, 249 aa, Artificial Sequence
  Description of Artificial Sequence: Synthetic polypeptide
  XENP019631 1G6_H1.278_L1.197_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSASPGERVTLTCRASQSVGNDVAWYQQKPGQAPRLLCNYASHRYTSVPDRFTCSGYGTEFTLTISSVQSEDFGVYYCQQDFSSPRTFGGGTKVEIK

SEQ ID NO: 11025 - protein, 122 aa, Artificial Sequence; identical to SEQ ID NO: 10845
  Description of Artificial Sequence: Synthetic polypeptide
  VH of XENP019631

SEQ ID NO: 11026 - protein, 107 aa, Artificial Sequence
  Description of Artificial Sequence: Synthetic polypeptide
  VL of XENP019631
EIVLTQSPATLSASPGERVTLTCRASQSVGNDVAWYQQKPGQAPRLLCNYASHRYTSVPDRFTCSGYGTEFTLTISSVQSEDFGVYYCQQDFSSPRTFGGGTKVEIK

SEQ ID NO: 11027 - protein, 5 aa, Artificial Sequence
  Description of Artificial Sequence: Synthetic peptide
  XENP019631 vhCDR1
NYWMN

SEQ ID NO: 11028 - protein, 19 aa, Artificial Sequence
  Description of Artificial Sequence: Synthetic peptide
  XENP019631 vhCDR2
EIRLYSNNYATHYAESVKG

SEQ ID NO: 11029 - protein, 11 aa, Artificial Sequence
  Description of Artificial Sequence: Synthetic peptide
  XENP019631 vhCDR3
YYGNYGGYFDV

SEQ ID NO: 11030 - protein, 11 aa, Artificial Sequence
  Description of Artificial Sequence: Synthetic peptide
  XENP019631 vlCDR1
RASQSVGNDVA

SEQ ID NO: 11031 - protein, 9 aa, Artificial Sequence
  Description of Artificial Sequence: Synthetic peptide
  XENP019631 vlCDR2
CNYASHRYT

SEQ ID NO: 11032 - protein, 9 aa, Artificial Sequence
  Description of Artificial Sequence: Synthetic peptide
  XENP019631 vlCDR3
QQDFSSPRT

SEQ ID NO: 11033 - protein, 249 aa, Artificial Sequence
  Description of Artificial Sequence: Synthetic polypeptide
  XENP019632 1G6_H1.278_L1.198_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPSTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11034 - protein, 122 aa, Artificial Sequence; identical to SEQ ID NO: 10845
  Description of Artificial Sequence: Synthetic polypeptide
  VH of XENP019632

SEQ ID NO: 11035 - protein, 107 aa, Artificial Sequence
  Description of Artificial Sequence: Synthetic polypeptide
  VL of XENP019632
EIVLTQSPSTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11036 - protein, 5 aa, Artificial Sequence
  Description of Artificial Sequence: Synthetic peptide
  XENP019632 vhCDR1
NYWMN

SEQ ID NO: 11037 - protein, 19 aa, Artificial Sequence
  Description of Artificial Sequence: Synthetic peptide
  XENP019632 vhCDR2
EIRLYSNNYATHYAESVKG

SEQ ID NO: 11038 - protein, 11 aa, Artificial Sequence
  Description of Artificial Sequence: Synthetic peptide
  XENP019632 vhCDR3
YYGNYGGYFDV

SEQ ID NO: 11039 - protein, 11 aa, Artificial Sequence
  Description of Artificial Sequence: Synthetic peptide
  XENP019632 vlCDR1
RASQSVGNDVA

SEQ ID NO: 11040 - protein, 7 aa, Artificial Sequence
  Description of Artificial Sequence: Synthetic peptide
  XENP019632 vlCDR2
YASHRYT

SEQ ID NO: 11041 - protein, 9 aa, Artificial Sequence
  Description of Artificial Sequence: Synthetic peptide
  XENP019632 vlCDR3
QQDFSSPRT

SEQ ID NO: 11042 - protein, 249 aa, Artificial Sequence
  Description of Artificial Sequence: Synthetic polypeptide
  XENP019633 1G6_H1.278_L1.199_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPDTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11043 - protein, 122 aa, Artificial Sequence; identical to SEQ ID NO: 10845
  Description of Artificial Sequence: Synthetic polypeptide
  VH of XENP019633

SEQ ID NO: 11044 - protein, 107 aa, Artificial Sequence
  Description of Artificial Sequence: Synthetic polypeptide
  VL of XENP019633
EIVLTQSPDTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11045 - protein, 5 aa, Artificial Sequence
  Description of Artificial Sequence: Synthetic peptide
  XENP019633 vhCDR1
NYWMN

SEQ ID NO: 11046 - protein, 19 aa, Artificial Sequence
  Description of Artificial Sequence: Synthetic peptide
  XENP019633 vhCDR2
EIRLYSNNYATHYAESVKG

SEQ ID NO: 11047 - protein, 11 aa, Artificial Sequence
  Description of Artificial Sequence: Synthetic peptide
  XENP019633 vhCDR3
YYGNYGGYFDV

SEQ ID NO: 11048 - protein, 11 aa, Artificial Sequence
  Description of Artificial Sequence: Synthetic peptide
  XENP019633 vlCDR1
RASQSVGNDVA

SEQ ID NO: 11049 - protein, 7 aa, Artificial Sequence
  Description of Artificial Sequence: Synthetic peptide
  XENP019633 vlCDR2
YASHRYT

SEQ ID NO: 11050 - protein, 9 aa, Artificial Sequence
  Description of Artificial Sequence: Synthetic peptide
  XENP019633 vlCDR3
QQDFSSPRT

SEQ ID NO: 11051 - protein, 249 aa, Artificial Sequence
  Description of Artificial Sequence: Synthetic polypeptide
  XENP019634 1G6_H1.278_L1.200_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLAVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11052 - protein, 122 aa, Artificial Sequence; identical to SEQ ID NO: 10845
  Description of Artificial Sequence: Synthetic polypeptide
  VH of XENP019634

SEQ ID NO: 11053 - protein, 107 aa, Artificial Sequence
  Description of Artificial Sequence: Synthetic polypeptide
  VL of XENP019634
EIVLTQSPATLAVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11054 - protein, 5 aa, Artificial Sequence
  Description of Artificial Sequence: Synthetic peptide
  XENP019634 vhCDR1
NYWMN

SEQ ID NO: 11055 - protein, 19 aa, Artificial Sequence
  Description of Artificial Sequence: Synthetic peptide
  XENP019634 vhCDR2
EIRLYSNNYATHYAESVKG

SEQ ID NO: 11056 - protein, 11 aa, Artificial Sequence
  Description of Artificial Sequence: Synthetic peptide
  XENP019634 vhCDR3
YYGNYGGYFDV

SEQ ID NO: 11057 - protein, 11 aa, Artificial Sequence
  Description of Artificial Sequence: Synthetic peptide
  XENP019634 vlCDR1
RASQSVGNDVA

SEQ ID NO: 11058 - protein, 7 aa, Artificial Sequence
  Description of Artificial Sequence: Synthetic peptide
  XENP019634 vlCDR2
YASHRYT

SEQ ID NO: 11059 - protein, 9 aa, Artificial Sequence
  Description of Artificial Sequence: Synthetic peptide
  XENP019634 vlCDR3
QQDFSSPRT

SEQ ID NO: 11060 - protein, 249 aa, Artificial Sequence; identical to SEQ ID NO: 10979
  Description of Artificial Sequence: Synthetic polypeptide
  XENP019635 1G6_H1.278_L1.201_scFv(GKPGS)4

SEQ ID NO: 11061 - protein, 122 aa, Artificial Sequence; identical to SEQ ID NO: 10845
  Description of Artificial Sequence: Synthetic polypeptide
  VH of XENP019635

SEQ ID NO: 11062 - protein, 107 aa, Artificial Sequence; identical to SEQ ID NO: 10981
  Description of Artificial Sequence: Synthetic polypeptide
  VL of XENP019635

SEQ ID NO: 11063 - protein, 5 aa, Artificial Sequence
  Description of Artificial Sequence: Synthetic peptide
  XENP019635 vhCDR1
NYWMN

SEQ ID NO: 11064 - protein, 19 aa, Artificial Sequence
  Description of Artificial Sequence: Synthetic peptide
  XENP019635 vhCDR2
EIRLYSNNYATHYAESVKG

SEQ ID NO: 11065 - protein, 11 aa, Artificial Sequence
  Description of Artificial Sequence: Synthetic peptide
  XENP019635 vhCDR3
YYGNYGGYFDV

SEQ ID NO: 11066 - protein, 11 aa, Artificial Sequence
  Description of Artificial Sequence: Synthetic peptide
  XENP019635 vlCDR1
RASQSVGNDVA

SEQ ID NO: 11067 - protein, 7 aa, Artificial Sequence
  Description of Artificial Sequence: Synthetic peptide
  XENP019635 vlCDR2
YASHRYT

SEQ ID NO: 11068 - protein, 9 aa, Artificial Sequence
  Description of Artificial Sequence: Synthetic peptide
  XENP019635 vlCDR3
QQDFSSPRT

SEQ ID NO: 11069 - protein, 249 aa, Artificial Sequence
  Description of Artificial Sequence: Synthetic polypeptide
  XENP019636 1G6_H1.278_L1.202_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSVGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11070 - protein, 122 aa, Artificial Sequence; identical to SEQ ID NO: 10845
  Description of Artificial Sequence: Synthetic polypeptide
  VH of XENP019636

SEQ ID NO: 11071 - protein, 107 aa, Artificial Sequence
  Description of Artificial Sequence: Synthetic polypeptide
  VL of XENP019636
EIVLTQSPATLSVSVGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11072 - protein, 5 aa, Artificial Sequence
  Description of Artificial Sequence: Synthetic peptide
  XENP019636 vhCDR1
NYWMN

SEQ ID NO: 11073 - protein, 19 aa, Artificial Sequence
  Description of Artificial Sequence: Synthetic peptide
  XENP019636 vhCDR2
EIRLYSNNYATHYAESVKG

SEQ ID NO: 11074 - protein, 11 aa, Artificial Sequence
  Description of Artificial Sequence: Synthetic peptide
  XENP019636 vhCDR3
YYGNYGGYFDV

SEQ ID NO: 11075 - protein, 11 aa, Artificial Sequence
  Description of Artificial Sequence: Synthetic peptide
  XENP019636 vlCDR1
RASQSVGNDVA

SEQ ID NO: 11076 - protein, 7 aa, Artificial Sequence
  Description of Artificial Sequence: Synthetic peptide
  XENP019636 vlCDR2
YASHRYT

SEQ ID NO: 11077 - protein, 9 aa, Artificial Sequence
  Description of Artificial Sequence: Synthetic peptide
  XENP019636 vlCDR3
QQDFSSPRT

SEQ ID NO: 11078 - protein, 249 aa, Artificial Sequence
  Description of Artificial Sequence: Synthetic polypeptide
  XENP019637 1G6_H1.278_L1.203_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSLGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11079 - protein, 122 aa, Artificial Sequence; identical to SEQ ID NO: 10845
  Description of Artificial Sequence: Synthetic polypeptide
  VH of XENP019637

SEQ ID NO: 11080 - protein, 107 aa, Artificial Sequence
  Description of Artificial Sequence: Synthetic polypeptide
  VL of XENP019637
EIVLTQSPATLSVSLGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11081 - protein, 5 aa, Artificial Sequence
  Description of Artificial Sequence: Synthetic peptide
  XENP019637 vhCDR1
NYWMN

SEQ ID NO: 11082 - protein, 19 aa, Artificial Sequence
  Description of Artificial Sequence: Synthetic peptide
  XENP019637 vhCDR2
EIRLYSNNYATHYAESVKG

SEQ ID NO: 11083 - protein, 11 aa, Artificial Sequence
  Description of Artificial Sequence: Synthetic peptide
  XENP019637 vhCDR3
YYGNYGGYFDV

SEQ ID NO: 11084 - protein, 11 aa, Artificial Sequence
  Description of Artificial Sequence: Synthetic peptide
  XENP019637 vlCDR1
RASQSVGNDVA

SEQ ID NO: 11085 - protein, 7 aa, Artificial Sequence
  Description of Artificial Sequence: Synthetic peptide
  XENP019637 vlCDR2
YASHRYT

SEQ ID NO: 11086 - protein, 9 aa, Artificial Sequence
  Description of Artificial Sequence: Synthetic peptide
  XENP019637 vlCDR3
QQDFSSPRT

SEQ ID NO: 11087 - protein, 249 aa, Artificial Sequence
  Description of Artificial Sequence: Synthetic polypeptide
  XENP019638 1G6_H1.278_L1.204_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLNCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11088 - protein, 122 aa, Artificial Sequence; identical to SEQ ID NO: 10845
  Description of Artificial Sequence: Synthetic polypeptide
  VH of XENP019638

SEQ ID NO: 11089 - protein, 107 aa, Artificial Sequence
  Description of Artificial Sequence: Synthetic polypeptide
  VL of XENP019638
EIVLTQSPATLSVSPGERVTLNCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11090 - protein, 5 aa, Artificial Sequence
  Description of Artificial Sequence: Synthetic peptide
  XENP019638 vhCDR1
NYWMN

SEQ ID NO: 11091 - protein, 19 aa, Artificial Sequence
  Description of Artificial Sequence: Synthetic peptide
  XENP019638 vhCDR2
EIRLYSNNYATHYAESVKG

SEQ ID NO: 11092 - protein, 11 aa, Artificial Sequence
  Description of Artificial Sequence: Synthetic peptide
  XENP019638 vhCDR3
YYGNYGGYFDV

SEQ ID NO: 11093 - protein, 11 aa, Artificial Sequence
  Description of Artificial Sequence: Synthetic peptide
  XENP019638 vlCDR1
RASQSVGNDVA

SEQ ID NO: 11094 - protein, 7 aa, Artificial Sequence
  Description of Artificial Sequence: Synthetic peptide
  XENP019638 vlCDR2
YASHRYT

SEQ ID NO: 11095 - protein, 9 aa, Artificial Sequence
  Description of Artificial Sequence: Synthetic peptide
  XENP019638 vlCDR3
QQDFSSPRT

SEQ ID NO: 11096 - protein, 249 aa, Artificial Sequence
  Description of Artificial Sequence: Synthetic polypeptide
  XENP019639 1G6_H1.278_L1.205_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGKAPRLLINYASHRYTGVPDRFTGSGYGTEFTLTISSVQSEDFAVYYCQQDFSSPRTFGGGTKVEIK

SEQ ID NO: 11097 - protein, 122 aa, Artificial Sequence; identical to SEQ ID NO: 10845
  Description of Artificial Sequence: Synthetic polypeptide
  VH of XENP019639

SEQ ID NO: 11098 - protein, 107 aa, Artificial Sequence
  Description of Artificial Sequence: Synthetic polypeptide
  VL of XENP019639
EIVLTQSPATLSVSPGERVTLTCRASQSVGNDVAWYQQKPGKAPRLLINYASHRYTGVPDRFTGSGYGTEFTLTISSVQSEDFAVYYCQQDFSSPRTFGGGTKVEIK

SEQ ID NO: 11099 - protein, 5 aa, Artificial Sequence
  Description of Artificial Sequence: Synthetic peptide
  XENP019639 vhCDR1
NYWMN

SEQ ID NO: 11100 - protein, 19 aa, Artificial Sequence
  Description of Artificial Sequence: Synthetic peptide
  XENP019639 vhCDR2
EIRLYSNNYATHYAESVKG

SEQ ID NO: 11101 - protein, 11 aa, Artificial Sequence
  Description of Artificial Sequence: Synthetic peptide
  XENP019639 vhCDR3
YYGNYGGYFDV

SEQ ID NO: 11102 - protein, 11 aa, Artificial Sequence
  Description of Artificial Sequence: Synthetic peptide
  XENP019639 vlCDR1
RASQSVGNDVA

SEQ ID NO: 11103 - protein, 7 aa, Artificial Sequence
  Description of Artificial Sequence: Synthetic peptide
  XENP019639 vlCDR2
YASHRYT

SEQ ID NO: 11104 - protein, 9 aa, Artificial Sequence
  Description of Artificial Sequence: Synthetic peptide
  XENP019639 vlCDR3
QQDFSSPRT

SEQ ID NO: 11105 - protein, 249 aa, Artificial Sequence
  Description of Artificial Sequence: Synthetic polypeptide
  XENP019640 1G6_H1.278_L1.206_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQPEDFAVYYCQQDFSSPRTFGGGTKVEIK

SEQ ID NO: 11106 - protein, 122 aa, Artificial Sequence; identical to SEQ ID NO: 10845
  Description of Artificial Sequence: Synthetic polypeptide
  VH of XENP019640

SEQ ID NO: 11107 - protein, 107 aa, Artificial Sequence
  Description of Artificial Sequence: Synthetic polypeptide
  VL of XENP019640
EIVLTQSPATLSVSPGERVTLTCRASQSVGNDVAWYQQKPGQAPRLLINYASHRYTGVPDRFTGSGYGTEFTLTISSVQPEDFAVYYCQQDFSSPRTFGGGTKVEIK

SEQ ID NO: 11108 - protein, 5 aa, Artificial Sequence
  Description of Artificial Sequence: Synthetic peptide
  XENP019640 vhCDR1
NYWMN

SEQ ID NO: 11109 - protein, 19 aa, Artificial Sequence
  Description of Artificial Sequence: Synthetic peptide
  XENP019640 vhCDR2
EIRLYSNNYATHYAESVKG

SEQ ID NO: 11110 - protein, 11 aa, Artificial Sequence
  Description of Artificial Sequence: Synthetic peptide
  XENP019640 vhCDR3
YYGNYGGYFDV

SEQ ID NO: 11111 - protein, 11 aa, Artificial Sequence
  Description of Artificial Sequence: Synthetic peptide
  XENP019640 vlCDR1
RASQSVGNDVA

SEQ ID NO: 11112 - protein, 7 aa, Artificial Sequence
  Description of Artificial Sequence: Synthetic peptide
  XENP019640 vlCDR2
YASHRYT

SEQ ID NO: 11113 - protein, 9 aa, Artificial Sequence
  Description of Artificial Sequence: Synthetic peptide
  XENP019640 vlCDR3
QQDFSSPRT

SEQ ID NO: 11114 - protein, 249 aa, Artificial Sequence
  Description of Artificial Sequence: Synthetic polypeptide
  XENP019641 1G6_H1.278_L1.207_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDVAVYYCQQDFSSPRTFGGGTKVEIK

SEQ ID NO: 11115 - protein, 122 aa, Artificial Sequence; identical to SEQ ID NO: 10845
  Description of Artificial Sequence: Synthetic polypeptide
  VH of XENP019641

SEQ ID NO: 11116 - protein, 107 aa, Artificial Sequence
  Description of Artificial Sequence: Synthetic polypeptide
  VL of XENP019641
EIVLTQSPATLSVSPGERVTLTCRASQSVGNDVAWYQQKPGQAPRLLINYASHRYTGVPDRFTGSGYGTEFTLTISSVQSEDVAVYYCQQDFSSPRTFGGGTKVEIK

SEQ ID NO: 11117 - protein, 5 aa, Artificial Sequence
  Description of Artificial Sequence: Synthetic peptide
  XENP019641 vhCDR1
NYWMN

SEQ ID NO: 11118 - protein, 19 aa, Artificial Sequence
  Description of Artificial Sequence: Synthetic peptide
  XENP019641 vhCDR2
EIRLYSNNYATHYAESVKG

SEQ ID NO: 11119 - protein, 11 aa, Artificial Sequence
  Description of Artificial Sequence: Synthetic peptide
  XENP019641 vhCDR3
YYGNYGGYFDV

SEQ ID NO: 11120 - protein, 11 aa, Artificial Sequence
  Description of Artificial Sequence: Synthetic peptide
  XENP019641 vlCDR1
RASQSVGNDVA

SEQ ID NO: 11121 - protein, 7 aa, Artificial Sequence
  Description of Artificial Sequence: Synthetic peptide
  XENP019641 vlCDR2
YASHRYT

SEQ ID NO: 11122 - protein, 9 aa, Artificial Sequence
  Description of Artificial Sequence: Synthetic peptide
  XENP019641 vlCDR3
QQDFSSPRT

SEQ ID NO: 11123 - protein, 249 aa, Artificial Sequence
  Description of Artificial Sequence: Synthetic polypeptide
  XENP019642 1G6_H1.278_L1.208_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFATYYCQQDFSSPRTFGGGTKVEIK

SEQ ID NO: 11124 - protein, 122 aa, Artificial Sequence; identical to SEQ ID NO: 10845
  Description of Artificial Sequence: Synthetic polypeptide
  VH of XENP019642

SEQ ID NO: 11125 - protein, 107 aa, Artificial Sequence
  Description of Artificial Sequence: Synthetic polypeptide
  VL of XENP019642
EIVLTQSPATLSVSPGERVTLTCRASQSVGNDVAWYQQKPGQAPRLLINYASHRYTGVPDRFTGSGYGTEFTLTISSVQSEDFATYYCQQDFSSPRTFGGGTKVEIK

SEQ ID NO: 11126 - protein, 5 aa, Artificial Sequence
  Description of Artificial Sequence: Synthetic peptide
  XENP019642 vhCDR1
NYWMN

SEQ ID NO: 11127 - protein, 19 aa, Artificial Sequence
  Description of Artificial Sequence: Synthetic peptide
  XENP019642 vhCDR2
EIRLYSNNYATHYAESVKG

SEQ ID NO: 11128 - protein, 11 aa, Artificial Sequence
  Description of Artificial Sequence: Synthetic peptide
  XENP019642 vhCDR3
YYGNYGGYFDV

SEQ ID NO: 11129 - protein, 11 aa, Artificial Sequence
  Description of Artificial Sequence: Synthetic peptide
  XENP019642 vlCDR1
RASQSVGNDVA

SEQ ID NO: 11130 - protein, 7 aa, Artificial Sequence
  Description of Artificial Sequence: Synthetic peptide
  XENP019642 vlCDR2
YASHRYT

SEQ ID NO: 11131 - protein, 9 aa, Artificial Sequence
  Description of Artificial Sequence: Synthetic peptide
  XENP019642 vlCDR3
QQDFSSPRT

SEQ ID NO: 11132 - protein, 249 aa, Artificial Sequence
  Description of Artificial Sequence: Synthetic polypeptide
  XENP019643 1G6_L1.189_H1.279_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 11133 - protein, 107 aa, Artificial Sequence; identical to SEQ ID NO: 10864
  Description of Artificial Sequence: Synthetic polypeptide
  VH of XENP019643

SEQ ID NO: 11134 - protein, 122 aa, Artificial Sequence; identical to SEQ ID NO: 10908
  Description of Artificial Sequence: Synthetic polypeptide
  VL of XENP019643

SEQ ID NO: 11135 - protein, 11 aa, Artificial Sequence
  Description of Artificial Sequence: Synthetic peptide
  XENP019643 vhCDR1
RASQSVGNDVA

SEQ ID NO: 11136 - protein, 7 aa, Artificial Sequence
  Description of Artificial Sequence: Synthetic peptide
  XENP019643 vhCDR2
YASHRYT

SEQ ID NO: 11137 - protein, 9 aa, Artificial Sequence
  Description of Artificial Sequence: Synthetic peptide
  XENP019643 vhCDR3
QQDFSSPRT

SEQ ID NO: 11138 - protein, 5 aa, Artificial Sequence
  Description of Artificial Sequence: Synthetic peptide
  XENP019643 vlCDR1
NYWMN

SEQ ID NO: 11139 - protein, 19 aa, Artificial Sequence
  Description of Artificial Sequence: Synthetic peptide
  XENP019643 vlCDR2
EIRLYSNNYATHYAESVKG

SEQ ID NO: 11140 - protein, 11 aa, Artificial Sequence
  Description of Artificial Sequence: Synthetic peptide
  XENP019643 vlCDR3
YYGNYGGYFDV

SEQ ID NO: 11141 - protein, 249 aa, Artificial Sequence
  Description of Artificial Sequence: Synthetic polypeptide
  XENP019644 1G6_L1.189_H1.280_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 11142 - protein, 107 aa, Artificial Sequence; identical to SEQ ID NO: 10864
  Description of Artificial Sequence: Synthetic polypeptide
  VH of XENP019644

SEQ ID NO: 11143 - protein, 122 aa, Artificial Sequence; identical to SEQ ID NO: 10917
  Description of Artificial Sequence: Synthetic polypeptide
  VL of XENP019644

SEQ ID NO: 11144 - protein, 11 aa, Artificial Sequence
  Description of Artificial Sequence: Synthetic peptide
  XENP019644 vhCDR1
RASQSVGNDVA

SEQ ID NO: 11145 - protein, 7 aa, Artificial Sequence
  Description of Artificial Sequence: Synthetic peptide
  XENP019644 vhCDR2
YASHRYT

SEQ ID NO: 11146 - protein, 9 aa, Artificial Sequence
  Description of Artificial Sequence: Synthetic peptide
  XENP019644 vhCDR3
QQDFSSPRT

SEQ ID NO: 11147 - protein, 5 aa, Artificial Sequence
  Description of Artificial Sequence: Synthetic peptide
  XENP019644 vlCDR1
NYWMN

SEQ ID NO: 11148 - protein, 19 aa, Artificial Sequence
  Description of Artificial Sequence: Synthetic peptide
  XENP019644 vlCDR2
EIRLYSNNYATHYAESVKG

SEQ ID NO: 11149 - protein, 11 aa, Artificial Sequence
  Description of Artificial Sequence: Synthetic peptide
  XENP019644 vlCDR3
YYGNYGGYFDV

SEQ ID NO: 11150 - protein, 249 aa, Artificial Sequence
  Description of Artificial Sequence: Synthetic polypeptide
  XENP019645 1G6_L1.189_H1.281_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSS

SEQ ID NO: 11151 - protein, 107 aa, Artificial Sequence; identical to SEQ ID NO: 10864
  Description of Artificial Sequence: Synthetic polypeptide
  VH of XENP019645

SEQ ID NO: 11152 - protein, 122 aa, Artificial Sequence; identical to SEQ ID NO: 10926
  Description of Artificial Sequence: Synthetic polypeptide
  VL of XENP019645

SEQ ID NO: 11153 - protein, 11 aa, Artificial Sequence
  Description of Artificial Sequence: Synthetic peptide
  XENP019645 vhCDR1
RASQSVGNDVA

SEQ ID NO: 11154 - protein, 7 aa, Artificial Sequence
  Description of Artificial Sequence: Synthetic peptide
  XENP019645 vhCDR2
YASHRYT

SEQ ID NO: 11155 - protein, 9 aa, Artificial Sequence
  Description of Artificial Sequence: Synthetic peptide
  XENP019645 vhCDR3
QQDFSSPRT

SEQ ID NO: 11156 - protein, 5 aa, Artificial Sequence
  Description of Artificial Sequence: Synthetic peptide
  XENP019645 vlCDR1
NYWMN

SEQ ID NO: 11157 - protein, 19 aa, Artificial Sequence
  Description of Artificial Sequence: Synthetic peptide
  XENP019645 vlCDR2
EIRLYSNNYATHYAESVKG

SEQ ID NO: 11158 - protein, 11 aa, Artificial Sequence
  Description of Artificial Sequence: Synthetic peptide
  XENP019645 vlCDR3
YYGNYGGYFDV

SEQ ID NO: 11159 - protein, 249 aa, Artificial Sequence
  Description of Artificial Sequence: Synthetic polypeptide
  XENP019646 1G6_L1.189_H1.282_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSS

SEQ ID NO: 11160 - protein, 107 aa, Artificial Sequence; identical to SEQ ID NO: 10864
  Description of Artificial Sequence: Synthetic polypeptide
  VH of XENP019646

SEQ ID NO: 11161 - protein, 122 aa, Artificial Sequence; identical to SEQ ID NO: 10935
  Description of Artificial Sequence: Synthetic polypeptide
  VL of XENP019646

SEQ ID NO: 11162 - protein, 11 aa, Artificial Sequence
  Description of Artificial Sequence: Synthetic peptide
  XENP019646 vhCDR1
RASQSVGNDVA

SEQ ID NO: 11163 - protein, 7 aa, Artificial Sequence
  Description of Artificial Sequence: Synthetic peptide
  XENP019646 vhCDR2
YASHRYT

SEQ ID NO: 11164 - protein, 9 aa, Artificial Sequence
  Description of Artificial Sequence: Synthetic peptide
  XENP019646 vhCDR3
QQDFSSPRT

SEQ ID NO: 11165 - protein, 5 aa, Artificial Sequence
  Description of Artificial Sequence: Synthetic peptide
  XENP019646 vlCDR1
NYWMN

SEQ ID NO: 11166 - protein, 19 aa, Artificial Sequence
  Description of Artificial Sequence: Synthetic peptide
  XENP019646 vlCDR2
EIRLYSNNYATHYAESVKG

SEQ ID NO: 11167 - protein, 11 aa, Artificial Sequence
  Description of Artificial Sequence: Synthetic peptide
  XENP019646 vlCDR3
YYGNYGGYFDV

SEQ ID NO: 11168 - protein, 249 aa, Artificial Sequence
  Description of Artificial Sequence: Synthetic polypeptide
  XENP019647 1G6_L1.189_H1.283_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGQGTLVTVSS

SEQ ID NO: 11169 - protein, 107 aa, Artificial Sequence; identical to SEQ ID NO: 10864
  Description of Artificial Sequence: Synthetic polypeptide
  VH of XENP019647

SEQ ID NO: 11170 - protein, 122 aa, Artificial Sequence; identical to SEQ ID NO: 10944
  Description of Artificial Sequence: Synthetic polypeptide
  VL of XENP019647

SEQ ID NO: 11171 - protein, 11 aa, Artificial Sequence
  Description of Artificial Sequence: Synthetic peptide
  XENP019647 vhCDR1
RASQSVGNDVA

SEQ ID NO: 11172 - protein, 7 aa, Artificial Sequence
  Description of Artificial Sequence: Synthetic peptide
  XENP019647 vhCDR2
YASHRYT

SEQ ID NO: 11173 - protein, 9 aa, Artificial Sequence
  Description of Artificial Sequence: Synthetic peptide
  XENP019647 vhCDR3
QQDFSSPRT

SEQ ID NO: 11174 - protein, 5 aa, Artificial Sequence
  Description of Artificial Sequence: Synthetic peptide
  XENP019647 vlCDR1
NYWMN

SEQ ID NO: 11175 - protein, 19 aa, Artificial Sequence
  Description of Artificial Sequence: Synthetic peptide
  XENP019647 vlCDR2
EIRLYSNNYATHYAESVKG

SEQ ID NO: 11176 - protein, 11 aa, Artificial Sequence
  Description of Artificial Sequence: Synthetic peptide
  XENP019647 vlCDR3
YYGNYGGYFDV

SEQ ID NO: 11177 - protein, 249 aa, Artificial Sequence
  Description of Artificial Sequence: Synthetic polypeptide
  XENP019648 1G6_L1.189_H1.284_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSS

SEQ ID NO: 11178 - protein, 107 aa, Artificial Sequence; identical to SEQ ID NO: 10864
  Description of Artificial Sequence: Synthetic polypeptide
  VH of XENP019648

SEQ ID NO: 11179 - protein, 122 aa, Artificial Sequence; identical to SEQ ID NO: 10953
  Description of Artificial Sequence: Synthetic polypeptide
  VL of XENP019648

SEQ ID NO: 11180 - protein, 11 aa, Artificial Sequence
  Description of Artificial Sequence: Synthetic peptide
  XENP019648 vhCDR1
RASQSVGNDVA

SEQ ID NO: 11181 - protein, 7 aa, Artificial Sequence
  Description of Artificial Sequence: Synthetic peptide
  XENP019648 vhCDR2
YASHRYT

SEQ ID NO: 11182 - protein, 9 aa, Artificial Sequence
  Description of Artificial Sequence: Synthetic peptide
  XENP019648 vhCDR3
QQDFSSPRT

SEQ ID NO: 11183 - protein, 5 aa, Artificial Sequence
  Description of Artificial Sequence: Synthetic peptide
  XENP019648 vlCDR1
NYWMN

SEQ ID NO: 11184 - protein, 19 aa, Artificial Sequence
  Description of Artificial Sequence: Synthetic peptide
  XENP019648 vlCDR2
EIRLYSNNYATHYAESVKG

SEQ ID NO: 11185 - protein, 11 aa, Artificial Sequence
  Description of Artificial Sequence: Synthetic peptide
  XENP019648 vlCDR3
YYGNYGGYFDV

SEQ ID NO: 11186 - protein, 249 aa, Artificial Sequence
  Description of Artificial Sequence: Synthetic polypeptide
  XENP019649 1G6_L1.189_H1.285_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLTCVASGFTFSNYWMNWVRQAPGKGLEWVCEIRLYSNNYATHYAESVKGRFTCSRDDSKSMLYLQMNNLKTEDTGVYYCTRYYGNYGGYFDVWGRGTLVTVSS

SEQ ID NO: 11187 - protein, 107 aa, Artificial Sequence; identical to SEQ ID NO: 10864
  Description of Artificial Sequence: Synthetic polypeptide
  VH of XENP019649

SEQ ID NO: 11188 - protein, 122 aa, Artificial Sequence; identical to SEQ ID NO: 10962
  Description of Artificial Sequence: Synthetic polypeptide
  VL of XENP019649

SEQ ID NO: 11189 - protein, 11 aa, Artificial Sequence
  Description of Artificial Sequence: Synthetic peptide
  XENP019649 vhCDR1
RASQSVGNDVA

SEQ ID NO: 11190 - protein, 7 aa, Artificial Sequence
  Description of Artificial Sequence: Synthetic peptide
  XENP019649 vhCDR2
YASHRYT

SEQ ID NO: 11191 - protein, 9 aa, Artificial Sequence
  Description of Artificial Sequence: Synthetic peptide
  XENP019649 vhCDR3
QQDFSSPRT

SEQ ID NO: 11192 - protein, 5 aa, Artificial Sequence
  Description of Artificial Sequence: Synthetic peptide
  XENP019649 vlCDR1
NYWMN

SEQ ID NO: 11193 - protein, 19 aa, Artificial Sequence
  Description of Artificial Sequence: Synthetic peptide
  XENP019649 vlCDR2
EIRLYSNNYATHYAESVKG

SEQ ID NO: 11194 - protein, 11 aa, Artificial Sequence
  Description of Artificial Sequence: Synthetic peptide
  XENP019649 vlCDR3
YYGNYGGYFDV

SEQ ID NO: 11195 - protein, 249 aa, Artificial Sequence
  Description of Artificial Sequence: Synthetic polypeptide
  XENP019650 1G6_L1.192_H1.278_scFv(GKPGS)4
EIVLTQSPATLSASPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 11196 - protein, 107 aa, Artificial Sequence; identical to SEQ ID NO: 10981
  Description of Artificial Sequence: Synthetic polypeptide
  VH of XENP019650

SEQ ID NO: 11197 - protein, 122 aa, Artificial Sequence; identical to SEQ ID NO: 10845
  Description of Artificial Sequence: Synthetic polypeptide
  VL of XENP019650

SEQ ID NO: 11198 - protein, 11 aa, Artificial Sequence
  Description of Artificial Sequence: Synthetic peptide
  XENP019650 vhCDR1
RASQSVGNDVA

SEQ ID NO: 11199 - protein, 7 aa, Artificial Sequence
  Description of Artificial Sequence: Synthetic peptide
  XENP019650 vhCDR2
YASHRYT

SEQ ID NO: 11200 - protein, 9 aa, Artificial Sequence
  Description of Artificial Sequence: Synthetic peptide
  XENP019650 vhCDR3
QQDFSSPRT

SEQ ID NO: 11201 - protein, 5 aa, Artificial Sequence
  Description of Artificial Sequence: Synthetic peptide
  XENP019650 vlCDR1
NYWMN

SEQ ID NO: 11202 - protein, 19 aa, Artificial Sequence
  Description of Artificial Sequence: Synthetic peptide
  XENP019650 vlCDR2
EIRLYSNNYATHYAESVKG

SEQ ID NO: 11203 - protein, 11 aa, Artificial Sequence
  Description of Artificial Sequence: Synthetic peptide
  XENP019650 vlCDR3
YYGNYGGYFDV

SEQ ID NO: 11204 - protein, 249 aa, Artificial Sequence
  Description of Artificial Sequence: Synthetic polypeptide
  XENP019651 1G6_L1.193_H1.278_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 11205 - protein, 107 aa, Artificial Sequence; identical to SEQ ID NO: 10990
  Description of Artificial Sequence: Synthetic polypeptide
  VH of XENP019651

SEQ ID NO: 11206 - protein, 122 aa, Artificial Sequence; identical to SEQ ID NO: 10845
  Description of Artificial Sequence: Synthetic polypeptide
  VL of XENP019651

SEQ ID NO: 11207 - protein, 11 aa, Artificial Sequence
  Description of Artificial Sequence: Synthetic peptide
  XENP019651 vhCDR1
RASQSVGNDVA

SEQ ID NO: 11208 - protein, 7 aa, Artificial Sequence
  Description of Artificial Sequence: Synthetic peptide
  XENP019651 vhCDR2
YASHRYT

SEQ ID NO: 11209 - protein, 9 aa, Artificial Sequence
  Description of Artificial Sequence: Synthetic peptide
  XENP019651 vhCDR3
QQDFSSPRT

SEQ ID NO: 11210 - protein, 5 aa, Artificial Sequence
  Description of Artificial Sequence: Synthetic peptide
  XENP019651 vlCDR1
NYWMN

SEQ ID NO: 11211 - protein, 19 aa, Artificial Sequence
  Description of Artificial Sequence: Synthetic peptide
  XENP019651 vlCDR2
EIRLYSNNYATHYAESVKG

SEQ ID NO: 11212 - protein, 11 aa, Artificial Sequence
  Description of Artificial Sequence: Synthetic peptide
  XENP019651 vlCDR3
YYGNYGGYFDV

SEQ ID NO: 11213 - protein, 249 aa, Artificial Sequence
  Description of Artificial Sequence: Synthetic polypeptide
  XENP019652 1G6_L1.194_H1.278_scFv(GKPGS)4
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 11214 - protein, 107 aa, Artificial Sequence; identical to SEQ ID NO: 10999
  Description of Artificial Sequence: Synthetic polypeptide
  VH of XENP019652

SEQ ID NO: 11215 - protein, 122 aa, Artificial Sequence; identical to SEQ ID NO: 10845
  Description of Artificial Sequence: Synthetic polypeptide
  VL of XENP019652

SEQ ID NO: 11216 - protein, 11 aa, Artificial Sequence
  Description of Artificial Sequence: Synthetic peptide
  XENP019652 vhCDR1
RASQSVGNDVA

SEQ ID NO: 11217 - protein, 7 aa, Artificial Sequence
  Description of Artificial Sequence: Synthetic peptide
  XENP019652 vhCDR2
YASHRYT

SEQ ID NO: 11218 - protein, 9 aa, Artificial Sequence
  Description of Artificial Sequence: Synthetic peptide
  XENP019652 vhCDR3
QQDFSSPRT

SEQ ID NO: 11219 - protein, 5 aa, Artificial Sequence
  Description of Artificial Sequence: Synthetic peptide
  XENP019652 vlCDR1
NYWMN

SEQ ID NO: 11220 - protein, 19 aa, Artificial Sequence
  Description of Artificial Sequence: Synthetic peptide
  XENP019652 vlCDR2
EIRLYSNNYATHYAESVKG

SEQ ID NO: 11221 - protein, 11 aa, Artificial Sequence
  Description of Artificial Sequence: Synthetic peptide
  XENP019652 vlCDR3
YYGNYGGYFDV

SEQ ID NO: 11222 - protein, 249 aa, Artificial Sequence
  Description of Artificial Sequence: Synthetic polypeptide
  XENP019653 1G6_L1.195_H1.278_scFv(GKPGS)4
EIVLTQSPATLSVSPGERVTLTCRASQSVGNDVAWYQQKPGQAPRLLCNYASHRYTGVPDRFTCSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 11223 - protein, 107 aa, Artificial Sequence; identical to SEQ ID NO: 11008
  Description of Artificial Sequence: Synthetic polypeptide
  VH of XENP019653

SEQ ID NO: 11224 - protein, 122 aa, Artificial Sequence; identical to SEQ ID NO: 10845
  Description of Artificial Sequence: Synthetic polypeptide
  VL of XENP019653

SEQ ID NO: 11225 - protein, 11 aa, Artificial Sequence
  Description of Artificial Sequence: Synthetic peptide
  XENP019653 vhCDR1
RASQSVGNDVA

SEQ ID NO: 11226 - protein, 9 aa, Artificial Sequence
  Description of Artificial Sequence: Synthetic peptide
  XENP019653 vhCDR2
CNYASHRYT

SEQ ID NO: 11227 - protein, 9 aa, Artificial Sequence
  Description of Artificial Sequence: Synthetic peptide
  XENP019653 vhCDR3
QQDFSSPRT

SEQ ID NO: 11228 - protein, 5 aa, Artificial Sequence
  Description of Artificial Sequence: Synthetic peptide
  XENP019653 vlCDR1
NYWMN

SEQ ID NO: 11229 - protein, 19 aa, Artificial Sequence
  Description of Artificial Sequence: Synthetic peptide
  XENP019653 vlCDR2
EIRLYSNNYATHYAESVKG

SEQ ID NO: 11230 - protein, 11 aa, Artificial Sequence
  Description of Artificial Sequence: Synthetic peptide
  XENP019653 vlCDR3
YYGNYGGYFDV

SEQ ID NO: 11231 - protein, 249 aa, Artificial Sequence
  Description of Artificial Sequence: Synthetic polypeptide
  XENP019654 1G6_L1.196_H1.278_scFv(GKPGS)4
EIVLTQSPATLSASPGERVTLTCRASQSVGNDVAWYQQKPGQAPRLLCNYASHRYTGVPDRFTCSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 11232 - protein, 107 aa, Artificial Sequence; identical to SEQ ID NO: 11017
  Description of Artificial Sequence: Synthetic polypeptide
  VH of XENP019654

SEQ ID NO: 11233 - protein, 122 aa, Artificial Sequence; identical to SEQ ID NO: 10845
  Description of Artificial Sequence: Synthetic polypeptide
  VL of XENP019654

SEQ ID NO: 11234 - protein, 11 aa, Artificial Sequence
  Description of Artificial Sequence: Synthetic peptide
  XENP019654 vhCDR1
RASQSVGNDVA

SEQ ID NO: 11235 - protein, 9 aa, Artificial Sequence
  Description of Artificial Sequence: Synthetic peptide
  XENP019654 vhCDR2
CNYASHRYT

SEQ ID NO: 11236 - protein, 9 aa, Artificial Sequence
  Description of Artificial Sequence: Synthetic peptide
  XENP019654 vhCDR3
QQDFSSPRT

SEQ ID NO: 11237 - protein, 5 aa, Artificial Sequence
  Description of Artificial Sequence: Synthetic peptide
  XENP019654 vlCDR1
NYWMN

SEQ ID NO: 11238 - protein, 19 aa, Artificial Sequence
  Description of Artificial Sequence: Synthetic peptide
  XENP019654 vlCDR2
EIRLYSNNYATHYAESVKG

SEQ ID NO: 11239 - protein, 11 aa, Artificial Sequence
  Description of Artificial Sequence: Synthetic peptide
  XENP019654 vlCDR3
YYGNYGGYFDV

SEQ ID NO: 11240 - protein, 249 aa, Artificial Sequence
  Description of Artificial Sequence: Synthetic polypeptide
  XENP019655 1G6_L1.197_H1.278_scFv(GKPGS)4
EIVLTQSPATLSASPGERVTLTCRASQSVGNDVAWYQQKPGQAPRLLCNYASHRYTSVPDRFTCSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 11241 - protein, 107 aa, Artificial Sequence; identical to SEQ ID NO: 11026
  Description of Artificial Sequence: Synthetic polypeptide
  VH of XENP019655

SEQ ID NO: 11242 - protein, 122 aa, Artificial Sequence; identical to SEQ ID NO: 10845
  Description of Artificial Sequence: Synthetic polypeptide
  VL of XENP019655

SEQ ID NO: 11243 - protein, 11 aa, Artificial Sequence
  Description of Artificial Sequence: Synthetic peptide
  XENP019655 vhCDR1
RASQSVGNDVA

SEQ ID NO: 11244 - protein, 9 aa, Artificial Sequence
  Description of Artificial Sequence: Synthetic peptide
  XENP019655 vhCDR2
CNYASHRYT

SEQ ID NO: 11245 - protein, 9 aa, Artificial Sequence
  Description of Artificial Sequence: Synthetic peptide
  XENP019655 vhCDR3
QQDFSSPRT

SEQ ID NO: 11246 - protein, 5 aa, Artificial Sequence
  Description of Artificial Sequence: Synthetic peptide
  XENP019655 vlCDR1
NYWMN

SEQ ID NO: 11247 - protein, 19 aa, Artificial Sequence
  Description of Artificial Sequence: Synthetic peptide
  XENP019655 vlCDR2
EIRLYSNNYATHYAESVKG

SEQ ID NO: 11248 - protein, 11 aa, Artificial Sequence
  Description of Artificial Sequence: Synthetic peptide
  XENP019655 vlCDR3
YYGNYGGYFDV

SEQ ID NO: 11249 - protein, 249 aa, Artificial Sequence
  Description of Artificial Sequence: Synthetic polypeptide
  XENP019656 1G6_H1.278_L1.189_scFv_linkerV1
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGGGGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11250 - protein, 122 aa, Artificial Sequence; identical to SEQ ID NO: 10845
  Description of Artificial Sequence: Synthetic polypeptide
  VH of XENP019656

SEQ ID NO: 11251 - protein, 107 aa, Artificial Sequence; identical to SEQ ID NO: 10864
  Description of Artificial Sequence: Synthetic polypeptide
  VL of XENP019656

SEQ ID NO: 11252 - protein, 5 aa, Artificial Sequence
  Description of Artificial Sequence: Synthetic peptide
  XENP019656 vhCDR1
NYWMN

SEQ ID NO: 11253 - protein, 19 aa, Artificial Sequence
  Description of Artificial Sequence: Synthetic peptide
  XENP019656 vhCDR2
EIRLYSNNYATHYAESVKG

SEQ ID NO: 11254 - protein, 11 aa, Artificial Sequence
  Description of Artificial Sequence: Synthetic peptide
  XENP019656 vhCDR3
YYGNYGGYFDV

SEQ ID NO: 11255 - protein, 11 aa, Artificial Sequence
  Description of Artificial Sequence: Synthetic peptide
  XENP019656 vlCDR1
RASQSVGNDVA

SEQ ID NO: 11256 - protein, 7 aa, Artificial Sequence
  Description of Artificial Sequence: Synthetic peptide
  XENP019656 vlCDR2
YASHRYT

SEQ ID NO: 11257 - protein, 9 aa, Artificial Sequence
  Description of Artificial Sequence: Synthetic peptide
  XENP019656 vlCDR3
QQDFSSPRT

SEQ ID NO: 11258 - protein, 247 aa, Artificial Sequence
  Description of Artificial Sequence: Synthetic polypeptide
  XENP019657 1G6_H1.278_L1.189_scFv_linkerV2
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11259 - protein, 122 aa, Artificial Sequence; identical to SEQ ID NO: 10845
  Description of Artificial Sequence: Synthetic polypeptide
  VH of XENP019657

SEQ ID NO: 11260 - protein, 107 aa, Artificial Sequence; identical to SEQ ID NO: 10864
  Description of Artificial Sequence: Synthetic polypeptide
  VL of XENP019657

SEQ ID NO: 11261 - protein, 5 aa, Artificial Sequence
  Description of Artificial Sequence: Synthetic peptide
  XENP019657 vhCDR1
NYWMN

SEQ ID NO: 11262 - protein, 19 aa, Artificial Sequence
  Description of Artificial Sequence: Synthetic peptide
  XENP019657 vhCDR2
EIRLYSNNYATHYAESVKG

SEQ ID NO: 11263 - protein, 11 aa, Artificial Sequence
  Description of Artificial Sequence: Synthetic peptide
  XENP019657 vhCDR3
YYGNYGGYFDV

SEQ ID NO: 11264 - protein, 11 aa, Artificial Sequence
  Description of Artificial Sequence: Synthetic peptide
  XENP019657 vlCDR1
RASQSVGNDVA

SEQ ID NO: 11265 - protein, 7 aa, Artificial Sequence
  Description of Artificial Sequence: Synthetic peptide
  XENP019657 vlCDR2
YASHRYT

SEQ ID NO: 11266 - protein, 9 aa, Artificial Sequence
  Description of Artificial Sequence: Synthetic peptide
  XENP019657 vlCDR3
QQDFSSPRT

SEQ ID NO: 11267 - protein, 244 aa, Artificial Sequence
  Description of Artificial Sequence: Synthetic polypeptide
  XENP019658 1G6_H1.278_L1.189_scFv_linkerV3
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11268 - protein, 122 aa, Artificial Sequence; identical to SEQ ID NO: 10845
  Description of Artificial Sequence: Synthetic polypeptide
  VH of XENP019658

SEQ ID NO: 11269 - protein, 107 aa, Artificial Sequence; identical to SEQ ID NO: 10864
  Description of Artificial Sequence: Synthetic polypeptide
  VL of XENP019658

SEQ ID NO: 11270 - protein, 5 aa, Artificial Sequence
  Description of Artificial Sequence: Synthetic peptide
  XENP019658 vhCDR1
NYWMN

SEQ ID NO: 11271 - protein, 19 aa, Artificial Sequence
  Description of Artificial Sequence: Synthetic peptide
  XENP019658 vhCDR2
EIRLYSNNYATHYAESVKG

SEQ ID NO: 11272 - protein, 11 aa, Artificial Sequence
  Description of Artificial Sequence: Synthetic peptide
  XENP019658 vhCDR3
YYGNYGGYFDV

SEQ ID NO: 11273 - protein, 11 aa, Artificial Sequence
  Description of Artificial Sequence: Synthetic peptide
  XENP019658 vlCDR1
RASQSVGNDVA

SEQ ID NO: 11274 - protein, 7 aa, Artificial Sequence
  Description of Artificial Sequence: Synthetic peptide
  XENP019658 vlCDR2
YASHRYT

SEQ ID NO: 11275 - protein, 9 aa, Artificial Sequence
  Description of Artificial Sequence: Synthetic peptide
  XENP019658 vlCDR3
QQDFSSPRT

SEQ ID NO: 11276 - protein, 251 aa, Artificial Sequence
  Description of Artificial Sequence: Synthetic polypeptide
  XENP019659 1G6_H1.278_L1.189_scFv_linkerV4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11277 - protein, 122 aa, Artificial Sequence; identical to SEQ ID NO: 10845
  Description of Artificial Sequence: Synthetic polypeptide
  VH of XENP019659

SEQ ID NO: 11278 - protein, 107 aa, Artificial Sequence; identical to SEQ ID NO: 10864
  Description of Artificial Sequence: Synthetic polypeptide
  VL of XENP019659

SEQ ID NO: 11279 - protein, 5 aa, Artificial Sequence
  Description of Artificial Sequence: Synthetic peptide
  XENP019659 vhCDR1
NYWMN

SEQ ID NO: 11280 - protein, 19 aa, Artificial Sequence
  Description of Artificial Sequence: Synthetic peptide
  XENP019659 vhCDR2
EIRLYSNNYATHYAESVKG

SEQ ID NO: 11281 - protein, 11 aa, Artificial Sequence
  Description of Artificial Sequence: Synthetic peptide
  XENP019659 vhCDR3
YYGNYGGYFDV

SEQ ID NO: 11282 - protein, 11 aa, Artificial Sequence
  Description of Artificial Sequence: Synthetic peptide
  XENP019659 vlCDR1
RASQSVGNDVA

SEQ ID NO: 11283 - protein, 7 aa, Artificial Sequence
  Description of Artificial Sequence: Synthetic peptide
  XENP019659 vlCDR2
YASHRYT

SEQ ID NO: 11284 - protein, 9 aa, Artificial Sequence
  Description of Artificial Sequence: Synthetic peptide
  XENP019659 vlCDR3
QQDFSSPRT

SEQ ID NO: 11285 - protein, 252 aa, Artificial Sequence
  Description of Artificial Sequence: Synthetic polypeptide
  XENP019660 1G6_H1.278_L1.189_scFv_linkerV5
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSGGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11286 - protein, 122 aa, Artificial Sequence; identical to SEQ ID NO: 10845
  Description of Artificial Sequence: Synthetic polypeptide
  VH of XENP019660

SEQ ID NO: 11287 - protein, 108 aa, Artificial Sequence
  Description of Artificial Sequence: Synthetic polypeptide
  VL of XENP019660
SEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11288 - protein, 5 aa, Artificial Sequence
  Description of Artificial Sequence: Synthetic peptide
  XENP019660 vhCDR1
NYWMN

SEQ ID NO: 11289 - protein, 19 aa, Artificial Sequence
  Description of Artificial Sequence: Synthetic peptide
  XENP019660 vhCDR2
EIRLYSNNYATHYAESVKG

SEQ ID NO: 11290 - protein, 11 aa, Artificial Sequence
  Description of Artificial Sequence: Synthetic peptide
  XENP019660 vhCDR3
YYGNYGGYFDV

SEQ ID NO: 11291 - protein, 11 aa, Artificial Sequence
  Description of Artificial Sequence: Synthetic peptide
  XENP019660 vlCDR1
RASQSVGNDVA

SEQ ID NO: 11292 - protein, 7 aa, Artificial Sequence
  Description of Artificial Sequence: Synthetic peptide
  XENP019660 vlCDR2
YASHRYT

SEQ ID NO: 11293 - protein, 9 aa, Artificial Sequence
  Description of Artificial Sequence: Synthetic peptide
  XENP019660 vlCDR3
QQDFSSPRT

SEQ ID NO: 11294 - protein, 253 aa, Artificial Sequence
  Description of Artificial Sequence: Synthetic polypeptide
  XENP019661 1G6_H1.278_L1.189_scFv_linkerV6
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSGGGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11295 - protein, 122 aa, Artificial Sequence; identical to SEQ ID NO: 10845
  Description of Artificial Sequence: Synthetic polypeptide
  VH of XENP019661

SEQ ID NO: 11296 - protein, 107 aa, Artificial Sequence; identical to SEQ ID NO: 10864
  Description of Artificial Sequence: Synthetic polypeptide
  VL of XENP019661

SEQ ID NO: 11297 - protein, 5 aa, Artificial Sequence
  Description of Artificial Sequence: Synthetic peptide
  XENP019661 vhCDR1
NYWMN

SEQ ID NO: 11298 - protein, 19 aa, Artificial Sequence
  Description of Artificial Sequence: Synthetic peptide
  XENP019661 vhCDR2
EIRLYSNNYATHYAESVKG

SEQ ID NO: 11299 - protein, 11 aa, Artificial Sequence
  Description of Artificial Sequence: Synthetic peptide
  XENP019661 vhCDR3
YYGNYGGYFDV

SEQ ID NO: 11300 - protein, 11 aa, Artificial Sequence
  Description of Artificial Sequence: Synthetic peptide
  XENP019661 vlCDR1
RASQSVGNDVA

SEQ ID NO: 11301 - protein, 7 aa, Artificial Sequence
  Description of Artificial Sequence: Synthetic peptide
  XENP019661 vlCDR2
YASHRYT

SEQ ID NO: 11302 - protein, 9 aa, Artificial Sequence
  Description of Artificial Sequence: Synthetic peptide
  XENP019661 vlCDR3
QQDFSSPRT

SEQ ID NO: 11303 - protein, 254 aa, Artificial Sequence
  Description of Artificial Sequence: Synthetic polypeptide
  XENP019662 1G6_H1.278_L1.189_scFv_linkerV7
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSGGGGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11304 - protein, 122 aa, Artificial Sequence; identical to SEQ ID NO: 10845
  Description of Artificial Sequence: Synthetic polypeptide
  VH of XENP019662

SEQ ID NO: 11305 - protein, 107 aa, Artificial Sequence; identical to SEQ ID NO: 10864
  Description of Artificial Sequence: Synthetic polypeptide
  VL of XENP019662

SEQ ID NO: 11306 - protein, 5 aa, Artificial Sequence
  Description of Artificial Sequence: Synthetic peptide
  XENP019662 vhCDR1
NYWMN

SEQ ID NO: 11307 - protein, 19 aa, Artificial Sequence
  Description of Artificial Sequence: Synthetic peptide
  XENP019662 vhCDR2
EIRLYSNNYATHYAESVKG

SEQ ID NO: 11308 - protein, 11 aa, Artificial Sequence
  Description of Artificial Sequence: Synthetic peptide
  XENP019662 vhCDR3
YYGNYGGYFDV

SEQ ID NO: 11309 - protein, 11 aa, Artificial Sequence
  Description of Artificial Sequence: Synthetic peptide
  XENP019662 vlCDR1
RASQSVGNDVA

SEQ ID NO: 11310 - protein, 7 aa, Artificial Sequence
  Description of Artificial Sequence: Synthetic peptide
  XENP019662 vlCDR2
YASHRYT

SEQ ID NO: 11311 - protein, 9 aa, Artificial Sequence
  Description of Artificial Sequence: Synthetic peptide
  XENP019662 vlCDR3
QQDFSSPRT

SEQ ID NO: 11312 - protein, 242 aa, Artificial Sequence
  Description of Artificial Sequence: Synthetic polypeptide
  XENP019663 1G6_H1.278_L1.189_scFv_linkerV8
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11313 - protein, 122 aa, Artificial Sequence; identical to SEQ ID NO: 10845
  Description of Artificial Sequence: Synthetic polypeptide
  VH of XENP019663

SEQ ID NO: 11314 - protein, 107 aa, Artificial Sequence; identical to SEQ ID NO: 10864
  Description of Artificial Sequence: Synthetic polypeptide
  VL of XENP019663

SEQ ID NO: 11315 - protein, 5 aa, Artificial Sequence
  Description of Artificial Sequence: Synthetic peptide
  XENP019663 vhCDR1
NYWMN

SEQ ID NO: 11316 - protein, 19 aa, Artificial Sequence
  Description of Artificial Sequence: Synthetic peptide
  XENP019663 vhCDR2
EIRLYSNNYATHYAESVKG

SEQ ID NO: 11317 - protein, 11 aa, Artificial Sequence
  Description of Artificial Sequence: Synthetic peptide
  XENP019663 vhCDR3
YYGNYGGYFDV

SEQ ID NO: 11318 - protein, 11 aa, Artificial Sequence
  Description of Artificial Sequence: Synthetic peptide
  XENP019663 vlCDR1
RASQSVGNDVA

SEQ ID NO: 11319 - protein, 7 aa, Artificial Sequence
  Description of Artificial Sequence: Synthetic peptide
  XENP019663 vlCDR2
YASHRYT

SEQ ID NO: 11320 - protein, 9 aa, Artificial Sequence
  Description of Artificial Sequence: Synthetic peptide
  XENP019663 vlCDR3
QQDFSSPRT

SEQ ID NO: 11321 - protein, 249 aa, Artificial Sequence
  Description of Artificial Sequence: Synthetic polypeptide
  XENP019664 1G6_H1.287_L1.209_scFv(GKPGS)4
EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGCGTKVEIK

SEQ ID NO: 11322 - protein, 122 aa, Artificial Sequence
  Description of Artificial Sequence: Synthetic polypeptide
  VH of XENP019664
EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGQGTLVTVSS

SEQ ID NO: 11323 - protein, 107 aa, Artificial Sequence
  Description of Artificial Sequence: Synthetic polypeptide
  VL of XENP019664
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGCGTKVEIK

SEQ ID NO: 11324 - protein, 5 aa, Artificial Sequence
  Description of Artificial Sequence: Synthetic peptide
  XENP019664 vhCDR1
NYWMN

SEQ ID NO: 11325 - protein, 19 aa, Artificial Sequence
  Description of Artificial Sequence: Synthetic peptide
  XENP019664 vhCDR2
EIRLYSNNYATHYAESVKG

SEQ ID NO: 11326 - protein, 11 aa, Artificial Sequence
  Description of Artificial Sequence: Synthetic peptide
  XENP019664 vhCDR3
YYGNYGGYFDV

SEQ ID NO: 11327 - protein, 11 aa, Artificial Sequence
  Description of Artificial Sequence: Synthetic peptide
  XENP019664 vlCDR1
RASQSVGNDVA

SEQ ID NO: 11328 - protein, 7 aa, Artificial Sequence
  Description of Artificial Sequence: Synthetic peptide
  XENP019664 vlCDR2
YASHRYT

SEQ ID NO: 11329 - protein, 9 aa, Artificial Sequence
  Description of Artificial Sequence: Synthetic peptide
  XENP019664 vlCDR3
QQDFSSPRT

SEQ ID NO: 11330 - protein, 249 aa, Artificial Sequence
  Description of Artificial Sequence: Synthetic polypeptide
  XENP019665 1G6_L1.209_H1.287_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGCGTKVEIKGKPGSGKPGSGKPGSGKPGSEVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGQGTLVTVSS

SEQ ID NO: 11331 - protein, 107 aa, Artificial Sequence; identical to SEQ ID NO: 11323
  Description of Artificial Sequence: Synthetic polypeptide
  VH of XENP019665

SEQ ID NO: 11332 - protein, 122 aa, Artificial Sequence; identical to SEQ ID NO: 11322
  Description of Artificial Sequence: Synthetic polypeptide
  VL of XENP019665

SEQ ID NO: 11333 - protein, 11 aa, Artificial Sequence
  Description of Artificial Sequence: Synthetic peptide
  XENP019665 vhCDR1
RASQSVGNDVA

SEQ ID NO: 11334 - protein, 7 aa, Artificial Sequence
  Description of Artificial Sequence: Synthetic peptide
  XENP019665 vhCDR2
YASHRYT

SEQ ID NO: 11335 - protein, 9 aa, Artificial Sequence
  Description of Artificial Sequence: Synthetic peptide
  XENP019665 vhCDR3
QQDFSSPRT

SEQ ID NO: 11336 - protein, 5 aa, Artificial Sequence
  Description of Artificial Sequence: Synthetic peptide
  XENP019665 vlCDR1
NYWMN

SEQ ID NO: 11337 - protein, 19 aa, Artificial Sequence
  Description of Artificial Sequence: Synthetic peptide
  XENP019665 vlCDR2
EIRLYSNNYATHYAESVKG

SEQ ID NO: 11338 - protein, 11 aa, Artificial Sequence
  Description of Artificial Sequence: Synthetic peptide
  XENP019665 vlCDR3
YYGNYGGYFDV

SEQ ID NO: 11339 - protein, 249 aa, Artificial Sequence
  Description of Artificial Sequence: Synthetic polypeptide
  XENP019666 1G6_H1.284_L1.194_scFv(GKPGS)4
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 11340 - protein, 122 aa, Artificial Sequence; identical to SEQ ID NO: 10953
  Description of Artificial Sequence: Synthetic polypeptide
  VH of XENP019666

SEQ ID NO: 11341 - protein, 107 aa, Artificial Sequence; identical to SEQ ID NO: 10999
  Description of Artificial Sequence: Synthetic polypeptide
  VL of XENP019666

SEQ ID NO: 11342 - protein, 5 aa, Artificial Sequence
  Description of Artificial Sequence: Synthetic peptide
  XENP019666 vhCDR1
NYWMN

SEQ ID NO: 11343 - protein, 19 aa, Artificial Sequence
  Description of Artificial Sequence: Synthetic peptide
  XENP019666 vhCDR2
EIRLYSNNYATHYAESVKG

SEQ ID NO: 11344 - protein, 11 aa, Artificial Sequence
  Description of Artificial Sequence: Synthetic peptide
  XENP019666 vhCDR3
YYGNYGGYFDV

SEQ ID NO: 11345 - protein, 11 aa, Artificial Sequence
  Description of Artificial Sequence: Synthetic peptide
  XENP019666 vlCDR1
RASQSVGNDVA

SEQ ID NO: 11346 - protein, 7 aa, Artificial Sequence
  Description of Artificial Sequence: Synthetic peptide
  XENP019666 vlCDR2
YASHRYT

SEQ ID NO: 11347 - protein, 9 aa, Artificial Sequence
  Description of Artificial Sequence: Synthetic peptide
  XENP019666 vlCDR3
QQDFSSPRT

SEQ ID NO: 11348 - protein, 249 aa, Artificial Sequence
  Description of Artificial Sequence: Synthetic polypeptide
  XENP019667 1G6_L1.194_H1.284_scFv(GKPGS)4
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSS

SEQ ID NO: 11349 - protein, 107 aa, Artificial Sequence; identical to SEQ ID NO: 10999
  Description of Artificial Sequence: Synthetic polypeptide
  VH of XENP019667

SEQ ID NO: 11350 - protein, 122 aa, Artificial Sequence; identical to SEQ ID NO: 10953
  Description of Artificial Sequence: Synthetic polypeptide
  VL of XENP019667

SEQ ID NO: 11351 - protein, 11 aa, Artificial Sequence
  Description of Artificial Sequence: Synthetic peptide
  XENP019667 vhCDR1
RASQSVGNDVA

SEQ ID NO: 11352 - protein, 7 aa, Artificial Sequence
  Description of Artificial Sequence: Synthetic peptide
  XENP019667 vhCDR2
YASHRYT

SEQ ID NO: 11353 - protein, 9 aa, Artificial Sequence
  Description of Artificial Sequence: Synthetic peptide
  XENP019667 vhCDR3
QQDFSSPRT

SEQ ID NO: 11354 - protein, 5 aa, Artificial Sequence
  Description of Artificial Sequence: Synthetic peptide
  XENP019667 vlCDR1
NYWMN

SEQ ID NO: 11355 - protein, 19 aa, Artificial Sequence
  Description of Artificial Sequence: Synthetic peptide
  XENP019667 vlCDR2
EIRLYSNNYATHYAESVKG

SEQ ID NO: 11356 - protein, 11 aa, Artificial Sequence
  Description of Artificial Sequence: Synthetic peptide
  XENP019667 vlCDR3
YYGNYGGYFDV

SEQ ID NO: 11357 - protein, 249 aa, Artificial Sequence
  Description of Artificial Sequence: Synthetic polypeptide
  XENP019668 1G6_H1.288_L1.210_scFv(GKPGS)4
EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIK

SEQ ID NO: 11358 - protein, 122 aa, Artificial Sequence
  Description of Artificial Sequence: Synthetic polypeptide
  VH of XENP019668
EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSS

SEQ ID NO: 11359 - protein, 107 aa, Artificial Sequence
  Description of Artificial Sequence: Synthetic polypeptide
  VL of XENP019668
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIK

SEQ ID NO: 11360 - protein, 5 aa, Artificial Sequence
  Description of Artificial Sequence: Synthetic peptide
  XENP019668 vhCDR1
NYWMN

SEQ ID NO: 11361 - protein, 19 aa, Artificial Sequence
  Description of Artificial Sequence: Synthetic peptide
  XENP019668 vhCDR2
EIRLYSNNYATHYAESVKG

SEQ ID NO: 11362 - protein, 11 aa, Artificial Sequence
  Description of Artificial Sequence: Synthetic peptide
  XENP019668 vhCDR3
YYGNYGGYFDV

SEQ ID NO: 11363 - protein, 11 aa, Artificial Sequence
  Description of Artificial Sequence: Synthetic peptide
  XENP019668 vlCDR1
RASQSVGNDVA

SEQ ID NO: 11364 - protein, 7 aa, Artificial Sequence
  Description of Artificial Sequence: Synthetic peptide
  XENP019668 vlCDR2
YASHRYT

SEQ ID NO: 11365 - protein, 9 aa, Artificial Sequence
  Description of Artificial Sequence: Synthetic peptide
  XENP019668 vlCDR3
QQDFSSPRT

SEQ ID NO: 11366 - protein, 249 aa, Artificial Sequence
  Description of Artificial Sequence: Synthetic polypeptide
  XENP019669 1G6_L1.210_H1.288_scFv(GKPGS)4
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIKGKPGSGKPGSGKPGSGKPGSEVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSS

SEQ ID NO: 11367 - protein, 107 aa, Artificial Sequence; identical to SEQ ID NO: 11359
  Description of Artificial Sequence: Synthetic polypeptide
  VH of XENP019669

SEQ ID NO: 11368 - protein, 122 aa, Artificial Sequence; identical to SEQ ID NO: 11358
  Description of Artificial Sequence: Synthetic polypeptide
  VL of XENP019669

SEQ ID NO: 11369 - protein, 11 aa, Artificial Sequence
  Description of Artificial Sequence: Synthetic peptide
  XENP019669 vhCDR1
RASQSVGNDVA

SEQ ID NO: 11370 - protein, 7 aa, Artificial Sequence
  Description of Artificial Sequence: Synthetic peptide
  XENP019669 vhCDR2
YASHRYT

SEQ ID NO: 11371 - protein, 9 aa, Artificial Sequence
  Description of Artificial Sequence: Synthetic peptide
  XENP019669 vhCDR3
QQDFSSPRT

SEQ ID NO: 11372 - protein, 5 aa, Artificial Sequence
  Description of Artificial Sequence: Synthetic peptide
  XENP019669 vlCDR1
NYWMN

SEQ ID NO: 11373 - protein, 19 aa, Artificial Sequence
  Description of Artificial Sequence: Synthetic peptide
  XENP019669 vlCDR2
EIRLYSNNYATHYAESVKG

SEQ ID NO: 11374 - protein, 11 aa, Artificial Sequence
  Description of Artificial Sequence: Synthetic peptide
  XENP019669 vlCDR3
YYGNYGGYFDV

SEQ ID NO: 11375 - protein, 249 aa, Artificial Sequence
  Description of Artificial Sequence: Synthetic polypeptide
  XENP019690 1G6_H1.279_L1.194_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 11376 - protein, 122 aa, Artificial Sequence; identical to SEQ ID NO: 10908
  Description of Artificial Sequence: Synthetic polypeptide
  VH of XENP019690

SEQ ID NO: 11377 - protein, 107 aa, Artificial Sequence; identical to SEQ ID NO: 10999
  Description of Artificial Sequence: Synthetic polypeptide
  VL of XENP019690

SEQ ID NO: 11378 - protein, 5 aa, Artificial Sequence
  Description of Artificial Sequence: Synthetic peptide
  XENP019690 vhCDR1
NYWMN

SEQ ID NO: 11379 - protein, 19 aa, Artificial Sequence
  Description of Artificial Sequence: Synthetic peptide
  XENP019690 vhCDR2
EIRLYSNNYATHYAESVKG

SEQ ID NO: 11380 - protein, 11 aa, Artificial Sequence
  Description of Artificial Sequence: Synthetic peptide
  XENP019690 vhCDR3
YYGNYGGYFDV

SEQ ID NO: 11381 - protein, 11 aa, Artificial Sequence
  Description of Artificial Sequence: Synthetic peptide
  XENP019690 vlCDR1
RASQSVGNDVA

SEQ ID NO: 11382 - protein, 7 aa, Artificial Sequence
  Description of Artificial Sequence: Synthetic peptide
  XENP019690 vlCDR2
YASHRYT

SEQ ID NO: 11383 - protein, 9 aa, Artificial Sequence
  Description of Artificial Sequence: Synthetic peptide
  XENP019690 vlCDR3
QQDFSSPRT

SEQ ID NO: 11384 - protein, 249 aa, Artificial Sequence
  Description of Artificial Sequence: Synthetic polypeptide
  XENP019691 1G6_H1.282_L1.194_scFv(GKPGS)4
EVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 11385 - protein, 122 aa, Artificial Sequence; identical to SEQ ID NO: 10935
  Description of Artificial Sequence: Synthetic polypeptide
  VH of XENP019691

SEQ ID NO: 11386 - protein, 107 aa, Artificial Sequence; identical to SEQ ID NO: 10999
  Description of Artificial Sequence: Synthetic polypeptide
  VL of XENP019691

SEQ ID NO: 11387 - protein, 5 aa, Artificial Sequence
  Description of Artificial Sequence: Synthetic peptide
  XENP019691 vhCDR1
NYWMN

SEQ ID NO: 11388 - protein, 19 aa, Artificial Sequence
  Description of Artificial Sequence: Synthetic peptide
  XENP019691 vhCDR2
EIRLYSNNYATHYAESVKG

SEQ ID NO: 11389 - protein, 11 aa, Artificial Sequence
  Description of Artificial Sequence: Synthetic peptide
  XENP019691 vhCDR3
YYGNYGGYFDV

SEQ ID NO: 11390 - protein, 11 aa, Artificial Sequence
  Description of Artificial Sequence: Synthetic peptide
  XENP019691 vlCDR1
RASQSVGNDVA

SEQ ID NO: 11391 - protein, 7 aa, Artificial Sequence
  Description of Artificial Sequence: Synthetic peptide
  XENP019691 vlCDR2
YASHRYT

SEQ ID NO: 11392 - protein, 9 aa, Artificial Sequence
  Description of Artificial Sequence: Synthetic peptide
  XENP019691 vlCDR3
QQDFSSPRT

SEQ ID NO: 11393 - protein, 249 aa, Artificial Sequence
  Description of Artificial Sequence: Synthetic polypeptide
  XENP019692 1G6_L1.194_H1.279_scFv(GKPGS)4
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 11394 - protein, 107 aa, Artificial Sequence; identical to SEQ ID NO: 10999
  Description of Artificial Sequence: Synthetic polypeptide
  VH of XENP019692

SEQ ID NO: 11395 - protein, 122 aa, Artificial Sequence; identical to SEQ ID NO: 10908
  Description of Artificial Sequence: Synthetic polypeptide
  VL of XENP019692

SEQ ID NO: 11396 - protein, 11 aa, Artificial Sequence
  Description of Artificial Sequence: Synthetic peptide
  XENP019692 vhCDR1
RASQSVGNDVA

SEQ ID NO: 11397 - protein, 7 aa, Artificial Sequence
  Description of Artificial Sequence: Synthetic peptide
  XENP019692 vhCDR2
YASHRYT

SEQ ID NO: 11398 - protein, 9 aa, Artificial Sequence
  Description of Artificial Sequence: Synthetic peptide
  XENP019692 vhCDR3
QQDFSSPRT

SEQ ID NO: 11399 - protein, 5 aa, Artificial Sequence
  Description of Artificial Sequence: Synthetic peptide
  XENP019692 vlCDR1
NYWMN

SEQ ID NO: 11400 - protein, 19 aa, Artificial Sequence
  Description of Artificial Sequence: Synthetic peptide
  XENP019692 vlCDR2
EIRLYSNNYATHYAESVKG

SEQ ID NO: 11401 - protein, 11 aa, Artificial Sequence
  Description of Artificial Sequence: Synthetic peptide
  XENP019692 vlCDR3
YYGNYGGYFDV

SEQ ID NO: 11402 - protein, 249 aa, Artificial Sequence
  Description of Artificial Sequence: Synthetic polypeptide
  XENP019693 1G6_L1.194_H1.282_scFv(GKPGS)4
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSS

SEQ ID NO: 11403 - protein, 107 aa, Artificial Sequence; identical to SEQ ID NO: 10999
  Description of Artificial Sequence: Synthetic polypeptide
  VH of XENP019693

SEQ ID NO: 11404 - protein, 122 aa, Artificial Sequence; identical to SEQ ID NO: 10935
  Description of Artificial Sequence: Synthetic polypeptide
  VL of XENP019693

SEQ ID NO: 11405 - protein, 11 aa, Artificial Sequence
  Description of Artificial Sequence: Synthetic peptide
  XENP019693 vhCDR1
RASQSVGNDVA

SEQ ID NO: 11406 - protein, 7 aa, Artificial Sequence
  Description of Artificial Sequence: Synthetic peptide
  XENP019693 vhCDR2
YASHRYT

SEQ ID NO: 11407 - protein, 9 aa, Artificial Sequence
  Description of Artificial Sequence: Synthetic peptide
  XENP019693 vhCDR3
QQDFSSPRT

SEQ ID NO: 11408 - protein, 5 aa, Artificial Sequence
  Description of Artificial Sequence: Synthetic peptide
  XENP019693 vlCDR1
NYWMN

SEQ ID NO: 11409 - protein, 19 aa, Artificial Sequence
  Description of Artificial Sequence: Synthetic peptide
  XENP019693 vlCDR2
EIRLYSNNYATHYAESVKG

SEQ ID NO: 11410 - protein, 11 aa, Artificial Sequence
  Description of Artificial Sequence: Synthetic peptide
  XENP019693 vlCDR3
YYGNYGGYFDV

SEQ ID NO: 11411 - protein, 247 aa, Artificial Sequence
  Description of Artificial Sequence: Synthetic polypeptide
  XENP020162 2E9_H1L1_scFv(GKPGS)4
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSGKPGSGKPGSGKPGSGKPGSDIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK

SEQ ID NO: 11412 - protein, 120 aa, Artificial Sequence
  Description of Artificial Sequence: Synthetic polypeptide
  VH of XENP020162
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSS

SEQ ID NO: 11413 - protein, 107 aa, Artificial Sequence
  Description of Artificial Sequence: Synthetic polypeptide
  VL of XENP020162
DIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK

SEQ ID NO: 11414 - protein, 5 aa, Artificial Sequence
  Description of Artificial Sequence: Synthetic peptide
  XENP020162 vhCDR1
NYWLG

SEQ ID NO: 11415 - protein, 17 aa, Artificial Sequence
  Description of Artificial Sequence: Synthetic peptide
  XENP020162 vhCDR2
NFYPGSSNTYYNEKFQG

SEQ ID NO: 11416 - protein, 11 aa, Artificial Sequence
  Description of Artificial Sequence: Synthetic peptide
  XENP020162 vhCDR3
HYGTNYRYFDV

SEQ ID NO: 11417 - protein, 11 aa, Artificial Sequence
  Description of Artificial Sequence: Synthetic peptide
  XENP020162 vlCDR1
RASQSVSNDVA

SEQ ID NO: 11418 - protein, 7 aa, Artificial Sequence
  Description of Artificial Sequence: Synthetic peptide
  XENP020162 vlCDR2
YASNRYT

SEQ ID NO: 11419 - protein, 9 aa, Artificial Sequence
  Description of Artificial Sequence: Synthetic peptide
  XENP020162 vlCDR3
QQDYSSPYT

SEQ ID NO: 11420 - protein, 247 aa, Artificial Sequence
  Description of Artificial Sequence: Synthetic polypeptide
  XENP020163 2E9_H2L1_scFv(GKPGS)4
EVQLVQSGAEVKKPGESLKISCKASGYAFTNYWLGWVRQMPGKGLEWMGNFYPGSSNTYYNPSFQGQVTISADKSISTAYLQWSSLKASDTAMYFCARHYGTNYRYFDVWGAGTLVTVSSGKPGSGKPGSGKPGSGKPGSDIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK

SEQ ID NO: 11421 - protein, 120 aa, Artificial Sequence
  Description of Artificial Sequence: Synthetic polypeptide
  VH of XENP020163
EVQLVQSGAEVKKPGESLKISCKASGYAFTNYWLGWVRQMPGKGLEWMGNFYPGSSNTYYNPSFQGQVTISADKSISTAYLQWSSLKASDTAMYFCARHYGTNYRYFDVWGAGTLVTVSS

SEQ ID NO: 11422 - protein, 107 aa, Artificial Sequence; identical to SEQ ID NO: 11413
  Description of Artificial Sequence: Synthetic polypeptide
  VL of XENP020163

SEQ ID NO: 11423 - protein, 5 aa, Artificial Sequence
  Description of Artificial Sequence: Synthetic peptide
  XENP020163 vhCDR1
NYWLG

SEQ ID NO: 11424 - protein, 17 aa, Artificial Sequence
  Description of Artificial Sequence: Synthetic peptide
  XENP020163 vhCDR2
NFYPGSSNTYYNPSFQG

SEQ ID NO: 11425 - protein, 11 aa, Artificial Sequence
  Description of Artificial Sequence: Synthetic peptide
  XENP020163 vhCDR3
HYGTNYRYFDV

SEQ ID NO: 11426 - protein, 11 aa, Artificial Sequence
  Description of Artificial Sequence: Synthetic peptide
  XENP020163 vlCDR1
RASQSVSNDVA

SEQ ID NO: 11427 - protein, 7 aa, Artificial Sequence
  Description of Artificial Sequence: Synthetic peptide
  XENP020163 vlCDR2
YASNRYT

SEQ ID NO: 11428 - protein, 9 aa, Artificial Sequence
  Description of Artificial Sequence: Synthetic peptide
  XENP020163 vlCDR3
QQDYSSPYT

SEQ ID NO: 11429 - protein, 242 aa, Artificial Sequence
  Description of Artificial Sequence: Synthetic polypeptide
  XENP020164 3C11(PD-1)_H1L1_scFv(GKPGS)4
QVQLVQSGAEVKKPGASVKVSCKASGYTFTSYWMHWVRQAPGQGLEWMGAIYPGNIATSYNQKFQGRVTMTADTSTSTAYMELSSLRSEDTAVYYCTTSYVMDYWGQGTLVTVSSGKPGSGKPGSGKPGSGKPGSDIVMTQSPSSLSASVGDRVTITCQASQDINSYLSWFQQKPGKSPKTLIYRANRLVDGVPSRFSGSGSGQDYTFTISSLQPEDIATYYCLQYDEFPYTFGGGTKVEIK

SEQ ID NO: 11430 - protein, 115 aa, Artificial Sequence
  Description of Artificial Sequence: Synthetic polypeptide
  VH of XENP020164
QVQLVQSGAEVKKPGASVKVSCKASGYTFTSYWMHWVRQAPGQGLEWMGAIYPGNIATSYNQKFQGRVTMTADTSTSTAYMELSSLRSEDTAVYYCTTSYVMDYWGQGTLVTVSS

SEQ ID NO: 11431 - protein, 107 aa, Artificial Sequence
  Description of Artificial Sequence: Synthetic polypeptide
  VL of XENP020164
DIVMTQSPSSLSASVGDRVTITCQASQDINSYLSWFQQKPGKSPKTLIYRANRLVDGVPSRFSGSGSGQDYTFTISSLQPEDIATYYCLQYDEFPYTFGGGTKVEIK

SEQ ID NO: 11432 - protein, 5 aa, Artificial Sequence
  Description of Artificial Sequence: Synthetic peptide
  XENP020164 vhCDR1
SYWMH

SEQ ID NO: 11433 - protein, 17 aa, Artificial Sequence
  Description of Artificial Sequence: Synthetic peptide
  XENP020164 vhCDR2
AIYPGNIATSYNQKFQG

SEQ ID NO: 11434 - protein, 6 aa, Artificial Sequence
  Description of Artificial Sequence: Synthetic peptide
  XENP020164 vhCDR3
SYVMDY

SEQ ID NO: 11435 - protein, 11 aa, Artificial Sequence
  Description of Artificial Sequence: Synthetic peptide
  XENP020164 vlCDR1
QASQDINSYLS

SEQ ID NO: 11436 - protein, 7 aa, Artificial Sequence
  Description of Artificial Sequence: Synthetic peptide
  XENP020164 vlCDR2
RANRLVD

SEQ ID NO: 11437 - protein, 9 aa, Artificial Sequence
  Description of Artificial Sequence: Synthetic peptide
  XENP020164 vlCDR3
LQYDEFPYT

SEQ ID NO: 11438 - protein, 239 aa, Artificial Sequence
  Description of Artificial Sequence: Synthetic polypeptide
  XENP020165 3G12_H1L1_scFv(GKPGS)4
QVQLVQSGAEVKKPGASVKVSCKASGYTFTSYWMHWVRQAPGQGLEWMGVIDPSDSYTSYNQKFQGRVTMTVDTSTSTAYMELSSLRSEDTAVYYCTGAYYWGQGTLVTVSSGKPGSGKPGSGKPGSGKPGSDIVLTQSPSSLSASVGDRVTITCRASQGISSNIGWLQQKPGKSFKGLIYHGTNLEDGVPSRFTGSGSGADYTLTISSLQPEDFATYYCVQYAQSPWTFGGGTKVEIK

SEQ ID NO: 11439 - protein, 112 aa, Artificial Sequence
  Description of Artificial Sequence: Synthetic polypeptide
  VH of XENP020165
QVQLVQSGAEVKKPGASVKVSCKASGYTFTSYWMHWVRQAPGQGLEWMGVIDPSDSYTSYNQKFQGRVTMTVDTSTSTAYMELSSLRSEDTAVYYCTGAYYWGQGTLVTVSS

SEQ ID NO: 11440 - protein, 107 aa, Artificial Sequence
  Description of Artificial Sequence: Synthetic polypeptide
  VL of XENP020165
DIVLTQSPSSLSASVGDRVTITCRASQGISSNIGWLQQKPGKSFKGLIYHGTNLEDGVPSRFTGSGSGADYTLTISSLQPEDFATYYCVQYAQSPWTFGGGTKVEIK

SEQ ID NO: 11441 - protein, 5 aa, Artificial Sequence
  Description of Artificial Sequence: Synthetic peptide
  XENP020165 vhCDR1
SYWMH

SEQ ID NO: 11442 - protein, 17 aa, Artificial Sequence
  Description of Artificial Sequence: Synthetic peptide
  XENP020165 vhCDR2
VIDPSDSYTSYNQKFQG

SEQ ID NO: 11443 - protein, 3 aa, Artificial Sequence
  Description of Artificial Sequence: Synthetic peptide
  XENP020165 vhCDR3
AYY

SEQ ID NO: 11444 - protein, 11 aa, Artificial Sequence
  Description of Artificial Sequence: Synthetic peptide
  XENP020165 vlCDR1
RASQGISSNIG

SEQ ID NO: 11445 - protein, 7 aa, Artificial Sequence
  Description of Artificial Sequence: Synthetic peptide
  XENP020165 vlCDR2
HGTNLED

SEQ ID NO: 11446 - protein, 9 aa, Artificial Sequence
  Description of Artificial Sequence: Synthetic peptide
  XENP020165 vlCDR3
VQYAQSPWT

SEQ ID NO: 11447 - protein, 239 aa, Artificial Sequence
  Description of Artificial Sequence: Synthetic polypeptide
  XENP020166 5C4_H1L1_scFv(GKPGS)4
QVQLVQSGAEVKKPGASVKVSCKASGYTFTDYWMHWLRQAPGQGLEWMGAIDTSDSYPTYNQKFQGRVTMTVDDSTSTAYMELSSLRSEDTAVYYCTRFDYWGQGTLVTVSSGKPGSGKPGSGKPGSGKPGSDIVMTQSPDSLAVSLGERATINCKASQSVSNDVAWYQQKPGQSPKLLIYYASNRYTGVPDRFTGSGYGTDFTLTISSLQAEDVAVYFCQQDYSSPYTFGGGTKVEIK

SEQ ID NO: 11448 - protein, 112 aa, Artificial Sequence
  Description of Artificial Sequence: Synthetic polypeptide
  VH of XENP020166
QVQLVQSGAEVKKPGASVKVSCKASGYTFTDYWMHWLRQAPGQGLEWMGAIDTSDSYPTYNQKFQGRVTMTVDDSTSTAYMELSSLRSEDTAVYYCTRFDYWGQGTLVTVSS

SEQ ID NO: 11449 - protein, 107 aa, Artificial Sequence
  Description of Artificial Sequence: Synthetic polypeptide
  VL of XENP020166
DIVMTQSPDSLAVSLGERATINCKASQSVSNDVAWYQQKPGQSPKLLIYYASNRYTGVPDRFTGSGYGTDFTLTISSLQAEDVAVYFCQQDYSSPYTFGGGTKVEIK

SEQ ID NO: 11450 - protein, 5 aa, Artificial Sequence
  Description of Artificial Sequence: Synthetic peptide
  XENP020166 vhCDR1
DYWMH

SEQ ID NO: 11451 - protein, 17 aa, Artificial Sequence
  Description of Artificial Sequence: Synthetic peptide
  XENP020166 vhCDR2
AIDTSDSYPTYNQKFQG

SEQ ID NO: 11452 - protein, 3 aa, Artificial Sequence
  Description of Artificial Sequence: Synthetic peptide
  XENP020166 vhCDR3
FDY

SEQ ID NO: 11453 - protein, 11 aa, Artificial Sequence
  Description of Artificial Sequence: Synthetic peptide
  XENP020166 vlCDR1
KASQSVSNDVA

SEQ ID NO: 11454 - protein, 7 aa, Artificial Sequence
  Description of Artificial Sequence: Synthetic peptide
  XENP020166 vlCDR2
YASNRYT

SEQ ID NO: 11455 - protein, 9 aa, Artificial Sequence
  Description of Artificial Sequence: Synthetic peptide
  XENP020166 vlCDR3
QQDYSSPYT

SEQ ID NO: 11456 - protein, 239 aa, Artificial Sequence
  Description of Artificial Sequence: Synthetic polypeptide
  XENP020167 5C4_H2L1_scFv(GKPGS)4
QVQLVQSGSELKKPGASVKVSCKASGYTFTDYWMHWLRQAPGQGLEWMGAIDTSDSYPTYNQGFTGRFVFSVDDSVSTAYLQISSLKAEDTAVYYCTRFDYWGQGTLVTVSSGKPGSGKPGSGKPGSGKPGSDIVMTQSPDSLAVSLGERATINCKASQSVSNDVAWYQQKPGQSPKLLIYYASNRYTGVPDRFTGSGYGTDFTLTISSLQAEDVAVYFCQQDYSSPYTFGGGTKVEIK

SEQ ID NO: 11457 - protein, 112 aa, Artificial Sequence
  Description of Artificial Sequence: Synthetic polypeptide
  VH of XENP020167
QVQLVQSGSELKKPGASVKVSCKASGYTFTDYWMHWLRQAPGQGLEWMGAIDTSDSYPTYNQGFTGRFVFSVDDSVSTAYLQISSLKAEDTAVYYCTRFDYWGQGTLVTVSS

SEQ ID NO: 11458 - protein, 107 aa, Artificial Sequence; identical to SEQ ID NO: 11449
  Description of Artificial Sequence: Synthetic polypeptide
  VL of XENP020167

SEQ ID NO: 11459 - protein, 5 aa, Artificial Sequence
  Description of Artificial Sequence: Synthetic peptide
  XENP020167 vhCDR1
DYWMH

SEQ ID NO: 11460 - protein, 17 aa, Artificial Sequence
  Description of Artificial Sequence: Synthetic peptide
  XENP020167 vhCDR2
AIDTSDSYPTYNQGFTG

SEQ ID NO: 11461 - protein, 3 aa, Artificial Sequence
  Description of Artificial Sequence: Synthetic peptide
  XENP020167 vhCDR3
FDY

SEQ ID NO: 11462 - protein, 11 aa, Artificial Sequence
  Description of Artificial Sequence: Synthetic peptide
  XENP020167 vlCDR1
KASQSVSNDVA

SEQ ID NO: 11463 - protein, 7 aa, Artificial Sequence
  Description of Artificial Sequence: Synthetic peptide
  XENP020167 vlCDR2
YASNRYT

SEQ ID NO: 11464 - protein, 9 aa, Artificial Sequence
  Description of Artificial Sequence: Synthetic peptide
  XENP020167 vlCDR3
QQDYSSPYT

SEQ ID NO: 11465 - protein, 443 aa, Artificial Sequence
  Description of Artificial Sequence: Synthetic polypeptide
  XENP013810 Nivolumab_H0L0_IgG1 Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11466 - protein, 113 aa, Artificial Sequence [sequence omitted]

SEQ ID NO: 11467 - protein, 5 aa, Artificial Sequence
  Description of Artificial Sequence: Synthetic peptide
  XENP013810 vhCDR1
NSGMH

SEQ ID NO: 11468 - protein, 17 aa, Artificial Sequence
  Description of Artificial Sequence: Synthetic peptide
  XENP013810 vhCDR2
VIWYDGSKRYYADSVKG

SEQ ID NO: 11469 - protein, 4 aa, Artificial Sequence
  Description of Artificial Sequence: Synthetic peptide
  XENP013810 vhCDR3
NDDY

SEQ ID NO: 11470 - protein, 214 aa, Artificial Sequence
  Description of Artificial Sequence: Synthetic polypeptide
  XENP013810 Nivolumab_H0L0_IgG1 Light Chain
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11471 - protein, 107 aa, Artificial Sequence [sequence omitted]

SEQ ID NO: 11472 - protein, 11 aa, Artificial Sequence
  Description of Artificial Sequence: Synthetic peptide
  XENP013810 vlCDR1
RASQSVSSYLA

SEQ ID NO: 11473 - protein, 7 aa, Artificial Sequence
  Description of Artificial Sequence: Synthetic peptide
  XENP013810 vlCDR2
DASNRAT

SEQ ID NO: 11474 - protein, 9 aa, Artificial Sequence
  Description of Artificial Sequence: Synthetic peptide
  XENP013810 vlCDR3
QQSSNWPRT

SEQ ID NO: 11475 - protein, 443 aa, Artificial Sequence
  Description of Artificial Sequence: Synthetic polypeptide
  XENP013960 Nivolumab_H0L0_IgG1_G236R/L328R Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLRGPSVFLFPPKPKDTLMISRTPEVTCVVVDVSHEDPEVKFNWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11476 - protein, 113 aa, Artificial Sequence [sequence omitted]

SEQ ID NO: 11477 - protein, 5 aa, Artificial Sequence
  Description of Artificial Sequence: Synthetic peptide
  XENP013960 vhCDR1
NSGMH

SEQ ID NO: 11478 - protein, 17 aa, Artificial Sequence
  Description of Artificial Sequence: Synthetic peptide
  XENP013960 vhCDR2
VIWYDGSKRYYADSVKG

SEQ ID NO: 11479 - protein, 4 aa, Artificial Sequence
  Description of Artificial Sequence: Synthetic peptide
  XENP013960 vhCDR3
NDDY

SEQ ID NO: 11480 - protein, 214 aa, Artificial Sequence; identical to SEQ ID NO: 11470
  Description of Artificial Sequence: Synthetic polypeptide
  XENP013960 Nivolumab_H0L0_IgG1_G236R/L328R Light Chain

SEQ ID NO: 11481 - protein, 107 aa, Artificial Sequence [sequence omitted]

SEQ ID NO: 11482 - protein, 11 aa, Artificial Sequence
  Description of Artificial Sequence: Synthetic peptide
  XENP013960 vlCDR1
RASQSVSSYLA

SEQ ID NO: 11483 - protein, 7 aa, Artificial Sequence
  Description of Artificial Sequence: Synthetic peptide
  XENP013960 vlCDR2
DASNRAT

SEQ ID NO: 11484 - protein, 9 aa, Artificial Sequence
  Description of Artificial Sequence: Synthetic peptide
  XENP013960 vlCDR3
QQSSNWPRT

SEQ ID NO: 11485 - protein, 442 aa, Artificial Sequence
  Description of Artificial Sequence: Synthetic polypeptide
  XENP016432 Nivolumab_H0L0_IgG1_PVA_/S267K Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11486 - protein, 113 aa, Artificial Sequence [sequence omitted]

SEQ ID NO: 11487 - protein, 5 aa, Artificial Sequence
  Description of Artificial Sequence: Synthetic peptide
  XENP016432 vhCDR1
NSGMH

SEQ ID NO: 11488 - protein, 17 aa, Artificial Sequence
  Description of Artificial Sequence: Synthetic peptide
  XENP016432 vhCDR2
VIWYDGSKRYYADSVKG

SEQ ID NO: 11489 - protein, 4 aa, Artificial Sequence
  Description of Artificial Sequence: Synthetic peptide
  XENP016432 vhCDR3
NDDY

SEQ ID NO: 11490 - protein, 214 aa, Artificial Sequence; identical to SEQ ID NO: 11470
  Description of Artificial Sequence: Synthetic polypeptide
  XENP016432 Nivolumab_H0L0_IgG1_PVA_/S267K Light Chain

SEQ ID NO: 11491 - protein, 107 aa, Artificial Sequence [sequence omitted]

SEQ ID NO: 11492 - protein, 11 aa, Artificial Sequence
  Description of Artificial Sequence: Synthetic peptide
  XENP016432 vlCDR1
RASQSVSSYLA

SEQ ID NO: 11493 - protein, 7 aa, Artificial Sequence
  Description of Artificial Sequence: Synthetic peptide
  XENP016432 vlCDR2
DASNRAT

SEQ ID NO: 11494 - protein, 9 aa, Artificial Sequence
  Description of Artificial Sequence: Synthetic peptide
  XENP016432 vlCDR3
QQSSNWPRT

SEQ ID NO: 11495 - protein, 440 aa, Artificial Sequence
  Description of Artificial Sequence: Synthetic polypeptide
  XENP016602 Nivolumab_H0_IgG4_S228P Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 11496 - protein, 113 aa, Artificial Sequence [sequence omitted]

SEQ ID NO: 11497 - protein, 5 aa, Artificial Sequence
  Description of Artificial Sequence: Synthetic peptide
  XENP016602 vhCDR1
NSGMH

SEQ ID NO: 11498 - protein, 17 aa, Artificial Sequence
  Description of Artificial Sequence: Synthetic peptide
  XENP016602 vhCDR2
VIWYDGSKRYYADSVKG

SEQ ID NO: 11499 - protein, 4 aa, Artificial Sequence
  Description of Artificial Sequence: Synthetic peptide
  XENP016602 vhCDR3
NDDY

SEQ ID NO: 11500 - protein, 214 aa, Artificial Sequence; identical to SEQ ID NO: 11470
  Description of Artificial Sequence: Synthetic polypeptide
  XENP016602 Nivolumab_H0_IgG4_S228P Light Chain

SEQ ID NO: 11501 - protein, 107 aa, Artificial Sequence [sequence omitted]

SEQ ID NO: 11502 - protein, 11 aa, Artificial Sequence
  Description of Artificial Sequence: Synthetic peptide
  XENP016602 vlCDR1
RASQSVSSYLA

SEQ ID NO: 11503 - protein, 7 aa, Artificial Sequence
  Description of Artificial Sequence: Synthetic peptide
  XENP016602 vlCDR2
DASNRAT

SEQ ID NO: 11504 - protein, 9 aa, Artificial Sequence
  Description of Artificial Sequence: Synthetic peptide
  XENP016602 vlCDR3
QQSSNWPRT

SEQ ID NO: 11505 - protein, 447 aa, Artificial Sequence
  Description of Artificial Sequence: Synthetic polypeptide
  XENP016603 Pembrolizumab_H0_IgG4_S228P Heavy Chain
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPSSKSTSGGTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 11506 - protein, 120 aa, Artificial Sequence [sequence omitted]

SEQ ID NO: 11507 - protein, 5 aa, Artificial Sequence
  Description of Artificial Sequence: Synthetic peptide
  XENP016603 vhCDR1
NYYMY

SEQ ID NO: 11508 - protein, 17 aa, Artificial Sequence
  Description of Artificial Sequence: Synthetic peptide
  XENP016603 vhCDR2
GINPSNGGTNFNEKFKN

SEQ ID NO: 11509 - protein, 11 aa, Artificial Sequence
  Description of Artificial Sequence: Synthetic peptide
  XENP016603 vhCDR3
RDYRFDMGFDY

SEQ ID NO: 11510 - protein, 218 aa, Artificial Sequence
  Description of Artificial Sequence: Synthetic polypeptide
  XENP016603 Pembrolizumab_H0_IgG4_S228P Light Chain
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11511 - protein, 111 aa, Artificial Sequence [sequence omitted]

SEQ ID NO: 11512 - protein, 15 aa, Artificial Sequence
  Description of Artificial Sequence: Synthetic peptide
  XENP016603 vlCDR1
RASKGVSTSGYSYLH

SEQ ID NO: 11513 - protein, 7 aa, Artificial Sequence
  Description of Artificial Sequence: Synthetic peptide
  XENP016603 vlCDR2
LASYLES

SEQ ID NO: 11514 - protein, 9 aa, Artificial Sequence
  Description of Artificial Sequence: Synthetic peptide
  XENP016603 vlCDR3
QHSRDLPLT

SEQ ID NO: 11515 - protein, 443 aa, Artificial Sequence
  Description of Artificial Sequence: Synthetic polypeptide
  XENP017903 1A2_H1L1_IgG1_PVA_/S267K Heavy Chain
QIQLVQSGAEVKKPGASVKVSCKASGYTFTDYSMHWVRQAPGQGLEWMGWINTETGEPTYADKFQGRVTMTLDTSTSTAYMELSSLRSEDTAVYFCASSPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11516 - protein, 114 aa, Artificial Sequence; identical to SEQ ID NO: 6219
  Description of Artificial Sequence: Synthetic polypeptide
  VH of XENP017903

SEQ ID NO: 11517 - protein, 5 aa, Artificial Sequence
  Description of Artificial Sequence: Synthetic peptide
  XENP017903 vhCDR1
DYSMH

SEQ ID NO: 11518 - protein, 17 aa, Artificial Sequence
  Description of Artificial Sequence: Synthetic peptide
  XENP017903 vhCDR2
WINTETGEPTYADKFQG

SEQ ID NO: 11519 - protein, 5 aa, Artificial Sequence
  Description of Artificial Sequence: Synthetic peptide
  XENP017903 vhCDR3
SPLDY

SEQ ID NO: 11520 - protein, 219 aa, Artificial Sequence
  Description of Artificial Sequence: Synthetic polypeptide
  XENP017903 1A2_H1L1_IgG1_PVA_/S267K Light Chain
DLLLTQSPLSLPVTPGEPASISCRSSQSIVHSNGNTYLEWFLQKPGQSPQLLIYKVFNRFSGVPDRFSGSGSGTDFTLKISRVEAEDVGVYYCFQGSHVPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11521 - protein, 112 aa, Artificial Sequence; identical to SEQ ID NO: 6220
  Description of Artificial Sequence: Synthetic polypeptide
  VL of XENP017903

SEQ ID NO: 11522 - protein, 16 aa, Artificial Sequence
  Description of Artificial Sequence: Synthetic peptide
  XENP017903 vlCDR1
RSSQSIVHSNGNTYLE

SEQ ID NO: 11523 - protein, 7 aa, Artificial Sequence
  Description of Artificial Sequence: Synthetic peptide
  XENP017903 vlCDR2
KVFNRFS

SEQ ID NO: 11524 - protein, 9 aa, Artificial Sequence
  Description of Artificial Sequence: Synthetic peptide
  XENP017903 vlCDR3
FQGSHVPFT

SEQ ID NO: 11525 - protein, 449 aa, Artificial Sequence
  Description of Artificial Sequence: Synthetic polypeptide
  XENP017904 1C7_H1L1_IgG1_PVA_/S267K Heavy Chain
EVQLLESGGGLVQPGGSLRLSCAASGFAFSSYDMSWVRQAPGKRLEWVSYISSGGGSTYYPDSVKGRFTISRDNSKNTLYLQMNSLRAEDTAVYYCARPLDDYYAPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11526 - protein, 120 aa, Artificial Sequence; identical to SEQ ID NO: 6228
  Description of Artificial Sequence: Synthetic polypeptide
  VH of XENP017904

SEQ ID NO: 11527 - protein, 5 aa, Artificial Sequence
  Description of Artificial Sequence: Synthetic peptide
  XENP017904 vhCDR1
SYDMS

SEQ ID NO: 11528 - protein, 17 aa, Artificial Sequence
  Description of Artificial Sequence: Synthetic peptide
  XENP017904 vhCDR2
YISSGGGSTYYPDSVKG

SEQ ID NO: 11529 - protein, 11 aa, Artificial Sequence
  Description of Artificial Sequence: Synthetic peptide
  XENP017904 vhCDR3
PLDDYYAPFAY

SEQ ID NO: 11530 - protein, 218 aa, Artificial Sequence
  Description of Artificial Sequence: Synthetic polypeptide
  XENP017904 1C7_H1L1_IgG1_PVA_/S267K Light Chain
DIVLTQSPSSLSASVGDRVTITCRASESVDNDGISFMNWFQQKPGKPPKLLIYAASNQGSGVPARFSGSGSGTDFTLTISSLQPEDFATYFCQQSKEVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11531 - protein, 111 aa, Artificial Sequence; identical to SEQ ID NO: 6229
  Description of Artificial Sequence: Synthetic polypeptide
  VL of XENP017904

SEQ ID NO: 11532 - protein, 15 aa, Artificial Sequence
  Description of Artificial Sequence: Synthetic peptide
  XENP017904 vlCDR1
RASESVDNDGISFMN

SEQ ID NO: 11533 - protein, 7 aa, Artificial Sequence
  Description of Artificial Sequence: Synthetic peptide
  XENP017904 vlCDR2
AASNQGS

SEQ ID NO: 11534 - protein, 9 aa, Artificial Sequence
  Description of Artificial Sequence: Synthetic peptide
  XENP017904 vlCDR3
QQSKEVPWT

SEQ ID NO: 11535 - protein, 443 aa, Artificial Sequence
  Description of Artificial Sequence: Synthetic polypeptide
  XENP017905 1G2_H1L1_IgG1_PVA_/S267K Heavy Chain
QVQLVQSGAEVKKPGASVKVSCKVSGFSLTDYGVNWVRQAPGQGLEWMGMIWGDGSTDYNSKFQGRVTMTKDISTSTVYMELSSLRSEDTAVYYCAREYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11536 - protein, 114 aa, Artificial Sequence; identical to SEQ ID NO: 6237
  Description of Artificial Sequence: Synthetic polypeptide
  VH of XENP017905

SEQ ID NO: 11537 - protein, 5 aa, Artificial Sequence
  Description of Artificial Sequence: Synthetic peptide
  XENP017905 vhCDR1
DYGVN

SEQ ID NO: 11538 - protein, 16 aa, Artificial Sequence
  Description of Artificial Sequence: Synthetic peptide
  XENP017905 vhCDR2
MIWGDGSTDYNSKFQG

SEQ ID NO: 11539 - protein, 6 aa, Artificial Sequence
  Description of Artificial Sequence: Synthetic peptide
  XENP017905 vhCDR3
EYAMDY

SEQ ID NO: 11540 - protein, 219 aa, Artificial Sequence
  Description of Artificial Sequence: Synthetic polypeptide
  XENP017905 1G2_H1L1_IgG1_PVA_/S267K Light Chain
DIVMTQSPDSLAVSLGERATINCKSSQSLLNSRTRKNYLAWYQQKPGQSPKLLIFWASTRESGVPDRFTGSGSGTDFTLTISSLQAEDVAVYYCKQSYNLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11541 - protein, 112 aa, Artificial Sequence; identical to SEQ ID NO: 6238
  Description of Artificial Sequence: Synthetic polypeptide
  VL of XENP017905

SEQ ID NO: 11542 - protein, 17 aa, Artificial Sequence
  Description of Artificial Sequence: Synthetic peptide
  XENP017905 vlCDR1
KSSQSLLNSRTRKNYLA

SEQ ID NO: 11543 - protein, 7 aa, Artificial Sequence
  Description of Artificial Sequence: Synthetic peptide
  XENP017905 vlCDR2
WASTRES

SEQ ID NO: 11544 - protein, 8 aa, Artificial Sequence
  Description of Artificial Sequence: Synthetic peptide
  XENP017905 vlCDR3
KQSYNLRT

SEQ ID NO: 11545 - protein, 451 aa, Artificial Sequence
  Description of Artificial Sequence: Synthetic polypeptide
  XENP017906 1G6_H1L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11546 - protein, 122 aa, Artificial Sequence; identical to SEQ ID NO: 6246
  Description of Artificial Sequence: Synthetic polypeptide
  VH of XENP017906

SEQ ID NO: 11547 - protein, 5 aa, Artificial Sequence
  Description of Artificial Sequence: Synthetic peptide
  XENP017906 vhCDR1
NYWMN

SEQ ID NO: 11548 - protein, 19 aa, Artificial Sequence
  Description of Artificial Sequence: Synthetic peptide
  XENP017906 vhCDR2
EIRLKSNNYATHYAEPVKG

SEQ ID NO: 11549 - protein, 11 aa, Artificial Sequence
  Description of Artificial Sequence: Synthetic peptide
  XENP017906 vhCDR3
YYGNYGGYFDV

SEQ ID NO: 11550 - protein, 214 aa, Artificial Sequence
  Description of Artificial Sequence: Synthetic polypeptide
  XENP017906 1G6_H1L1_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11551 - protein, 107 aa, Artificial Sequence; identical to SEQ ID NO: 6247
  Description of Artificial Sequence: Synthetic polypeptide
  VL of XENP017906

SEQ ID NO: 11552 - protein, 11 aa, Artificial Sequence
  Description of Artificial Sequence: Synthetic peptide
  XENP017906 vlCDR1
RASQSVSNDVA

SEQ ID NO: 11553 - protein, 7 aa, Artificial Sequence
  Description of Artificial Sequence: Synthetic peptide
  XENP017906 vlCDR2
YASHRYT

SEQ ID NO: 11554 - protein, 9 aa, Artificial Sequence
  Description of Artificial Sequence: Synthetic peptide
  XENP017906 vlCDR3
QQDYSSPRT

SEQ ID NO: 11555 - protein, 451 aa, Artificial Sequence; identical to SEQ ID NO: 11545
  Description of Artificial Sequence: Synthetic polypeptide
  XENP017907 1G6_H1L2_IgG1_PVA_/S267K Heavy Chain

SEQ ID NO: 11556 - protein, 122 aa, Artificial Sequence; identical to SEQ ID NO: 6246
  Description of Artificial Sequence: Synthetic polypeptide
  VH of XENP017907

SEQ ID NO: 11557 - protein, 5 aa, Artificial Sequence
  Description of Artificial Sequence: Synthetic peptide
  XENP017907 vhCDR1
NYWMN

SEQ ID NO: 11558 - protein, 19 aa, Artificial Sequence
  Description of Artificial Sequence: Synthetic peptide
  XENP017907 vhCDR2
EIRLKSNNYATHYAEPVKG

SEQ ID NO: 11559 - protein, 11 aa, Artificial Sequence
  Description of Artificial Sequence: Synthetic peptide
  XENP017907 vhCDR3
YYGNYGGYFDV

SEQ ID NO: 11560 - protein, 214 aa, Artificial Sequence
  Description of Artificial Sequence: Synthetic polypeptide
  XENP017907 1G6_H1L2_IgG1_PVA_/S267K Light Chain
SIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11561 - protein, 107 aa, Artificial Sequence; identical to SEQ ID NO: 6256
  Description of Artificial Sequence: Synthetic polypeptide
  VL of XENP017907

SEQ ID NO: 11562 - protein, 11 aa, Artificial Sequence
  Description of Artificial Sequence: Synthetic peptide
  XENP017907 vlCDR1
RASQSVSNDVA

SEQ ID NO: 11563 - protein, 7 aa, Artificial Sequence
  Description of Artificial Sequence: Synthetic peptide
  XENP017907 vlCDR2
YASHRYT

SEQ ID NO: 11564 - protein, 9 aa, Artificial Sequence
  Description of Artificial Sequence: Synthetic peptide
  XENP017907 vlCDR3
QQDYSSPRT

SEQ ID NO: 11565 - protein, 444 aa, Artificial Sequence
  Description of Artificial Sequence: Synthetic polypeptide
  XENP017908 2A2_H1L1_IgG1_PVA_/S267K Heavy Chain
QVQLVQSGAEVKKPGASVKVSCKASGYTFTNYWMHWVRQAPGQGLEWMGYINPSTGYTEYNQKFQGRVTMTADKSTSTAYMELSSLRSEDTAVYYCATGNYFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11566 - protein, 115 aa, Artificial Sequence; identical to SEQ ID NO: 6264
  Description of Artificial Sequence: Synthetic polypeptide
  VH of XENP017908

SEQ ID NO: 11567 - protein, 5 aa, Artificial Sequence
  Description of Artificial Sequence: Synthetic peptide
  XENP017908 vhCDR1
NYWMH

SEQ ID NO: 11568 - protein, 17 aa, Artificial Sequence
  Description of Artificial Sequence: Synthetic peptide
  XENP017908 vhCDR2
YINPSTGYTEYNQKFQG

SEQ ID NO: 11569 - protein, 6 aa, Artificial Sequence
  Description of Artificial Sequence: Synthetic peptide
  XENP017908 vhCDR3
GNYFAY

SEQ ID NO: 11570 - protein, 214 aa, Artificial Sequence
  Description of Artificial Sequence: Synthetic polypeptide
  XENP017908 2A2_H1L1_IgG1_PVA_/S267K Light Chain
DIQMTQSPSSLSASVGDRVTITCRPSESLYSYLAWYQQKPGKSPKLLVYNAKTLVEGVPSRFSGSGSGTDFTLTISSLQPEDFATYYCQHHYGTPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11571 - protein, 107 aa, Artificial Sequence; identical to SEQ ID NO: 6265
  Description of Artificial Sequence: Synthetic polypeptide
  VL of XENP017908

SEQ ID NO: 11572 - protein, 11 aa, Artificial Sequence
  Description of Artificial Sequence: Synthetic peptide
  XENP017908 vlCDR1
RPSESLYSYLA

SEQ ID NO: 11573 - protein, 7 aa, Artificial Sequence
  Description of Artificial Sequence: Synthetic peptide
  XENP017908 vlCDR2
NAKTLVE

SEQ ID NO: 11574 - protein, 9 aa, Artificial Sequence
  Description of Artificial Sequence: Synthetic peptide
  XENP017908 vlCDR3
QHHYGTPFT

SEQ ID NO: 11575 - protein, 449 aa, Artificial Sequence
  Description of Artificial Sequence: Synthetic polypeptide
  XENP017909 2F11_H1L1_IgG1_PVA_/S267K Heavy Chain
QVQLVQSGAEVKKPGASVKVSCKGSGYTFTDYVMHWVRQAPGQSLEWMGVISTYYGDASYNQKFQGRVTMTVDKSTSTAYMELSSLRSEDTAVYYCAREGYDGYLYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11576 - protein, 120 aa, Artificial Sequence; identical to SEQ ID NO: 6273
  Description of Artificial Sequence: Synthetic polypeptide
  VH of XENP017909

SEQ ID NO: 11577 - protein, 5 aa, Artificial Sequence
  Description of Artificial Sequence: Synthetic peptide
  XENP017909 vhCDR1
DYVMH

SEQ ID NO: 11578 - protein, 17 aa, Artificial Sequence
  Description of Artificial Sequence: Synthetic peptide
  XENP017909 vhCDR2
VISTYYGDASYNQKFQG

SEQ ID NO: 11579 - protein, 11 aa, Artificial Sequence
  Description of Artificial Sequence: Synthetic peptide
  XENP017909 vhCDR3
EGYDGYLYFDV

SEQ ID NO: 11580 - protein, 219 aa, Artificial Sequence
  Description of Artificial Sequence: Synthetic polypeptide
  XENP017909 2F11_H1L1_IgG1_PVA_/S267K Light Chain
DVLMTQTPLSSPVTLGQPASISCRSSQSIVHSNGNTYLEWYQQRPGQSPRLLIYKVSNRFSGVPDRFSGSGSGTDFTLKISRVEAEDVGVYYCFQGSHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11581 - protein, 112 aa, Artificial Sequence; identical to SEQ ID NO: 6274
  Description of Artificial Sequence: Synthetic polypeptide
  VL of XENP017909

SEQ ID NO: 11582 - protein, 16 aa, Artificial Sequence
  Description of Artificial Sequence: Synthetic peptide
  XENP017909 vlCDR1
RSSQSIVHSNGNTYLE

SEQ ID NO: 11583 - protein, 7 aa, Artificial Sequence
  Description of Artificial Sequence: Synthetic peptide
  XENP017909 vlCDR2
KVSNRFS

SEQ ID NO: 11584 - protein, 9 aa, Artificial Sequence
  Description of Artificial Sequence: Synthetic peptide
  XENP017909 vlCDR3
FQGSHVPYT

SEQ ID NO: 11585 - protein, 449 aa, Artificial Sequence
  Description of Artificial Sequence: Synthetic polypeptide
  XENP017910 5H1_H1L1_IgG1_PVA_/S267K Heavy Chain
QVQLVQSGAEVKKPGASVKVSCKGSGYTFTDYVMHWVRQAPGQSLEWMGVISIHYGDGRYNQKFQGRVTMTVDKSTSTAYMELSSLRSEDTAVYYCAREVYDGYLYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11586 - protein, 120 aa, Artificial Sequence; identical to SEQ ID NO: 6282
  Description of Artificial Sequence: Synthetic polypeptide
  VH of XENP017910

SEQ ID NO: 11587 - protein, 5 aa, Artificial Sequence
  Description of Artificial Sequence: Synthetic peptide
  XENP017910 vhCDR1
DYVMH

SEQ ID NO: 11588 - protein, 17 aa, Artificial Sequence
  Description of Artificial Sequence: Synthetic peptide
  XENP017910 vhCDR2
VISIHYGDGRYNQKFQG

SEQ ID NO: 11589 - protein, 11 aa, Artificial Sequence
  Description of Artificial Sequence: Synthetic peptide
  XENP017910 vhCDR3
EVYDGYLYFDV

SEQ ID NO: 11590 - protein, 219 aa, Artificial Sequence
  Description of Artificial Sequence: Synthetic polypeptide
  XENP017910 5H1_H1L1_IgG1_PVA_/S267K Light Chain
DVLMTQSPLSLPVTPGEPASISCRSSQSIVHSNGNTYLEWYLQKPGQSPQLLIYKVSNRFSGVPDRFGGRGSGTDFTLKISRVEAEDVGVYYCFQGSHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11591 - protein, 112 aa, Artificial Sequence; identical to SEQ ID NO: 6283
  Description of Artificial Sequence: Synthetic polypeptide
  VL of XENP017910

SEQ ID NO: 11592 - protein, 16 aa, Artificial Sequence
  Description of Artificial Sequence: Synthetic peptide
  XENP017910 vlCDR1
RSSQSIVHSNGNTYLE

SEQ ID NO: 11593 - protein, 7 aa, Artificial Sequence
  Description of Artificial Sequence: Synthetic peptide
  XENP017910 vlCDR2
KVSNRFS

SEQ ID NO: 11594 - protein, 9 aa, Artificial Sequence
  Description of Artificial Sequence: Synthetic peptide
  XENP017910 vlCDR3
FQGSHVPYT

SEQ ID NO: 11595 - protein, 449 aa, Artificial Sequence; identical to SEQ ID NO: 11585
  Description of Artificial Sequence: Synthetic polypeptide
  XENP017911 5H1_H1L2_IgG1_PVA_/S267K Heavy Chain

SEQ ID NO: 11596 - protein, 120 aa, Artificial Sequence; identical to SEQ ID NO: 6282
  Description of Artificial Sequence: Synthetic polypeptide
  VH of XENP017911

SEQ ID NO: 11597 - protein, 5 aa, Artificial Sequence
  Description of Artificial Sequence: Synthetic peptide
  XENP017911 vhCDR1
DYVMH

SEQ ID NO: 11598 - protein, 17 aa, Artificial Sequence
  Description of Artificial Sequence: Synthetic peptide
  XENP017911 vhCDR2
VISIHYGDGRYNQKFQG

SEQ ID NO: 11599 - protein, 11 aa, Artificial Sequence
  Description of Artificial Sequence: Synthetic peptide
  XENP017911 vhCDR3
EVYDGYLYFDV

SEQ ID NO: 11600 - protein, 219 aa, Artificial Sequence
  Description of Artificial Sequence: Synthetic polypeptide
  XENP017911 5H1_H1L2_IgG1_PVA_/S267K Light Chain
DVLMTQSPLSLPVTLGQPASISCRSSQSIVHSNGNTYLEWYQQRPGQSPRLLIYKVSNRFSGVPDRFGGRGSGTDFTLKISRVEAEDVGVYYCFQGSHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11601 - protein, 112 aa, Artificial Sequence; identical to SEQ ID NO: 6292
  Description of Artificial Sequence: Synthetic polypeptide
  VL of XENP017911

SEQ ID NO: 11602 - protein, 16 aa, Artificial Sequence
  Description of Artificial Sequence: Synthetic peptide
  XENP017911 vlCDR1
RSSQSIVHSNGNTYLE

SEQ ID NO: 11603 - protein, 7 aa, Artificial Sequence
  Description of Artificial Sequence: Synthetic peptide
  XENP017911 vlCDR2
KVSNRFS

SEQ ID NO: 11604 - protein, 9 aa, Artificial Sequence
  Description of Artificial Sequence: Synthetic peptide
  XENP017911 vlCDR3
FQGSHVPYT

SEQ ID NO: 11605 - protein, 449 aa, Artificial Sequence
  Description of Artificial Sequence: Synthetic polypeptide
  XENP017912 10E4_H1L1_IgG1_PVA_/S267K Heavy Chain
QVQLVQSGAEVKKPGASVKVSCKASGYSFTSYWMHWVRQAPGQGLEWMGAIYPGNSDTSYNQKFQGRVTMTADTSTSTAYMELSSLRSEDTAVYYCTRDGNYVRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11606 - protein, 120 aa, Artificial Sequence; identical to SEQ ID NO: 6300
  Description of Artificial Sequence: Synthetic polypeptide
  VH of XENP017912

SEQ ID NO: 11607 - protein, 5 aa, Artificial Sequence
  Description of Artificial Sequence: Synthetic peptide
  XENP017912 vhCDR1
SYWMH

SEQ ID NO: 11608 - protein, 17 aa, Artificial Sequence
  Description of Artificial Sequence: Synthetic peptide
  XENP017912 vhCDR2
AIYPGNSDTSYNQKFQG

SEQ ID NO: 11609 - protein, 11 aa, Artificial Sequence
  Description of Artificial Sequence: Synthetic peptide
  XENP017912 vhCDR3
DGNYVRYYFDY

SEQ ID NO: 11610 - protein, 214 aa, Artificial Sequence
  Description of Artificial Sequence: Synthetic polypeptide
  XENP017912 10E4_H1L1_IgG1_PVA_/S267K Light Chain
DIQMTQSPSSLSASVGDRVTITCRASQDIGSNLNWLQQKPGKTIKRLIYATSNLDSGVPKRFSGRRSGSDYTLTISSLQPEDFATYYCLQYASSPLTFGTGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11611 - protein, 107 aa, Artificial Sequence; identical to SEQ ID NO: 6301
  Description of Artificial Sequence: Synthetic polypeptide
  VL of XENP017912

SEQ ID NO: 11612 - protein, 11 aa, Artificial Sequence
  Description of Artificial Sequence: Synthetic peptide
  XENP017912 vlCDR1
RASQDIGSNLN

SEQ ID NO: 11613 - protein, 7 aa, Artificial Sequence
  Description of Artificial Sequence: Synthetic peptide
  XENP017912 vlCDR2
ATSNLDS

SEQ ID NO: 11614 - protein, 9 aa, Artificial Sequence
  Description of Artificial Sequence: Synthetic peptide
  XENP017912 vlCDR3
LQYASSPLT

SEQ ID NO: 11615 - protein, 449 aa, Artificial Sequence
  Description of Artificial Sequence: Synthetic polypeptide
  XENP017913 4C11_H1L1_IgG1_PVA_/S267K Heavy Chain
QIQLVQSGAEVKKPGASVKVSCKASGYTFTSYWMHWVRQAPGQGLEWMGAIYPGNSDTSYNQKFQGRVTMTADTSTSTAYMELSSLRSEDTAVYYCTNLYYGSSFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11616 - protein, 120 aa, Artificial Sequence; identical to SEQ ID NO: 6309
  Description of Artificial Sequence: Synthetic polypeptide
  VH of XENP017913

SEQ ID NO: 11617 - protein, 5 aa, Artificial Sequence
  Description of Artificial Sequence: Synthetic peptide
  XENP017913 vhCDR1
SYWMH

SEQ ID NO: 11618 - protein, 17 aa, Artificial Sequence
  Description of Artificial Sequence: Synthetic peptide
  XENP017913 vhCDR2
AIYPGNSDTSYNQKFQG

SEQ ID NO: 11619 - protein, 11 aa, Artificial Sequence
  Description of Artificial Sequence: Synthetic peptide
  XENP017913 vhCDR3
LYYGSSFAMDY

SEQ ID NO: 11620 - protein, 214 aa, Artificial Sequence
  Description of Artificial Sequence: Synthetic polypeptide
  XENP017913 4C11_H1L1_IgG1_PVA_/S267K Light Chain
DIKMTQSPSSLSASVGDRVTITCRASQDINTYLSWFQQKPGKSPKTLIYRANRLVDGVPSRFSGSGSGQDYTLTISSLQPEDFATYYCLHYDDFPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11621 - protein, 107 aa, Artificial Sequence; identical to SEQ ID NO: 6310
  Description of Artificial Sequence: Synthetic polypeptide
  VL of XENP017913

SEQ ID NO: 11622 - protein, 11 aa, Artificial Sequence
  Description of Artificial Sequence: Synthetic peptide
  XENP017913 vlCDR1
RASQDINTYLS

SEQ ID NO: 11623 - protein, 7 aa, Artificial Sequence
  Description of Artificial Sequence: Synthetic peptide
  XENP017913 vlCDR2
RANRLVD

SEQ ID NO: 11624 - protein, 9 aa, Artificial Sequence
  Description of Artificial Sequence: Synthetic peptide
  XENP017913 vlCDR3
LHYDDFPYT

SEQ ID NO: 11625 - protein, 446 aa, Artificial Sequence
  Description of Artificial Sequence: Synthetic polypeptide
  XENP017914 6A3_H1L1_IgG1_PVA_/S267K Heavy Chain
EVQLLESGGGLVQPGGSLRLSCAASGFTFSSYGMSWVRQAPGKRLEWVSTISGGGRYTYYPDSVKGRFTISRDNSKNTLYLQMNSLRAEDTAVYYCASYYDSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11626 - protein, 117 aa, Artificial Sequence; identical to SEQ ID NO: 6318
  Description of Artificial Sequence: Synthetic polypeptide
  VH of XENP017914

SEQ ID NO: 11627 - protein, 5 aa, Artificial Sequence
  Description of Artificial Sequence: Synthetic peptide
  XENP017914 vhCDR1
SYGMS

SEQ ID NO: 11628 - protein, 17 aa, Artificial Sequence
  Description of Artificial Sequence: Synthetic peptide
  XENP017914 vhCDR2
TISGGGRYTYYPDSVKG

SEQ ID NO: 11629 - protein, 8 aa, Artificial Sequence
  Description of Artificial Sequence: Synthetic peptide
  XENP017914 vhCDR3
YYDSSFDY

SEQ ID NO: 11630 - protein, 214 aa, Artificial Sequence
  Description of Artificial Sequence: Synthetic polypeptide
  XENP017914 6A3_H1L1_IgG1_PVA_/S267K Light Chain
DIVMTQSPDSLAVSLGERATINCKASQDVGTAVAWYQQKPGQSPKLLIYWASTRHTGVPDRFTGSGSGTDFTLTISSLQAEDVAVYFCQHYSIYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11631 - protein, 107 aa, Artificial Sequence; identical to SEQ ID NO: 6319
  Description of Artificial Sequence: Synthetic polypeptide
  VL of XENP017914

SEQ ID NO: 11632 - protein, 11 aa, Artificial Sequence
  Description of Artificial Sequence: Synthetic peptide
  XENP017914 vlCDR1
KASQDVGTAVA

SEQ ID NO: 11633 - protein, 7 aa, Artificial Sequence
  Description of Artificial Sequence: Synthetic peptide
  XENP017914 vlCDR2
WASTRHT

SEQ ID NO: 11634 - protein, 9 aa, Artificial Sequence
  Description of Artificial Sequence: Synthetic peptide
  XENP017914 vlCDR3
QHYSIYPWT

SEQ ID NO: 11635 - protein, 446 aa, Artificial Sequence; identical to SEQ ID NO: 11625
  Description of Artificial Sequence: Synthetic polypeptide
  XENP017915 6A3_H1L2_IgG1_PVA_/S267K Heavy Chain

SEQ ID NO: 11636 - protein, 117 aa, Artificial Sequence; identical to SEQ ID NO: 6318
  Description of Artificial Sequence: Synthetic polypeptide
  VH of XENP017915

SEQ ID NO: 11637 - protein, 5 aa, Artificial Sequence
  Description of Artificial Sequence: Synthetic peptide
  XENP017915 vhCDR1
SYGMS

SEQ ID NO: 11638 - protein, 17 aa, Artificial Sequence
  Description of Artificial Sequence: Synthetic peptide
  XENP017915 vhCDR2
TISGGGRYTYYPDSVKG

SEQ ID NO: 11639 - protein, 8 aa, Artificial Sequence
  Description of Artificial Sequence: Synthetic peptide
  XENP017915 vhCDR3
YYDSSFDY

SEQ ID NO: 11640 - protein, 214 aa, Artificial Sequence
  Description of Artificial Sequence: Synthetic polypeptide
  XENP017915 6A3_H1L2_IgG1_PVA_/S267K Light Chain
DIVMTQSPATLSVSPGERATLSCRASQDVGTAVAWYQQKPGQSPRLLIYWASTRHTGVPDRFTGSGSGTEFTLTISSLQSEDFAVYFCQHYSIYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11641 - protein, 107 aa, Artificial Sequence; identical to SEQ ID NO: 6328
  Description of Artificial Sequence: Synthetic polypeptide
  VL of XENP017915

SEQ ID NO: 11642 - protein, 11 aa, Artificial Sequence
  Description of Artificial Sequence: Synthetic peptide
  XENP017915 vlCDR1
RASQDVGTAVA

SEQ ID NO: 11643 - protein, 7 aa, Artificial Sequence
  Description of Artificial Sequence: Synthetic peptide
  XENP017915 vlCDR2
WASTRHT

SEQ ID NO: 11644 - protein, 9 aa, Artificial Sequence
  Description of Artificial Sequence: Synthetic peptide
  XENP017915 vlCDR3
QHYSIYPWT

SEQ ID NO: 11645 - protein, 446 aa, Artificial Sequence; identical to SEQ ID NO: 11625
  Description of Artificial Sequence: Synthetic polypeptide
  XENP017916 6A3_H1L3_IgG1_PVA_/S267K Heavy Chain

SEQ ID NO: 11646 - protein, 117 aa, Artificial Sequence; identical to SEQ ID NO: 6318
  Description of Artificial Sequence: Synthetic polypeptide
  VH of XENP017916

SEQ ID NO: 11647 - protein, 5 aa, Artificial Sequence
  Description of Artificial Sequence: Synthetic peptide
  XENP017916 vhCDR1
SYGMS

SEQ ID NO: 11648 - protein, 17 aa, Artificial Sequence
  Description of Artificial Sequence: Synthetic peptide
  XENP017916 vhCDR2
TISGGGRYTYYPDSVKG

SEQ ID NO: 11649 - protein, 8 aa, Artificial Sequence
  Description of Artificial Sequence: Synthetic peptide
  XENP017916 vhCDR3
YYDSSFDY

SEQ ID NO: 11650 - protein, 214 aa, Artificial Sequence
  Description of Artificial Sequence: Synthetic polypeptide
  XENP017916 6A3_H1L3_IgG1_PVA_/S267K Light Chain
DIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11651 - protein, 107 aa, Artificial Sequence; identical to SEQ ID NO: 6337
  Description of Artificial Sequence: Synthetic polypeptide
  VL of XENP017916

SEQ ID NO: 11652 - protein, 11 aa, Artificial Sequence
  Description of Artificial Sequence: Synthetic peptide
  XENP017916 vlCDR1
RASQDVGTAVA

SEQ ID NO: 11653 - protein, 7 aa, Artificial Sequence
  Description of Artificial Sequence: Synthetic peptide
  XENP017916 vlCDR2
WASTRHT

SEQ ID NO: 11654 - protein, 9 aa, Artificial Sequence
  Description of Artificial Sequence: Synthetic peptide
  XENP017916 vlCDR3
QHYSIYPWT

SEQ ID NO: 11655 - protein, 446 aa, Artificial Sequence
  Description of Artificial Sequence: Synthetic polypeptide
  XENP017917 6A3_H2L3_IgG1_PVA_/S267K Heavy Chain
EVQLLESGGGLVQPGGSLRLSCAASGFTFSSYGMSWVRQAPGKGLEWVSTISGGGRYTYYPDSVKGRFTISRDNSKNTLYLQMNSLRAEDTAVYYCASYYDSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11656 - protein, 117 aa, Artificial Sequence; identical to SEQ ID NO: 6354
  Description of Artificial Sequence: Synthetic polypeptide
  VH of XENP017917

SEQ ID NO: 11657 - protein, 5 aa, Artificial Sequence
  Description of Artificial Sequence: Synthetic peptide
  XENP017917 vhCDR1
SYGMS

SEQ ID NO: 11658 - protein, 17 aa, Artificial Sequence
  Description of Artificial Sequence: Synthetic peptide
  XENP017917 vhCDR2
TISGGGRYTYYPDSVKG

SEQ ID NO: 11659 - protein, 8 aa, Artificial Sequence
  Description of Artificial Sequence: Synthetic peptide
  XENP017917 vhCDR3
YYDSSFDY

SEQ ID NO: 11660 - protein, 214 aa, Artificial Sequence; identical to SEQ ID NO: 11650
  Description of Artificial Sequence: Synthetic polypeptide
  XENP017917 6A3_H2L3_IgG1_PVA_/S267K Light Chain

SEQ ID NO: 11661 - protein, 107 aa, Artificial Sequence; identical to SEQ ID NO: 6337
  Description of Artificial Sequence: Synthetic polypeptide
  VL of XENP017917

SEQ ID NO: 11662 - protein, 11 aa, Artificial Sequence
  Description of Artificial Sequence: Synthetic peptide
  XENP017917 vlCDR1
RASQDVGTAVA

SEQ ID NO: 11663 - protein, 7 aa, Artificial Sequence
  Description of Artificial Sequence: Synthetic peptide
  XENP017917 vlCDR2
WASTRHT

SEQ ID NO: 11664 - protein, 9 aa, Artificial Sequence
  Description of Artificial Sequence: Synthetic peptide
  XENP017917 vlCDR3
QHYSIYPWT

SEQ ID NO: 11665 - protein, 446 aa, Artificial Sequence
  Description of Artificial Sequence: Synthetic polypeptide
  XENP017918 6A3_H1.1_L3_IgG1_PVA_/S267K Heavy Chain
QVQLVESGGGLVKPGGSLRLSCAASGFTFSSYGMSWVRQAPGKRLEWVSTISGGGRYTYYPDSVKGRFTISRDNAKNSLYLQMNSLRAEDTAVYYCASYYDSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11666 - protein, 117 aa, Artificial Sequence; identical to SEQ ID NO: 6345
  Description of Artificial Sequence: Synthetic polypeptide
  VH of XENP017918

SEQ ID NO: 11667 - protein, 5 aa, Artificial Sequence
  Description of Artificial Sequence: Synthetic peptide
  XENP017918 vhCDR1
SYGMS

SEQ ID NO: 11668 - protein, 17 aa, Artificial Sequence
  Description of Artificial Sequence: Synthetic peptide
  XENP017918 vhCDR2
TISGGGRYTYYPDSVKG

SEQ ID NO: 11669 - protein, 8 aa, Artificial Sequence
  Description of Artificial Sequence: Synthetic peptide
  XENP017918 vhCDR3
YYDSSFDY

SEQ ID NO: 11670 - protein, 214 aa, Artificial Sequence; identical to SEQ ID NO: 11650
  Description of Artificial Sequence: Synthetic polypeptide
  XENP017918 6A3_H1.1_L3_IgG1_PVA_/S267K Light Chain

SEQ ID NO: 11671 - protein, 107 aa, Artificial Sequence; identical to SEQ ID NO: 6337
  Description of Artificial Sequence: Synthetic polypeptide
  VL of XENP017918

SEQ ID NO: 11672 - protein, 11 aa, Artificial Sequence
  Description of Artificial Sequence: Synthetic peptide
  XENP017918 vlCDR1
RASQDVGTAVA

SEQ ID NO: 11673 - protein, 7 aa, Artificial Sequence
  Description of Artificial Sequence: Synthetic peptide
  XENP017918 vlCDR2
WASTRHT

SEQ ID NO: 11674 - protein, 9 aa, Artificial Sequence
  Description of Artificial Sequence: Synthetic peptide
  XENP017918 vlCDR3
QHYSIYPWT

SEQ ID NO: 11675 - protein, 451 aa, Artificial Sequence
  Description of Artificial Sequence: Synthetic polypeptide
  XENP018089 H1M7789N_H0L0_IgG1 Heavy Chain
EVQLLESGGGLVQPGGSLRLSCSASGFTFSSYTMNWVRQAPGKGLEWVSGISDTGGNTYYTDSVKGRFTVSRDNSKNTLSLQMNSLRAEDTAVYYCAKDQGGSYPYYFHYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11676 - protein, 121 aa, Artificial Sequence
  Description of Artificial Sequence: Synthetic polypeptide
  VH of XENP018089
EVQLLESGGGLVQPGGSLRLSCSASGFTFSSYTMNWVRQAPGKGLEWVSGISDTGGNTYYTDSVKGRFTVSRDNSKNTLSLQMNSLRAEDTAVYYCAKDQGGSYPYYFHYWGQGSLVTVSS

SEQ ID NO: 11677 - protein, 5 aa, Artificial Sequence
  Description of Artificial Sequence: Synthetic peptide
  XENP018089 vhCDR1
SYTMN

SEQ ID NO: 11678 - protein, 17 aa, Artificial Sequence
  Description of Artificial Sequence: Synthetic peptide
  XENP018089 vhCDR2
GISDTGGNTYYTDSVKG

SEQ ID NO: 11679 - protein, 12 aa, Artificial Sequence
  Description of Artificial Sequence: Synthetic peptide
  XENP018089 vhCDR3
DQGGSYPYYFHY

SEQ ID NO: 11680 - protein, 215 aa, Artificial Sequence
  Description of Artificial Sequence: Synthetic polypeptide
  XENP018089 H1M7789N_H0L0_IgG1 Light Chain
DIQMTQSPSSLSASVGDRVTITCRASQSISSYLIWYQQKPGTAPKFLIYAASSLQSGVPSRFSGSGSGTDFTLTISSLQPEDFATYYCQQSYSTPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11681 - protein, 108 aa, Artificial Sequence
  Description of Artificial Sequence: Synthetic polypeptide
  VL of XENP018089
DIQMTQSPSSLSASVGDRVTITCRASQSISSYLIWYQQKPGTAPKFLIYAASSLQSGVPSRFSGSGSGTDFTLTISSLQPEDFATYYCQQSYSTPPITFGQGTRLEIK

SEQ ID NO: 11682 - protein, 11 aa, Artificial Sequence
  Description of Artificial Sequence: Synthetic peptide
  XENP018089 vlCDR1
RASQSISSYLI

SEQ ID NO: 11683 - protein, 7 aa, Artificial Sequence
  Description of Artificial Sequence: Synthetic peptide
  XENP018089 vlCDR2
AASSLQS

SEQ ID NO: 11684 - protein, 10 aa, Artificial Sequence
  Description of Artificial Sequence: Synthetic peptide
  XENP018089 vlCDR3
QQSYSTPPIT

SEQ ID NO: 11685 - protein, 446 aa, Artificial Sequence
  Description of Artificial Sequence: Synthetic polypeptide
  XENP018090 H2aM7791N_H0L0_IgG1 Heavy Chain
QMQLQQWGAGLLKPSETLSLTCVVYGGSLNGYYWSWIRQSPGKGLEWIGEIDHSGSTNYNPSLKNRVTMSVDTSKIQFSLKLTSVTVADTAVYYCAREGLLPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11686 - protein, 116 aa, Artificial Sequence
  Description of Artificial Sequence: Synthetic polypeptide
  VH of XENP018090
QMQLQQWGAGLLKPSETLSLTCVVYGGSLNGYYWSWIRQSPGKGLEWIGEIDHSGSTNYNPSLKNRVTMSVDTSKIQFSLKLTSVTVADTAVYYCAREGLLPFDYWGQGTLVTVSS

SEQ ID NO: 11687 - protein, 5 aa, Artificial Sequence
  Description of Artificial Sequence: Synthetic peptide
  XENP018090 vhCDR1
GYYWS

SEQ ID NO: 11688 - protein, 16 aa, Artificial Sequence
  Description of Artificial Sequence: Synthetic peptide
  XENP018090 vhCDR2
EIDHSGSTNYNPSLKN

SEQ ID NO: 11689 - protein, 8 aa, Artificial Sequence
  Description of Artificial Sequence: Synthetic peptide
  XENP018090 vhCDR3
EGLLPFDY

SEQ ID NO: 11690 - protein, 215 aa, Artificial Sequence
  Description of Artificial Sequence: Synthetic polypeptide
  XENP018090 H2aM7791N_H0L0_IgG1 Light Chain
EIVLTQSPGTLSLSPGERVTLSCRASQSVYSNYLAWYQQNPGQAPRLLIYAASNRATGIPDRFSGSGSGTDFTLTISRLEPEDFAVYYCHQYATSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11691 - protein, 108 aa, Artificial Sequence
  Description of Artificial Sequence: Synthetic polypeptide
  VL of XENP018090
EIVLTQSPGTLSLSPGERVTLSCRASQSVYSNYLAWYQQNPGQAPRLLIYAASNRATGIPDRFSGSGSGTDFTLTISRLEPEDFAVYYCHQYATSPWTFGQGTKVEIK

SEQ ID NO: 11692 - protein, 12 aa, Artificial Sequence
  Description of Artificial Sequence: Synthetic peptide
  XENP018090 vlCDR1
RASQSVYSNYLA

SEQ ID NO: 11693 - protein, 7 aa, Artificial Sequence
  Description of Artificial Sequence: Synthetic peptide
  XENP018090 vlCDR2
AASNRAT

SEQ ID NO: 11694 - protein, 9 aa, Artificial Sequence
  Description of Artificial Sequence: Synthetic peptide
  XENP018090 vlCDR3
HQYATSPWT

SEQ ID NO: 11695 - protein, 446 aa, Artificial Sequence
  Description of Artificial Sequence: Synthetic polypeptide
  XENP018091 H2aM7796N_H0L0_IgG1 Heavy Chain
QVQLVESGGGVVQPGRSLRLSCAASGFTFSSYGMHWVRQAPGKGLEWVAIIWSDGDSEYNLDSVKGRFTISRDNSKNTLYLQMNSLRVEDSAVYYCARDRDLEDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11696 - protein, 116 aa, Artificial Sequence
  Description of Artificial Sequence: Synthetic polypeptide
  VH of XENP018091
QVQLVESGGGVVQPGRSLRLSCAASGFTFSSYGMHWVRQAPGKGLEWVAIIWSDGDSEYNLDSVKGRFTISRDNSKNTLYLQMNSLRVEDSAVYYCARDRDLEDIWGQGTMVTVSS

SEQ ID NO: 11697 - protein, 5 aa, Artificial Sequence
  Description of Artificial Sequence: Synthetic peptide
  XENP018091 vhCDR1
SYGMH

SEQ ID NO: 11698 - protein, 17 aa, Artificial Sequence
  Description of Artificial Sequence: Synthetic peptide
  XENP018091 vhCDR2
IIWSDGDSEYNLDSVKG

SEQ ID NO: 11699 - protein, 7 aa, Artificial Sequence
  Description of Artificial Sequence: Synthetic peptide
  XENP018091 vhCDR3
DRDLEDI

SEQ ID NO: 11700 - protein, 214 aa, Artificial Sequence
  Description of Artificial Sequence: Synthetic polypeptide
  XENP018091 H2aM7796N_H0L0_IgG1 Light Chain
DIQMTQSPSSLSASVGDRVTITCRASQGIRNDLGWYQQKPGKAPKRLIYAASNLQSGVPSRFSGSGSGTEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11701 - protein, 107 aa, Artificial Sequence
  Description of Artificial Sequence: Synthetic polypeptide
  VL of XENP018091
DIQMTQSPSSLSASVGDRVTITCRASQGIRNDLGWYQQKPGKAPKRLIYAASNLQSGVPSRFSGSGSGTEFTLTISSLQPEDFATYYCLQHNSYPLTFGGGTKVEIK

SEQ ID NO: 11702 - protein, 11 aa, Artificial Sequence
  Description of Artificial Sequence: Synthetic peptide
  XENP018091 vlCDR1
RASQGIRNDLG

SEQ ID NO: 11703 - protein, 7 aa, Artificial Sequence
  Description of Artificial Sequence: Synthetic peptide
  XENP018091 vlCDR2
AASNLQS

SEQ ID NO: 11704 - protein, 9 aa, Artificial Sequence
  Description of Artificial Sequence: Synthetic peptide
  XENP018091 vlCDR3
LQHNSYPLT

SEQ ID NO: 11705 - protein, 451 aa, Artificial Sequence
  Description of Artificial Sequence: Synthetic polypeptide
  XENP018092 H4H9057P2_H0L0_IgG1 Heavy Chain
EVQLVESGGGLVQSGRSLRLSCAASGFTFDDYAMHWVRQPPGKGLEWVSGINWNRGRTGYADSVKGRFTISRDNAKNSLYLQMNDLRVEDTALYYCAKAEQWLDEGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11706 - protein, 121 aa, Artificial Sequence
  Description of Artificial Sequence: Synthetic polypeptide
  VH of XENP018092
EVQLVESGGGLVQSGRSLRLSCAASGFTFDDYAMHWVRQPPGKGLEWVSGINWNRGRTGYADSVKGRFTISRDNAKNSLYLQMNDLRVEDTALYYCAKAEQWLDEGYFDYWGQGTLVTVSS

SEQ ID NO: 11707 - protein, 5 aa, Artificial Sequence
  Description of Artificial Sequence: Synthetic peptide
  XENP018092 vhCDR1
DYAMH

SEQ ID NO: 11708 - protein, 17 aa, Artificial Sequence
  Description of Artificial Sequence: Synthetic peptide
  XENP018092 vhCDR2
GINWNRGRTGYADSVKG

SEQ ID NO: 11709 - protein, 12 aa, Artificial Sequence
  Description of Artificial Sequence: Synthetic peptide
  XENP018092 vhCDR3
AEQWLDEGYFDY

SEQ ID NO: 11710 - protein, 215 aa, Artificial Sequence
  Description of Artificial Sequence: Synthetic polypeptide
  XENP018092 H4H9057P2_H0L0_IgG1 Light Chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11711 - protein, 108 aa, Artificial Sequence
  Description of Artificial Sequence: Synthetic polypeptide
  VL of XENP018092
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIK

SEQ ID NO: 11712 - protein, 11 aa, Artificial Sequence
  Description of Artificial Sequence: Synthetic peptide
  XENP018092 vlCDR1
RASQSISSYLN

SEQ ID NO: 11713 - protein, 7 aa, Artificial Sequence
  Description of Artificial Sequence: Synthetic peptide
  XENP018092 vlCDR2
AASSLQS

SEQ ID NO: 11714 - protein, 10 aa, Artificial Sequence
  Description of Artificial Sequence: Synthetic peptide
  XENP018092 vlCDR3
QQSYSTPPIT

SEQ ID NO: 11715 - protein, 451 aa, Artificial Sequence
  Description of Artificial Sequence: Synthetic polypeptide
  XENP018093 H4H9068P2_H0L0_IgG1 Heavy Chain
EVQLVESGGGLVQPGGSLRLSCAASGFSFSSYAMNWVRQAPGKGLEWVSTISDSGGSTYYADSVKGRFTISRDNSKNTLSLQMNSLRAEDTAVYYCAKDQGGSYPYYFHYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11716 - protein, 121 aa, Artificial Sequence
  Description of Artificial Sequence: Synthetic polypeptide
  VH of XENP018093
EVQLVESGGGLVQPGGSLRLSCAASGFSFSSYAMNWVRQAPGKGLEWVSTISDSGGSTYYADSVKGRFTISRDNSKNTLSLQMNSLRAEDTAVYYCAKDQGGSYPYYFHYWGQGTLVTVSS

SEQ ID NO: 11717 - protein, 5 aa, Artificial Sequence
  Description of Artificial Sequence: Synthetic peptide
  XENP018093 vhCDR1
SYAMN

SEQ ID NO: 11718 - protein, 17 aa, Artificial Sequence
  Description of Artificial Sequence: Synthetic peptide
  XENP018093 vhCDR2
TISDSGGSTYYADSVKG

SEQ ID NO: 11719 - protein, 12 aa, Artificial Sequence
  Description of Artificial Sequence: Synthetic peptide
  XENP018093 vhCDR3
DQGGSYPYYFHY

SEQ ID NO: 11720 - protein, 215 aa, Artificial Sequence; identical to SEQ ID NO: 11710
  Description of Artificial Sequence: Synthetic polypeptide
  XENP018093 H4H9068P2_H0L0_IgG1 Light Chain

SEQ ID NO: 11721 - protein, 108 aa, Artificial Sequence; identical to SEQ ID NO: 11711
  Description of Artificial Sequence: Synthetic polypeptide
  VL of XENP018093

SEQ ID NO: 11722 - protein, 11 aa, Artificial Sequence
  Description of Artificial Sequence: Synthetic peptide
  XENP018093 vlCDR1
RASQSISSYLN

SEQ ID NO: 11723 - protein, 7 aa, Artificial Sequence
  Description of Artificial Sequence: Synthetic peptide
  XENP018093 vlCDR2
AASSLQS

SEQ ID NO: 11724 - protein, 10 aa, Artificial Sequence
  Description of Artificial Sequence: Synthetic peptide
  XENP018093 vlCDR3
QQSYSTPPIT

SEQ ID NO: 11725 - protein, 451 aa, Artificial Sequence
  Description of Artificial Sequence: Synthetic polypeptide
  XENP018094 1G6_H1.1_L1_IgG1_PVA_/S267K Heavy Chain
QVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11726 - protein, 122 aa, Artificial Sequence; identical to SEQ ID NO: 6363
  Description of Artificial Sequence: Synthetic polypeptide
  VH of XENP018094

SEQ ID NO: 11727 - protein, 5 aa, Artificial Sequence
  Description of Artificial Sequence: Synthetic peptide
  XENP018094 vhCDR1
NYWMN

SEQ ID NO: 11728 - protein, 19 aa, Artificial Sequence
  Description of Artificial Sequence: Synthetic peptide
  XENP018094 vhCDR2
EIRLKSNNYATHYAEPVKG

SEQ ID NO: 11729 - protein, 11 aa, Artificial Sequence
  Description of Artificial Sequence: Synthetic peptide
  XENP018094 vhCDR3
YYGNYGGYFDV

SEQ ID NO: 11730 - protein, 214 aa, Artificial Sequence; identical to SEQ ID NO: 11550
  Description of Artificial Sequence: Synthetic polypeptide
  XENP018094 1G6_H1.1_L1_IgG1_PVA_/S267K Light Chain

SEQ ID NO: 11731 - protein, 107 aa, Artificial Sequence; identical to SEQ ID NO: 6247
  Description of Artificial Sequence: Synthetic polypeptide
  VL of XENP018094

SEQ ID NO: 11732 - protein, 11 aa, Artificial Sequence
  Description of Artificial Sequence: Synthetic peptide
  XENP018094 vlCDR1
RASQSVSNDVA

SEQ ID NO: 11733 - protein, 7 aa, Artificial Sequence
  Description of Artificial Sequence: Synthetic peptide
  XENP018094 vlCDR2
YASHRYT

SEQ ID NO: 11734 - protein, 9 aa, Artificial Sequence
  Description of Artificial Sequence: Synthetic peptide
  XENP018094 vlCDR3
QQDYSSPRT

SEQ ID NO: 11735 - protein, 451 aa, Artificial Sequence
  Description of Artificial Sequence: Synthetic polypeptide
  XENP018095 1G6_H1.2_L1_IgG1_PVA_/S267K Heavy Chain
EVKLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11736 - protein, 122 aa, Artificial Sequence; identical to SEQ ID NO: 6372
  Description of Artificial Sequence: Synthetic polypeptide
  VH of XENP018095

SEQ ID NO: 11737 - protein, 5 aa, Artificial Sequence
  Description of Artificial Sequence: Synthetic peptide
  XENP018095 vhCDR1
NYWMN

SEQ ID NO: 11738 - protein, 19 aa, Artificial Sequence
  Description of Artificial Sequence: Synthetic peptide
  XENP018095 vhCDR2
EIRLKSNNYATHYAEPVKG

SEQ ID NO: 11739 - protein, 11 aa, Artificial Sequence
  Description of Artificial Sequence: Synthetic peptide
  XENP018095 vhCDR3
YYGNYGGYFDV

SEQ ID NO: 11740 - protein, 214 aa, Artificial Sequence; identical to SEQ ID NO: 11550
  Description of Artificial Sequence: Synthetic polypeptide
  XENP018095 1G6_H1.2_L1_IgG1_PVA_/S267K Light Chain

SEQ ID NO: 11741 - protein, 107 aa, Artificial Sequence; identical to SEQ ID NO: 6247
  Description of Artificial Sequence: Synthetic polypeptide
  VL of XENP018095

SEQ ID NO: 11742 - protein, 11 aa, Artificial Sequence
  Description of Artificial Sequence: Synthetic peptide
  XENP018095 vlCDR1
RASQSVSNDVA

SEQ ID NO: 11743 - protein, 7 aa, Artificial Sequence
  Description of Artificial Sequence: Synthetic peptide
  XENP018095 vlCDR2
YASHRYT

SEQ ID NO: 11744 - protein, 9 aa, Artificial Sequence
  Description of Artificial Sequence: Synthetic peptide
  XENP018095 vlCDR3
QQDYSSPRT

SEQ ID NO: 11745 - protein, 451 aa, Artificial Sequence
  Description of Artificial Sequence: Synthetic polypeptide
  XENP018096 1G6_H1.3_L1_IgG1_PVA_/S267K Heavy Chain
EVQLEESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11746 - protein, 122 aa, Artificial Sequence; identical to SEQ ID NO: 6381
  Description of Artificial Sequence: Synthetic polypeptide
  VH of XENP018096

SEQ ID NO: 11747 - protein, 5 aa, Artificial Sequence
  Description of Artificial Sequence: Synthetic peptide
  XENP018096 vhCDR1
NYWMN

SEQ ID NO: 11748 - protein, 19 aa, Artificial Sequence
  Description of Artificial Sequence: Synthetic peptide
  XENP018096 vhCDR2
EIRLKSNNYATHYAEPVKG

SEQ ID NO: 11749 - protein, 11 aa, Artificial Sequence
  Description of Artificial Sequence: Synthetic peptide
  XENP018096 vhCDR3
YYGNYGGYFDV

SEQ ID NO: 11750 - protein, 214 aa, Artificial Sequence; identical to SEQ ID NO: 11550
  Description of Artificial Sequence: Synthetic polypeptide
  XENP018096 1G6_H1.3_L1_IgG1_PVA_/S267K Light Chain

SEQ ID NO: 11751 - protein, 107 aa, Artificial Sequence; identical to SEQ ID NO: 6247
  Description of Artificial Sequence: Synthetic polypeptide
  VL of XENP018096

SEQ ID NO: 11752 - protein, 11 aa, Artificial Sequence
  Description of Artificial Sequence: Synthetic peptide
  XENP018096 vlCDR1
RASQSVSNDVA

SEQ ID NO: 11753 - protein, 7 aa, Artificial Sequence
  Description of Artificial Sequence: Synthetic peptide
  XENP018096 vlCDR2
YASHRYT

SEQ ID NO: 11754 - protein, 9 aa, Artificial Sequence
  Description of Artificial Sequence: Synthetic peptide
  XENP018096 vlCDR3
QQDYSSPRT

SEQ ID NO: 11755 - protein, 451 aa, Artificial Sequence
  Description of Artificial Sequence: Synthetic polypeptide
  XENP018101 1G6_H1.4_L1_IgG1_PVA_/S267K Heavy Chain
EVQLVESGGGLVQPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11756 - protein, 122 aa, Artificial Sequence; identical to SEQ ID NO: 6390
  Description of Artificial Sequence: Synthetic polypeptide
  VH of XENP018101

SEQ ID NO: 11757 - protein, 5 aa, Artificial Sequence
  Description of Artificial Sequence: Synthetic peptide
  XENP018101 vhCDR1
NYWMN

SEQ ID NO: 11758 - protein, 19 aa, Artificial Sequence
  Description of Artificial Sequence: Synthetic peptide
  XENP018101 vhCDR2
EIRLKSNNYATHYAEPVKG

SEQ ID NO: 11759 - protein, 11 aa, Artificial Sequence
  Description of Artificial Sequence: Synthetic peptide
  XENP018101 vhCDR3
YYGNYGGYFDV

SEQ ID NO: 11760 - protein, 214 aa, Artificial Sequence; identical to SEQ ID NO: 11550
  Description of Artificial Sequence: Synthetic polypeptide
  XENP018101 1G6_H1.4_L1_IgG1_PVA_/S267K Light Chain

SEQ ID NO: 11761 - protein, 107 aa, Artificial Sequence; identical to SEQ ID NO: 6247
  Description of Artificial Sequence: Synthetic polypeptide
  VL of XENP018101

SEQ ID NO: 11762 - protein, 11 aa, Artificial Sequence
  Description of Artificial Sequence: Synthetic peptide
  XENP018101 vlCDR1
RASQSVSNDVA

SEQ ID NO: 11763 - protein, 7 aa, Artificial Sequence
  Description of Artificial Sequence: Synthetic peptide
  XENP018101 vlCDR2
YASHRYT

SEQ ID NO: 11764 - protein, 9 aa, Artificial Sequence
  Description of Artificial Sequence: Synthetic peptide
  XENP018101 vlCDR3
QQDYSSPRT

SEQ ID NO: 11765 - protein, 451 aa, Artificial Sequence
  Description of Artificial Sequence: Synthetic polypeptide
  XENP018102 1G6_H1.5_L1_IgG1_PVA_/S267K Heavy Chain
EVQLVESGGGLVRPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11766 - protein, 122 aa, Artificial Sequence; identical to SEQ ID NO: 6399
  Description of Artificial Sequence: Synthetic polypeptide
  VH of XENP018102

SEQ ID NO: 11767 - protein, 5 aa, Artificial Sequence
  Description of Artificial Sequence: Synthetic peptide
  XENP018102 vhCDR1
NYWMN

SEQ ID NO: 11768 - protein, 19 aa, Artificial Sequence
  Description of Artificial Sequence: Synthetic peptide
  XENP018102 vhCDR2
EIRLKSNNYATHYAEPVKG

SEQ ID NO: 11769 - protein, 11 aa, Artificial Sequence
  Description of Artificial Sequence: Synthetic peptide
  XENP018102 vhCDR3
YYGNYGGYFDV

SEQ ID NO: 11770 - protein, 214 aa, Artificial Sequence; identical to SEQ ID NO: 11550
  Description of Artificial Sequence: Synthetic polypeptide
  XENP018102 1G6_H1.5_L1_IgG1_PVA_/S267K Light Chain

SEQ ID NO: 11771 - protein, 107 aa, Artificial Sequence; identical to SEQ ID NO: 6247
  Description of Artificial Sequence: Synthetic polypeptide
  VL of XENP018102

SEQ ID NO: 11772 - protein, 11 aa, Artificial Sequence
  Description of Artificial Sequence: Synthetic peptide
  XENP018102 vlCDR1
RASQSVSNDVA

SEQ ID NO: 11773 - protein, 7 aa, Artificial Sequence
  Description of Artificial Sequence: Synthetic peptide
  XENP018102 vlCDR2
YASHRYT

SEQ ID NO: 11774 - protein, 9 aa, Artificial Sequence
  Description of Artificial Sequence: Synthetic peptide
  XENP018102 vlCDR3
QQDYSSPRT

SEQ ID NO: 11775 - protein, 451 aa, Artificial Sequence
  Description of Artificial Sequence: Synthetic polypeptide
  XENP018103 1G6_H1.6_L1_IgG1_PVA_/S267K Heavy Chain
EVQLVESGGGLVKPGGSMRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11776 - protein, 122 aa, Artificial Sequence; identical to SEQ ID NO: 6408
  Description of Artificial Sequence: Synthetic polypeptide
  VH of XENP018103

SEQ ID NO: 11777 - protein, 5 aa, Artificial Sequence
  Description of Artificial Sequence: Synthetic peptide
  XENP018103 vhCDR1
NYWMN

SEQ ID NO: 11778 - protein, 19 aa, Artificial Sequence
  Description of Artificial Sequence: Synthetic peptide
  XENP018103 vhCDR2
EIRLKSNNYATHYAEPVKG

SEQ ID NO: 11779 - protein, 11 aa, Artificial Sequence
  Description of Artificial Sequence: Synthetic peptide
  XENP018103 vhCDR3
YYGNYGGYFDV

SEQ ID NO: 11780 - protein, 214 aa, Artificial Sequence; identical to SEQ ID NO: 11550
  Description of Artificial Sequence: Synthetic polypeptide
  XENP018103 1G6_H1.6_L1_IgG1_PVA_/S267K Light Chain

SEQ ID NO: 11781 - protein, 107 aa, Artificial Sequence; identical to SEQ ID NO: 6247
  Description of Artificial Sequence: Synthetic polypeptide
  VL of XENP018103

SEQ ID NO: 11782 - protein, 11 aa, Artificial Sequence
  Description of Artificial Sequence: Synthetic peptide
  XENP018103 vlCDR1
RASQSVSNDVA

SEQ ID NO: 11783 - protein, 7 aa, Artificial Sequence
  Description of Artificial Sequence: Synthetic peptide
  XENP018103 vlCDR2
YASHRYT

SEQ ID NO: 11784 - protein, 9 aa, Artificial Sequence
  Description of Artificial Sequence: Synthetic peptide
  XENP018103 vlCDR3
QQDYSSPRT

SEQ ID NO: 11785 - protein, 451 aa, Artificial Sequence
  Description of Artificial Sequence: Synthetic polypeptide
  XENP018104 1G6_H1.7_L1_IgG1_PVA_/S267K Heavy Chain
EVQLVESGGGLVKPGGSLKLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11786 - protein, 122 aa, Artificial Sequence; identical to SEQ ID NO: 6417
  Description of Artificial Sequence: Synthetic polypeptide
  VH of XENP018104

SEQ ID NO: 11787 - protein, 5 aa, Artificial Sequence
  Description of Artificial Sequence: Synthetic peptide
  XENP018104 vhCDR1
NYWMN

SEQ ID NO: 11788 - protein, 19 aa, Artificial Sequence
  Description of Artificial Sequence: Synthetic peptide
  XENP018104 vhCDR2
EIRLKSNNYATHYAEPVKG

SEQ ID NO: 11789 - protein, 11 aa, Artificial Sequence
  Description of Artificial Sequence: Synthetic peptide
  XENP018104 vhCDR3
YYGNYGGYFDV

SEQ ID NO: 11790 - protein, 214 aa, Artificial Sequence; identical to SEQ ID NO: 11550
  Description of Artificial Sequence: Synthetic polypeptide
  XENP018104 1G6_H1.7_L1_IgG1_PVA_/S267K Light Chain

SEQ ID NO: 11791 - protein, 107 aa, Artificial Sequence; identical to SEQ ID NO: 6247
  Description of Artificial Sequence: Synthetic polypeptide
  VL of XENP018104

SEQ ID NO: 11792 - protein, 11 aa, Artificial Sequence
  Description of Artificial Sequence: Synthetic peptide
  XENP018104 vlCDR1
RASQSVSNDVA

SEQ ID NO: 11793 - protein, 7 aa, Artificial Sequence
  Description of Artificial Sequence: Synthetic peptide
  XENP018104 vlCDR2
YASHRYT

SEQ ID NO: 11794 - protein, 9 aa, Artificial Sequence
  Description of Artificial Sequence: Synthetic peptide
  XENP018104 vlCDR3
QQDYSSPRT

SEQ ID NO: 11795 - protein, 451 aa, Artificial Sequence
  Description of Artificial Sequence: Synthetic polypeptide
  XENP018105 1G6_H1.8_L1_IgG1_PVA_/S267K Heavy Chain
EVQLVESGGGLVKPGGSLRLSCVASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11796 - protein, 122 aa, Artificial Sequence; identical to SEQ ID NO: 6426
  Description of Artificial Sequence: Synthetic polypeptide
  VH of XENP018105

SEQ ID NO: 11797 - protein, 5 aa, Artificial Sequence
  Description of Artificial Sequence: Synthetic peptide
  XENP018105 vhCDR1
NYWMN

SEQ ID NO: 11798 - protein, 19 aa, Artificial Sequence
  Description of Artificial Sequence: Synthetic peptide
  XENP018105 vhCDR2
EIRLKSNNYATHYAEPVKG

SEQ ID NO: 11799 - protein, 11 aa, Artificial Sequence
  Description of Artificial Sequence: Synthetic peptide
  XENP018105 vhCDR3
YYGNYGGYFDV

SEQ ID NO: 11800 - protein, 214 aa, Artificial Sequence; identical to SEQ ID NO: 11550
  Description of Artificial Sequence: Synthetic polypeptide
  XENP018105 1G6_H1.8_L1_IgG1_PVA_/S267K Light Chain

SEQ ID NO: 11801 - protein, 107 aa, Artificial Sequence; identical to SEQ ID NO: 6247
  Description of Artificial Sequence: Synthetic polypeptide
  VL of XENP018105

SEQ ID NO: 11802 - protein, 11 aa, Artificial Sequence
  Description of Artificial Sequence: Synthetic peptide
  XENP018105 vlCDR1
RASQSVSNDVA

SEQ ID NO: 11803 - protein, 7 aa, Artificial Sequence
  Description of Artificial Sequence: Synthetic peptide
  XENP018105 vlCDR2
YASHRYT

SEQ ID NO: 11804 - protein, 9 aa, Artificial Sequence
  Description of Artificial Sequence: Synthetic peptide
  XENP018105 vlCDR3
QQDYSSPRT

SEQ ID NO: 11805 - protein, 451 aa, Artificial Sequence
  Description of Artificial Sequence: Synthetic polypeptide
  XENP018106 1G6_H1.9_L1_IgG1_PVA_/S267K Heavy Chain
EVQLVESGGGLVKPGGSLRLSCAASGFTVSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11806 - protein, 122 aa, Artificial Sequence; identical to SEQ ID NO: 6435
  Description of Artificial Sequence: Synthetic polypeptide
  VH of XENP018106

SEQ ID NO: 11807 - protein, 5 aa, Artificial Sequence
  Description of Artificial Sequence: Synthetic peptide
  XENP018106 vhCDR1
NYWMN

SEQ ID NO: 11808 - protein, 19 aa, Artificial Sequence
  Description of Artificial Sequence: Synthetic peptide
  XENP018106 vhCDR2
EIRLKSNNYATHYAEPVKG

SEQ ID NO: 11809 - protein, 11 aa, Artificial Sequence
  Description of Artificial Sequence: Synthetic peptide
  XENP018106 vhCDR3
YYGNYGGYFDV

SEQ ID NO: 11810 - protein, 214 aa, Artificial Sequence; identical to SEQ ID NO: 11550
  Description of Artificial Sequence: Synthetic polypeptide
  XENP018106 1G6_H1.9_L1_IgG1_PVA_/S267K Light Chain

SEQ ID NO: 11811 - protein, 107 aa, Artificial Sequence; identical to SEQ ID NO: 6247
  Description of Artificial Sequence: Synthetic polypeptide
  VL of XENP018106

SEQ ID NO: 11812 - protein, 11 aa, Artificial Sequence
  Description of Artificial Sequence: Synthetic peptide
  XENP018106 vlCDR1
RASQSVSNDVA

SEQ ID NO: 11813 - protein, 7 aa, Artificial Sequence
  Description of Artificial Sequence: Synthetic peptide
  XENP018106 vlCDR2
YASHRYT

SEQ ID NO: 11814 - protein, 9 aa, Artificial Sequence
  Description of Artificial Sequence: Synthetic peptide
  XENP018106 vlCDR3
QQDYSSPRT

SEQ ID NO: 11815 - protein, 451 aa, Artificial Sequence
  Description of Artificial Sequence: Synthetic polypeptide
  XENP018107 1G6_H1.10_L1_IgG1_PVA_/S267K Heavy Chain
EVQLVESGGGLVKPGGSLRLSCAASGFTFTNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11816 - protein, 122 aa, Artificial Sequence; identical to SEQ ID NO: 6444
  Description of Artificial Sequence: Synthetic polypeptide
  VH of XENP018107

SEQ ID NO: 11817 - protein, 5 aa, Artificial Sequence
  Description of Artificial Sequence: Synthetic peptide
  XENP018107 vhCDR1
NYWMN

SEQ ID NO: 11818 - protein, 19 aa, Artificial Sequence
  Description of Artificial Sequence: Synthetic peptide
  XENP018107 vhCDR2
EIRLKSNNYATHYAEPVKG

SEQ ID NO: 11819 - protein, 11 aa, Artificial Sequence
  Description of Artificial Sequence: Synthetic peptide
  XENP018107 vhCDR3
YYGNYGGYFDV

SEQ ID NO: 11820 - protein, 214 aa, Artificial Sequence; identical to SEQ ID NO: 11550
  Description of Artificial Sequence: Synthetic polypeptide
  XENP018107 1G6_H1.10_L1_IgG1_PVA_/S267K Light Chain

SEQ ID NO: 11821 - protein, 107 aa, Artificial Sequence; identical to SEQ ID NO: 6247
  Description of Artificial Sequence: Synthetic polypeptide
  VL of XENP018107

SEQ ID NO: 11822 - protein, 11 aa, Artificial Sequence
  Description of Artificial Sequence: Synthetic peptide
  XENP018107 vlCDR1
RASQSVSNDVA

SEQ ID NO: 11823 - protein, 7 aa, Artificial Sequence
  Description of Artificial Sequence: Synthetic peptide
  XENP018107 vlCDR2
YASHRYT

SEQ ID NO: 11824 - protein, 9 aa, Artificial Sequence
  Description of Artificial Sequence: Synthetic peptide
  XENP018107 vlCDR3
QQDYSSPRT

SEQ ID NO: 11825 - protein, 451 aa, Artificial Sequence
  Description of Artificial Sequence: Synthetic polypeptide
  XENP018108 1G6_H1.11_L1_IgG1_PVA_/S267K Heavy Chain
EVQLVESGGGLVKPGGSLRLSCAASGFTFANYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11826 - protein, 122 aa, Artificial Sequence; identical to SEQ ID NO: 6453
  Description of Artificial Sequence: Synthetic polypeptide
  VH of XENP018108

SEQ ID NO: 11827 - protein, 5 aa, Artificial Sequence
  Description of Artificial Sequence: Synthetic peptide
  XENP018108 vhCDR1
NYWMN

SEQ ID NO: 11828 - protein, 19 aa, Artificial Sequence
  Description of Artificial Sequence: Synthetic peptide
  XENP018108 vhCDR2
EIRLKSNNYATHYAEPVKG

SEQ ID NO: 11829 - protein, 11 aa, Artificial Sequence
  Description of Artificial Sequence: Synthetic peptide
  XENP018108 vhCDR3
YYGNYGGYFDV

SEQ ID NO: 11830 - protein, 214 aa, Artificial Sequence; identical to SEQ ID NO: 11550
  Description of Artificial Sequence: Synthetic polypeptide
  XENP018108 1G6_H1.11_L1_IgG1_PVA_/S267K Light Chain

SEQ ID NO: 11831 - protein, 107 aa, Artificial Sequence; identical to SEQ ID NO: 6247
  Description of Artificial Sequence: Synthetic polypeptide
  VL of XENP018108

SEQ ID NO: 11832 - protein, 11 aa, Artificial Sequence
  Description of Artificial Sequence: Synthetic peptide
  XENP018108 vlCDR1
RASQSVSNDVA

SEQ ID NO: 11833 - protein, 7 aa, Artificial Sequence
  Description of Artificial Sequence: Synthetic peptide
  XENP018108 vlCDR2
YASHRYT

SEQ ID NO: 11834 - protein, 9 aa, Artificial Sequence
  Description of Artificial Sequence: Synthetic peptide
  XENP018108 vlCDR3
QQDYSSPRT

SEQ ID NO: 11835 - protein, 451 aa, Artificial Sequence
  Description of Artificial Sequence: Synthetic polypeptide
  XENP018109 1G6_H1.12_L1_IgG1_PVA_/S267K Heavy Chain
EVQLVESGGGLVKPGGSLRLSCAASGFTFQNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11836 - protein, 122 aa, Artificial Sequence; identical to SEQ ID NO: 6462
  Description of Artificial Sequence: Synthetic polypeptide
  VH of XENP018109

SEQ ID NO: 11837 - protein, 5 aa, Artificial Sequence
  Description of Artificial Sequence: Synthetic peptide
  XENP018109 vhCDR1
NYWMN

SEQ ID NO: 11838 - protein, 19 aa, Artificial Sequence
  Description of Artificial Sequence: Synthetic peptide
  XENP018109 vhCDR2
EIRLKSNNYATHYAEPVKG

SEQ ID NO: 11839 - protein, 11 aa, Artificial Sequence
  Description of Artificial Sequence: Synthetic peptide
  XENP018109 vhCDR3
YYGNYGGYFDV

SEQ ID NO: 11840 - protein, 214 aa, Artificial Sequence; identical to SEQ ID NO: 11550
  Description of Artificial Sequence: Synthetic polypeptide
  XENP018109 1G6_H1.12_L1_IgG1_PVA_/S267K Light Chain

SEQ ID NO: 11841 - protein, 107 aa, Artificial Sequence; identical to SEQ ID NO: 6247
  Description of Artificial Sequence: Synthetic polypeptide
  VL of XENP018109

SEQ ID NO: 11842 - protein, 11 aa, Artificial Sequence
  Description of Artificial Sequence: Synthetic peptide
  XENP018109 vlCDR1
RASQSVSNDVA

SEQ ID NO: 11843 - protein, 7 aa, Artificial Sequence
  Description of Artificial Sequence: Synthetic peptide
  XENP018109 vlCDR2
YASHRYT

SEQ ID NO: 11844 - protein, 9 aa, Artificial Sequence
  Description of Artificial Sequence: Synthetic peptide
  XENP018109 vlCDR3
QQDYSSPRT

SEQ ID NO: 11845 - protein, 451 aa, Artificial Sequence
  Description of Artificial Sequence: Synthetic polypeptide
  XENP018110 1G6_H1.13_L1_IgG1_PVA_/S267K Heavy Chain
EVQLVESGGGLVKPGGSLRLSCAASGFTFGNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11846 - protein, 122 aa, Artificial Sequence; identical to SEQ ID NO: 6471
  Description of Artificial Sequence: Synthetic polypeptide
  VH of XENP018110

SEQ ID NO: 11847 - protein, 5 aa, Artificial Sequence
  Description of Artificial Sequence: Synthetic peptide
  XENP018110 vhCDR1
NYWMN

SEQ ID NO: 11848 - protein, 19 aa, Artificial Sequence
  Description of Artificial Sequence: Synthetic peptide
  XENP018110 vhCDR2
EIRLKSNNYATHYAEPVKG

SEQ ID NO: 11849 - protein, 11 aa, Artificial Sequence
  Description of Artificial Sequence: Synthetic peptide
  XENP018110 vhCDR3
YYGNYGGYFDV

SEQ ID NO: 11850 - protein, 214 aa, Artificial Sequence; identical to SEQ ID NO: 11550
  Description of Artificial Sequence: Synthetic polypeptide
  XENP018110 1G6_H1.13_L1_IgG1_PVA_/S267K Light Chain

SEQ ID NO: 11851 - protein, 107 aa, Artificial Sequence; identical to SEQ ID NO: 6247
  Description of Artificial Sequence: Synthetic polypeptide
  VL of XENP018110

SEQ ID NO: 11852 - protein, 11 aa, Artificial Sequence
  Description of Artificial Sequence: Synthetic peptide
  XENP018110 vlCDR1
RASQSVSNDVA

SEQ ID NO: 11853 - protein, 7 aa, Artificial Sequence
  Description of Artificial Sequence: Synthetic peptide
  XENP018110 vlCDR2
YASHRYT

SEQ ID NO: 11854 - protein, 9 aa, Artificial Sequence
  Description of Artificial Sequence: Synthetic peptide
  XENP018110 vlCDR3
QQDYSSPRT

SEQ ID NO: 11855 - protein, 451 aa, Artificial Sequence
  Description of Artificial Sequence: Synthetic polypeptide
  XENP018111 1G6_H1.14_L1_IgG1_PVA_/S267K Heavy Chain
EVQLVESGGGLVKPGGSLRLSCAASGFTFVNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11856 - protein, 122 aa, Artificial Sequence; identical to SEQ ID NO: 6480
  Description of Artificial Sequence: Synthetic polypeptide
  VH of XENP018111

SEQ ID NO: 11857 - protein, 5 aa, Artificial Sequence
  Description of Artificial Sequence: Synthetic peptide
  XENP018111 vhCDR1
NYWMN

SEQ ID NO: 11858 - protein, 19 aa, Artificial Sequence
  Description of Artificial Sequence: Synthetic peptide
  XENP018111 vhCDR2
EIRLKSNNYATHYAEPVKG

SEQ ID NO: 11859 - protein, 11 aa, Artificial Sequence
  Description of Artificial Sequence: Synthetic peptide
  XENP018111 vhCDR3
YYGNYGGYFDV

SEQ ID NO: 11860 - protein, 214 aa, Artificial Sequence; identical to SEQ ID NO: 11550
  Description of Artificial Sequence: Synthetic polypeptide
  XENP018111 1G6_H1.14_L1_IgG1_PVA_/S267K Light Chain

SEQ ID NO: 11861 - protein, 107 aa, Artificial Sequence; identical to SEQ ID NO: 6247
  Description of Artificial Sequence: Synthetic polypeptide
  VL of XENP018111

SEQ ID NO: 11862 - protein, 11 aa, Artificial Sequence
  Description of Artificial Sequence: Synthetic peptide
  XENP018111 vlCDR1
RASQSVSNDVA

SEQ ID NO: 11863 - protein, 7 aa, Artificial Sequence
  Description of Artificial Sequence: Synthetic peptide
  XENP018111 vlCDR2
YASHRYT

SEQ ID NO: 11864 - protein, 9 aa, Artificial Sequence
  Description of Artificial Sequence: Synthetic peptide
  XENP018111 vlCDR3
QQDYSSPRT

SEQ ID NO: 11865 - protein, 451 aa, Artificial Sequence
  Description of Artificial Sequence: Synthetic polypeptide
  XENP018112 1G6_H1.15_L1_IgG1_PVA_/S267K Heavy Chain
EVQLVESGGGLVKPGGSLRLSCAASGFTFHNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11866 - protein, 122 aa, Artificial Sequence; identical to SEQ ID NO: 6489
  Description of Artificial Sequence: Synthetic polypeptide
  VH of XENP018112

SEQ ID NO: 11867 - protein, 5 aa, Artificial Sequence
  Description of Artificial Sequence: Synthetic peptide
  XENP018112 vhCDR1
NYWMN

SEQ ID NO: 11868 - protein, 19 aa, Artificial Sequence
  Description of Artificial Sequence: Synthetic peptide
  XENP018112 vhCDR2
EIRLKSNNYATHYAEPVKG

SEQ ID NO: 11869 - protein, 11 aa, Artificial Sequence
  Description of Artificial Sequence: Synthetic peptide
  XENP018112 vhCDR3
YYGNYGGYFDV

SEQ ID NO: 11870 - protein, 214 aa, Artificial Sequence; identical to SEQ ID NO: 11550
  Description of Artificial Sequence: Synthetic polypeptide
  XENP018112 1G6_H1.15_L1_IgG1_PVA_/S267K Light Chain

SEQ ID NO: 11871 - protein, 107 aa, Artificial Sequence; identical to SEQ ID NO: 6247
  Description of Artificial Sequence: Synthetic polypeptide
  VL of XENP018112

SEQ ID NO: 11872 - protein, 11 aa, Artificial Sequence
  Description of Artificial Sequence: Synthetic peptide
  XENP018112 vlCDR1
RASQSVSNDVA

SEQ ID NO: 11873 - protein, 7 aa, Artificial Sequence
  Description of Artificial Sequence: Synthetic peptide
  XENP018112 vlCDR2
YASHRYT

SEQ ID NO: 11874 - protein, 9 aa, Artificial Sequence
  Description of Artificial Sequence: Synthetic peptide
  XENP018112 vlCDR3
QQDYSSPRT

SEQ ID NO: 11875 - protein, 451 aa, Artificial Sequence
  Description of Artificial Sequence: Synthetic polypeptide
  XENP018113 1G6_H1.16_L1_IgG1_PVA_/S267K Heavy Chain
EVQLVESGGGLVKPGGSLRLSCAASGFTFDNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11876 - protein, 122 aa, Artificial Sequence; identical to SEQ ID NO: 6498
  Description of Artificial Sequence: Synthetic polypeptide
  VH of XENP018113

SEQ ID NO: 11877 - protein, 5 aa, Artificial Sequence
  Description of Artificial Sequence: Synthetic peptide
  XENP018113 vhCDR1
NYWMN

SEQ ID NO: 11878 - protein, 19 aa, Artificial Sequence
  Description of Artificial Sequence: Synthetic peptide
  XENP018113 vhCDR2
EIRLKSNNYATHYAEPVKG

SEQ ID NO: 11879 - protein, 11 aa, Artificial Sequence
  Description of Artificial Sequence: Synthetic peptide
  XENP018113 vhCDR3
YYGNYGGYFDV

SEQ ID NO: 11880 - protein, 214 aa, Artificial Sequence; identical to SEQ ID NO: 11550
  Description of Artificial Sequence: Synthetic polypeptide
  XENP018113 1G6_H1.16_L1_IgG1_PVA_/S267K Light Chain

SEQ ID NO: 11881 - protein, 107 aa, Artificial Sequence; identical to SEQ ID NO: 6247
  Description of Artificial Sequence: Synthetic polypeptide
  VL of XENP018113

SEQ ID NO: 11882 - protein, 11 aa, Artificial Sequence
  Description of Artificial Sequence: Synthetic peptide
  XENP018113 vlCDR1
RASQSVSNDVA

SEQ ID NO: 11883 - protein, 7 aa, Artificial Sequence
  Description of Artificial Sequence: Synthetic peptide
  XENP018113 vlCDR2
YASHRYT

SEQ ID NO: 11884 - protein, 9 aa, Artificial Sequence
  Description of Artificial Sequence: Synthetic peptide
  XENP018113 vlCDR3
QQDYSSPRT

SEQ ID NO: 11885 - protein, 451 aa, Artificial Sequence
  Description of Artificial Sequence: Synthetic polypeptide
  XENP018114 1G6_H1.17_L1_IgG1_PVA_/S267K Heavy Chain
EVQLVESGGGLVKPGGSLRLSCAASGFTFKNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11886 - protein, 122 aa, Artificial Sequence; identical to SEQ ID NO: 6507
  Description of Artificial Sequence: Synthetic polypeptide
  VH of XENP018114

SEQ ID NO: 11887 - protein, 5 aa, Artificial Sequence
  Description of Artificial Sequence: Synthetic peptide
  XENP018114 vhCDR1
NYWMN

SEQ ID NO: 11888 - protein, 19 aa, Artificial Sequence
  Description of Artificial Sequence: Synthetic peptide
  XENP018114 vhCDR2
EIRLKSNNYATHYAEPVKG

SEQ ID NO: 11889 - protein, 11 aa, Artificial Sequence
  Description of Artificial Sequence: Synthetic peptide
  XENP018114 vhCDR3
YYGNYGGYFDV

SEQ ID NO: 11890 - protein, 214 aa, Artificial Sequence; identical to SEQ ID NO: 11550
  Description of Artificial Sequence: Synthetic polypeptide
  XENP018114 1G6_H1.17_L1_IgG1_PVA_/S267K Light Chain

SEQ ID NO: 11891 - protein, 107 aa, Artificial Sequence; identical to SEQ ID NO: 6247
  Description of Artificial Sequence: Synthetic polypeptide
  VL of XENP018114

SEQ ID NO: 11892 - protein, 11 aa, Artificial Sequence
  Description of Artificial Sequence: Synthetic peptide
  XENP018114 vlCDR1
RASQSVSNDVA

SEQ ID NO: 11893 - protein, 7 aa, Artificial Sequence
  Description of Artificial Sequence: Synthetic peptide
  XENP018114 vlCDR2
YASHRYT

SEQ ID NO: 11894 - protein, 9 aa, Artificial Sequence
  Description of Artificial Sequence: Synthetic peptide
  XENP018114 vlCDR3
QQDYSSPRT

SEQ ID NO: 11895 - protein, 451 aa, Artificial Sequence
  Description of Artificial Sequence: Synthetic polypeptide
  XENP018115 1G6_H1.18_L1_IgG1_PVA_/S267K Heavy Chain
EVQLVESGGGLVKPGGSLRLSCAASGFTFYNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11896 - protein, 122 aa, Artificial Sequence; identical to SEQ ID NO: 6516
  Description of Artificial Sequence: Synthetic polypeptide
  VH of XENP018115

SEQ ID NO: 11897 - protein, 5 aa, Artificial Sequence
  Description of Artificial Sequence: Synthetic peptide
  XENP018115 vhCDR1
NYWMN

SEQ ID NO: 11898 - protein, 19 aa, Artificial Sequence
  Description of Artificial Sequence: Synthetic peptide
  XENP018115 vhCDR2
EIRLKSNNYATHYAEPVKG

SEQ ID NO: 11899 - protein, 11 aa, Artificial Sequence
  Description of Artificial Sequence: Synthetic peptide
  XENP018115 vhCDR3
YYGNYGGYFDV

SEQ ID NO: 11900 - protein, 214 aa, Artificial Sequence; identical to SEQ ID NO: 11550
  Description of Artificial Sequence: Synthetic polypeptide
  XENP018115 1G6_H1.18_L1_IgG1_PVA_/S267K Light Chain

SEQ ID NO: 11901 - protein, 107 aa, Artificial Sequence; identical to SEQ ID NO: 6247
  Description of Artificial Sequence: Synthetic polypeptide
  VL of XENP018115

SEQ ID NO: 11902 - protein, 11 aa, Artificial Sequence
  Description of Artificial Sequence: Synthetic peptide
  XENP018115 vlCDR1
RASQSVSNDVA

SEQ ID NO: 11903 - protein, 7 aa, Artificial Sequence
  Description of Artificial Sequence: Synthetic peptide
  XENP018115 vlCDR2
YASHRYT

SEQ ID NO: 11904 - protein, 9 aa, Artificial Sequence
  Description of Artificial Sequence: Synthetic peptide
  XENP018115 vlCDR3
QQDYSSPRT

SEQ ID NO: 11905 - protein, 451 aa, Artificial Sequence
  Description of Artificial Sequence: Synthetic polypeptide
  XENP018116 1G6_H1.19_L1_IgG1_PVA_/S267K Heavy Chain
EVQLVESGGGLVKPGGSLRLSCAASGFTFSDYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11906 - protein, 122 aa, Artificial Sequence; identical to SEQ ID NO: 6525
  Description of Artificial Sequence: Synthetic polypeptide
  VH of XENP018116

SEQ ID NO: 11907 - protein, 5 aa, Artificial Sequence
  Description of Artificial Sequence: Synthetic peptide
  XENP018116 vhCDR1
DYWMN

SEQ ID NO: 11908 - protein, 19 aa, Artificial Sequence
  Description of Artificial Sequence: Synthetic peptide
  XENP018116 vhCDR2
EIRLKSNNYATHYAEPVKG

SEQ ID NO: 11909 - protein, 11 aa, Artificial Sequence
  Description of Artificial Sequence: Synthetic peptide
  XENP018116 vhCDR3
YYGNYGGYFDV

SEQ ID NO: 11910 - protein, 214 aa, Artificial Sequence; identical to SEQ ID NO: 11550
  Description of Artificial Sequence: Synthetic polypeptide
  XENP018116 1G6_H1.19_L1_IgG1_PVA_/S267K Light Chain

SEQ ID NO: 11911 - protein, 107 aa, Artificial Sequence; identical to SEQ ID NO: 6247
  Description of Artificial Sequence: Synthetic polypeptide
  VL of XENP018116

SEQ ID NO: 11912 - protein, 11 aa, Artificial Sequence
  Description of Artificial Sequence: Synthetic peptide
  XENP018116 vlCDR1
RASQSVSNDVA

SEQ ID NO: 11913 - protein, 7 aa, Artificial Sequence
  Description of Artificial Sequence: Synthetic peptide
  XENP018116 vlCDR2
YASHRYT

SEQ ID NO: 11914 - protein, 9 aa, Artificial Sequence
  Description of Artificial Sequence: Synthetic peptide
  XENP018116 vlCDR3
QQDYSSPRT

SEQ ID NO: 11915 - protein, 451 aa, Artificial Sequence
  Description of Artificial Sequence: Synthetic polypeptide
  XENP018117 1G6_H1.20_L1_IgG1_PVA_/S267K Heavy Chain
EVQLVESGGGLVKPGGSLRLSCAASGFTFSHYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11916 - protein, 122 aa, Artificial Sequence; identical to SEQ ID NO: 6534
  Description of Artificial Sequence: Synthetic polypeptide
  VH of XENP018117

SEQ ID NO: 11917 - protein, 5 aa, Artificial Sequence
  Description of Artificial Sequence: Synthetic peptide
  XENP018117 vhCDR1
HYWMN

SEQ ID NO: 11918 - protein, 19 aa, Artificial Sequence
  Description of Artificial Sequence: Synthetic peptide
  XENP018117 vhCDR2
EIRLKSNNYATHYAEPVKG

SEQ ID NO: 11919 - protein, 11 aa, Artificial Sequence
  Description of Artificial Sequence: Synthetic peptide
  XENP018117 vhCDR3
YYGNYGGYFDV

SEQ ID NO: 11920 - protein, 214 aa, Artificial Sequence; identical to SEQ ID NO: 11550
  Description of Artificial Sequence: Synthetic polypeptide
  XENP018117 1G6_H1.20_L1_IgG1_PVA_/S267K Light Chain

SEQ ID NO: 11921 - protein, 107 aa, Artificial Sequence; identical to SEQ ID NO: 6247
  Description of Artificial Sequence: Synthetic polypeptide
  VL of XENP018117

SEQ ID NO: 11922 - protein, 11 aa, Artificial Sequence
  Description of Artificial Sequence: Synthetic peptide
  XENP018117 vlCDR1
RASQSVSNDVA

SEQ ID NO: 11923 - protein, 7 aa, Artificial Sequence
  Description of Artificial Sequence: Synthetic peptide
  XENP018117 vlCDR2
YASHRYT

SEQ ID NO: 11924 - protein, 9 aa, Artificial Sequence
  Description of Artificial Sequence: Synthetic peptide
  XENP018117 vlCDR3
QQDYSSPRT

SEQ ID NO: 11925 - protein, 451 aa, Artificial Sequence
  Description of Artificial Sequence: Synthetic polypeptide
  XENP018118 1G6_H1.21_L1_IgG1_PVA_/S267K Heavy Chain
EVQLVESGGGLVKPGGSLRLSCAASGFTFSEYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11926 - protein, 122 aa, Artificial Sequence; identical to SEQ ID NO: 6543
  Description of Artificial Sequence: Synthetic polypeptide
  VH of XENP018118

SEQ ID NO: 11927 - protein, 5 aa, Artificial Sequence
  Description of Artificial Sequence: Synthetic peptide
  XENP018118 vhCDR1
EYWMN

SEQ ID NO: 11928 - protein, 19 aa, Artificial Sequence
  Description of Artificial Sequence: Synthetic peptide
  XENP018118 vhCDR2
EIRLKSNNYATHYAEPVKG

SEQ ID NO: 11929 - protein, 11 aa, Artificial Sequence
  Description of Artificial Sequence: Synthetic peptide
  XENP018118 vhCDR3
YYGNYGGYFDV

SEQ ID NO: 11930 - protein, 214 aa, Artificial Sequence; identical to SEQ ID NO: 11550
  Description of Artificial Sequence: Synthetic polypeptide
  XENP018118 1G6_H1.21_L1_IgG1_PVA_/S267K Light Chain

SEQ ID NO: 11931 - protein, 107 aa, Artificial Sequence; identical to SEQ ID NO: 6247
  Description of Artificial Sequence: Synthetic polypeptide
  VL of XENP018118

SEQ ID NO: 11932 - protein, 11 aa, Artificial Sequence
  Description of Artificial Sequence: Synthetic peptide
  XENP018118 vlCDR1
RASQSVSNDVA

SEQ ID NO: 11933 - protein, 7 aa, Artificial Sequence
  Description of Artificial Sequence: Synthetic peptide
  XENP018118 vlCDR2
YASHRYT

SEQ ID NO: 11934 - protein, 9 aa, Artificial Sequence
  Description of Artificial Sequence: Synthetic peptide
  XENP018118 vlCDR3
QQDYSSPRT

SEQ ID NO: 11935 - protein, 451 aa, Artificial Sequence
  Description of Artificial Sequence: Synthetic polypeptide
  XENP018119 1G6_H1.22_L1_IgG1_PVA_/S267K Heavy Chain
EVQLVESGGGLVKPGGSLRLSCAASGFTFSSYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11936 - protein, 122 aa, Artificial Sequence; identical to SEQ ID NO: 6552
  Description of Artificial Sequence: Synthetic polypeptide
  VH of XENP018119

SEQ ID NO: 11937 - protein, 5 aa, Artificial Sequence
  Description of Artificial Sequence: Synthetic peptide
  XENP018119 vhCDR1
SYWMN

SEQ ID NO: 11938 - protein, 19 aa, Artificial Sequence
  Description of Artificial Sequence: Synthetic peptide
  XENP018119 vhCDR2
EIRLKSNNYATHYAEPVKG

SEQ ID NO: 11939 - protein, 11 aa, Artificial Sequence
  Description of Artificial Sequence: Synthetic peptide
  XENP018119 vhCDR3
YYGNYGGYFDV

SEQ ID NO: 11940 - protein, 214 aa, Artificial Sequence; identical to SEQ ID NO: 11550
  Description of Artificial Sequence: Synthetic polypeptide
  XENP018119 1G6_H1.22_L1_IgG1_PVA_/S267K Light Chain

SEQ ID NO: 11941 - protein, 107 aa, Artificial Sequence; identical to SEQ ID NO: 6247
  Description of Artificial Sequence: Synthetic polypeptide
  VL of XENP018119

SEQ ID NO: 11942 - protein, 11 aa, Artificial Sequence
  Description of Artificial Sequence: Synthetic peptide
  XENP018119 vlCDR1
RASQSVSNDVA

SEQ ID NO: 11943 - protein, 7 aa, Artificial Sequence
  Description of Artificial Sequence: Synthetic peptide
  XENP018119 vlCDR2
YASHRYT

SEQ ID NO: 11944 - protein, 9 aa, Artificial Sequence
  Description of Artificial Sequence: Synthetic peptide
  XENP018119 vlCDR3
QQDYSSPRT

SEQ ID NO: 11945 - protein, 451 aa, Artificial Sequence
  Description of Artificial Sequence: Synthetic polypeptide
  XENP018120 1G6_H1.23_L1_IgG1_PVA_/S267K Heavy Chain
EVQLVESGGGLVKPGGSLRLSCAASGFTFSRYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11946 - protein, 122 aa, Artificial Sequence; identical to SEQ ID NO: 6561
  Description of Artificial Sequence: Synthetic polypeptide
  VH of XENP018120

SEQ ID NO: 11947 - protein, 5 aa, Artificial Sequence
  Description of Artificial Sequence: Synthetic peptide
  XENP018120 vhCDR1
RYWMN

SEQ ID NO: 11948 - protein, 19 aa, Artificial Sequence
  Description of Artificial Sequence: Synthetic peptide
  XENP018120 vhCDR2
EIRLKSNNYATHYAEPVKG

SEQ ID NO: 11949 - protein, 11 aa, Artificial Sequence
  Description of Artificial Sequence: Synthetic peptide
  XENP018120 vhCDR3
YYGNYGGYFDV

SEQ ID NO: 11950 - protein, 214 aa, Artificial Sequence; identical to SEQ ID NO: 11550
  Description of Artificial Sequence: Synthetic polypeptide
  XENP018120 1G6_H1.23_L1_IgG1_PVA_/S267K Light Chain

SEQ ID NO: 11951 - protein, 107 aa, Artificial Sequence; identical to SEQ ID NO: 6247
  Description of Artificial Sequence: Synthetic polypeptide
  VL of XENP018120

SEQ ID NO: 11952 - protein, 11 aa, Artificial Sequence
  Description of Artificial Sequence: Synthetic peptide
  XENP018120 vlCDR1
RASQSVSNDVA

SEQ ID NO: 11953 - protein, 7 aa, Artificial Sequence
  Description of Artificial Sequence: Synthetic peptide
  XENP018120 vlCDR2
YASHRYT

SEQ ID NO: 11954 - protein, 9 aa, Artificial Sequence
  Description of Artificial Sequence: Synthetic peptide
  XENP018120 vlCDR3
QQDYSSPRT

SEQ ID NO: 11955 - protein, 451 aa, Artificial Sequence
  Description of Artificial Sequence: Synthetic polypeptide
  XENP018121 1G6_H1.24_L1_IgG1_PVA_/S267K Heavy Chain
EVQLVESGGGLVKPGGSLRLSCAASGFTFSLYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11956 - protein, 122 aa, Artificial Sequence; identical to SEQ ID NO: 6570
  Description of Artificial Sequence: Synthetic polypeptide
  VH of XENP018121

SEQ ID NO: 11957 - protein, 5 aa, Artificial Sequence
  Description of Artificial Sequence: Synthetic peptide
  XENP018121 vhCDR1
LYWMN

SEQ ID NO: 11958 - protein, 19 aa, Artificial Sequence
  Description of Artificial Sequence: Synthetic peptide
  XENP018121 vhCDR2
EIRLKSNNYATHYAEPVKG

SEQ ID NO: 11959 - protein, 11 aa, Artificial Sequence
  Description of Artificial Sequence: Synthetic peptide
  XENP018121 vhCDR3
YYGNYGGYFDV

SEQ ID NO: 11960 - protein, 214 aa, Artificial Sequence; identical to SEQ ID NO: 11550
  Description of Artificial Sequence: Synthetic polypeptide
  XENP018121 1G6_H1.24_L1_IgG1_PVA_/S267K Light Chain

SEQ ID NO: 11961 - protein, 107 aa, Artificial Sequence; identical to SEQ ID NO: 6247
  Description of Artificial Sequence: Synthetic polypeptide
  VL of XENP018121

SEQ ID NO: 11962 - protein, 11 aa, Artificial Sequence
  Description of Artificial Sequence: Synthetic peptide
  XENP018121 vlCDR1
RASQSVSNDVA

SEQ ID NO: 11963 - protein, 7 aa, Artificial Sequence
  Description of Artificial Sequence: Synthetic peptide
  XENP018121 vlCDR2
YASHRYT

SEQ ID NO: 11964 - protein, 9 aa, Artificial Sequence
  Description of Artificial Sequence: Synthetic peptide
  XENP018121 vlCDR3
QQDYSSPRT

SEQ ID NO: 11965 - protein, 451 aa, Artificial Sequence
  Description of Artificial Sequence: Synthetic polypeptide
  XENP018122 1G6_H1.25_L1_IgG1_PVA_/S267K Heavy Chain
EVQLVESGGGLVKPGGSLRLSCAASGFTFSTYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11966 - protein, 122 aa, Artificial Sequence; identical to SEQ ID NO: 6579
  Description of Artificial Sequence: Synthetic polypeptide
  VH of XENP018122

SEQ ID NO: 11967 - protein, 5 aa, Artificial Sequence
  Description of Artificial Sequence: Synthetic peptide
  XENP018122 vhCDR1
TYWMN

SEQ ID NO: 11968 - protein, 19 aa, Artificial Sequence
  Description of Artificial Sequence: Synthetic peptide
  XENP018122 vhCDR2
EIRLKSNNYATHYAEPVKG

SEQ ID NO: 11969 - protein, 11 aa, Artificial Sequence
  Description of Artificial Sequence: Synthetic peptide
  XENP018122 vhCDR3
YYGNYGGYFDV

SEQ ID NO: 11970 - protein, 214 aa, Artificial Sequence; identical to SEQ ID NO: 11550
  Description of Artificial Sequence: Synthetic polypeptide
  XENP018122 1G6_H1.25_L1_IgG1_PVA_/S267K Light Chain

SEQ ID NO: 11971 - protein, 107 aa, Artificial Sequence; identical to SEQ ID NO: 6247
  Description of Artificial Sequence: Synthetic polypeptide
  VL of XENP018122

SEQ ID NO: 11972 - protein, 11 aa, Artificial Sequence
  Description of Artificial Sequence: Synthetic peptide
  XENP018122 vlCDR1
RASQSVSNDVA

SEQ ID NO: 11973 - protein, 7 aa, Artificial Sequence
  Description of Artificial Sequence: Synthetic peptide
  XENP018122 vlCDR2
YASHRYT

SEQ ID NO: 11974 - protein, 9 aa, Artificial Sequence
  Description of Artificial Sequence: Synthetic peptide
  XENP018122 vlCDR3
QQDYSSPRT

SEQ ID NO: 11975 - protein, 451 aa, Artificial Sequence
  Description of Artificial Sequence: Synthetic polypeptide
  XENP018123 1G6_H1.26_L1_IgG1_PVA_/S267K Heavy Chain
EVQLVESGGGLVKPGGSLRLSCAASGFTFSGYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11976 - protein, 122 aa, Artificial Sequence; identical to SEQ ID NO: 6588
  Description of Artificial Sequence: Synthetic polypeptide
  VH of XENP018123

SEQ ID NO: 11977 - protein, 5 aa, Artificial Sequence
  Description of Artificial Sequence: Synthetic peptide
  XENP018123 vhCDR1
GYWMN

SEQ ID NO: 11978 - protein, 19 aa, Artificial Sequence
  Description of Artificial Sequence: Synthetic peptide
  XENP018123 vhCDR2
EIRLKSNNYATHYAEPVKG

SEQ ID NO: 11979 - protein, 11 aa, Artificial Sequence
  Description of Artificial Sequence: Synthetic peptide
  XENP018123 vhCDR3
YYGNYGGYFDV

SEQ ID NO: 11980 - protein, 214 aa, Artificial Sequence; identical to SEQ ID NO: 11550
  Description of Artificial Sequence: Synthetic polypeptide
  XENP018123 1G6_H1.26_L1_IgG1_PVA_/S267K Light Chain

SEQ ID NO: 11981 - protein, 107 aa, Artificial Sequence; identical to SEQ ID NO: 6247
  Description of Artificial Sequence: Synthetic polypeptide
  VL of XENP018123

SEQ ID NO: 11982 - protein, 11 aa, Artificial Sequence
  Description of Artificial Sequence: Synthetic peptide
  XENP018123 vlCDR1
RASQSVSNDVA

SEQ ID NO: 11983 - protein, 7 aa, Artificial Sequence
  Description of Artificial Sequence: Synthetic peptide
  XENP018123 vlCDR2
YASHRYT

SEQ ID NO: 11984 - protein, 9 aa, Artificial Sequence
  Description of Artificial Sequence: Synthetic peptide
  XENP018123 vlCDR3
QQDYSSPRT

SEQ ID NO: 11985 - protein, 451 aa, Artificial Sequence
  Description of Artificial Sequence: Synthetic polypeptide
  XENP018124 1G6_H1.27_L1_IgG1_PVA_/S267K Heavy Chain
EVQLVESGGGLVKPGGSLRLSCAASGFTFSYYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11986 - protein, 122 aa, Artificial Sequence; identical to SEQ ID NO: 6597
  Description of Artificial Sequence: Synthetic polypeptide
  VH of XENP018124

SEQ ID NO: 11987 - protein, 5 aa, Artificial Sequence
  Description of Artificial Sequence: Synthetic peptide
  XENP018124 vhCDR1
YYWMN

SEQ ID NO: 11988 - protein, 19 aa, Artificial Sequence
  Description of Artificial Sequence: Synthetic peptide
  XENP018124 vhCDR2
EIRLKSNNYATHYAEPVKG

SEQ ID NO: 11989 - protein, 11 aa, Artificial Sequence
  Description of Artificial Sequence: Synthetic peptide
  XENP018124 vhCDR3
YYGNYGGYFDV

SEQ ID NO: 11990 - protein, 214 aa, Artificial Sequence; identical to SEQ ID NO: 11550
  Description of Artificial Sequence: Synthetic polypeptide
  XENP018124 1G6_H1.27_L1_IgG1_PVA_/S267K Light Chain

SEQ ID NO: 11991 - protein, 107 aa, Artificial Sequence; identical to SEQ ID NO: 6247
  Description of Artificial Sequence: Synthetic polypeptide
  VL of XENP018124

SEQ ID NO: 11992 - protein, 11 aa, Artificial Sequence
  Description of Artificial Sequence: Synthetic peptide
  XENP018124 vlCDR1
RASQSVSNDVA

SEQ ID NO: 11993 - protein, 7 aa, Artificial Sequence
  Description of Artificial Sequence: Synthetic peptide
  XENP018124 vlCDR2
YASHRYT

SEQ ID NO: 11994 - protein, 9 aa, Artificial Sequence
  Description of Artificial Sequence: Synthetic peptide
  XENP018124 vlCDR3
QQDYSSPRT

SEQ ID NO: 11995 - protein, 451 aa, Artificial Sequence
  Description of Artificial Sequence: Synthetic polypeptide
  XENP018125 1G6_H1.28_L1_IgG1_PVA_/S267K Heavy Chain
EVQLVESGGGLVKPGGSLRLSCAASGFTFSNFWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11996 - protein, 122 aa, Artificial Sequence; identical to SEQ ID NO: 6606
  Description of Artificial Sequence: Synthetic polypeptide
  VH of XENP018125

SEQ ID NO: 11997 - protein, 5 aa, Artificial Sequence
  Description of Artificial Sequence: Synthetic peptide
  XENP018125 vhCDR1
NFWMN

SEQ ID NO: 11998 - protein, 19 aa, Artificial Sequence
  Description of Artificial Sequence: Synthetic peptide
  XENP018125 vhCDR2
EIRLKSNNYATHYAEPVKG

SEQ ID NO: 11999 - protein, 11 aa, Artificial Sequence
  Description of Artificial Sequence: Synthetic peptide
  XENP018125 vhCDR3
YYGNYGGYFDV

SEQ ID NO: 12000 - protein, 214 aa, Artificial Sequence; identical to SEQ ID NO: 11550
  Description of Artificial Sequence: Synthetic polypeptide
  XENP018125 1G6_H1.28_L1_IgG1_PVA_/S267K Light Chain

SEQ ID NO: 12001 - protein, 107 aa, Artificial Sequence; identical to SEQ ID NO: 6247
  Description of Artificial Sequence: Synthetic polypeptide
  VL of XENP018125

SEQ ID NO: 12002 - protein, 11 aa, Artificial Sequence
  Description of Artificial Sequence: Synthetic peptide
  XENP018125 vlCDR1
RASQSVSNDVA

SEQ ID NO: 12003 - protein, 7 aa, Artificial Sequence
  Description of Artificial Sequence: Synthetic peptide
  XENP018125 vlCDR2
YASHRYT

SEQ ID NO: 12004 - protein, 9 aa, Artificial Sequence
  Description of Artificial Sequence: Synthetic peptide
  XENP018125 vlCDR3
QQDYSSPRT

SEQ ID NO: 12005 - protein, 451 aa, Artificial Sequence
  Description of Artificial Sequence: Synthetic polypeptide
  XENP018126 1G6_H1.29_L1_IgG1_PVA_/S267K Heavy Chain
EVQLVESGGGLVKPGGSLRLSCAASGFTFSNHWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12006 - protein, 122 aa, Artificial Sequence; identical to SEQ ID NO: 6615
  Description of Artificial Sequence: Synthetic polypeptide
  VH of XENP018126

SEQ ID NO: 12007 - protein, 5 aa, Artificial Sequence
  Description of Artificial Sequence: Synthetic peptide
  XENP018126 vhCDR1
NHWMN

SEQ ID NO: 12008 - protein, 19 aa, Artificial Sequence
  Description of Artificial Sequence: Synthetic peptide
  XENP018126 vhCDR2
EIRLKSNNYATHYAEPVKG

SEQ ID NO: 12009 - protein, 11 aa, Artificial Sequence
  Description of Artificial Sequence: Synthetic peptide
  XENP018126 vhCDR3
YYGNYGGYFDV

SEQ ID NO: 12010 - protein, 214 aa, Artificial Sequence; identical to SEQ ID NO: 11550
  Description of Artificial Sequence: Synthetic polypeptide
  XENP018126 1G6_H1.29_L1_IgG1_PVA_/S267K Light Chain

SEQ ID NO: 12011 - protein, 107 aa, Artificial Sequence; identical to SEQ ID NO: 6247
  Description of Artificial Sequence: Synthetic polypeptide
  VL of XENP018126

SEQ ID NO: 12012 - protein, 11 aa, Artificial Sequence
  Description of Artificial Sequence: Synthetic peptide
  XENP018126 vlCDR1
RASQSVSNDVA

SEQ ID NO: 12013 - protein, 7 aa, Artificial Sequence
  Description of Artificial Sequence: Synthetic peptide
  XENP018126 vlCDR2
YASHRYT

SEQ ID NO: 12014 - protein, 9 aa, Artificial Sequence
  Description of Artificial Sequence: Synthetic peptide
  XENP018126 vlCDR3
QQDYSSPRT

SEQ ID NO: 12015 - protein, 451 aa, Artificial Sequence
  Description of Artificial Sequence: Synthetic polypeptide
  XENP018127 1G6_H1.30_L1_IgG1_PVA_/S267K Heavy Chain
EVQLVESGGGLVKPGGSLRLSCAASGFTFSNLWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12016 - protein, 122 aa, Artificial Sequence; identical to SEQ ID NO: 6624
  Description of Artificial Sequence: Synthetic polypeptide
  VH of XENP018127

SEQ ID NO: 12017 - protein, 5 aa, Artificial Sequence
  Description of Artificial Sequence: Synthetic peptide
  XENP018127 vhCDR1
NLWMN

SEQ ID NO: 12018 - protein, 19 aa, Artificial Sequence
  Description of Artificial Sequence: Synthetic peptide
  XENP018127 vhCDR2
EIRLKSNNYATHYAEPVKG

SEQ ID NO: 12019 - protein, 11 aa, Artificial Sequence
  Description of Artificial Sequence: Synthetic peptide
  XENP018127 vhCDR3
YYGNYGGYFDV

SEQ ID NO: 12020 - protein, 214 aa, Artificial Sequence; identical to SEQ ID NO: 11550
  Description of Artificial Sequence: Synthetic polypeptide
  XENP018127 1G6_H1.30_L1_IgG1_PVA_/S267K Light Chain

SEQ ID NO: 12021 - protein, 107 aa, Artificial Sequence; identical to SEQ ID NO: 6247
  Description of Artificial Sequence: Synthetic polypeptide
  VL of XENP018127

SEQ ID NO: 12022 - protein, 11 aa, Artificial Sequence
  Description of Artificial Sequence: Synthetic peptide
  XENP018127 vlCDR1
RASQSVSNDVA

SEQ ID NO: 12023 - protein, 7 aa, Artificial Sequence
  Description of Artificial Sequence: Synthetic peptide
  XENP018127 vlCDR2
YASHRYT

SEQ ID NO: 12024 - protein, 9 aa, Artificial Sequence
  Description of Artificial Sequence: Synthetic peptide
  XENP018127 vlCDR3
QQDYSSPRT

SEQ ID NO: 12025 - protein, 451 aa, Artificial Sequence
  Description of Artificial Sequence: Synthetic polypeptide
  XENP018128 1G6_H1.31_L1_IgG1_PVA_/S267K Heavy Chain
EVQLVESGGGLVKPGGSLRLSCAASGFTFSNWWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12026 - protein, 122 aa, Artificial Sequence; identical to SEQ ID NO: 6633
  Description of Artificial Sequence: Synthetic polypeptide
  VH of XENP018128

SEQ ID NO: 12027 - protein, 5 aa, Artificial Sequence
  Description of Artificial Sequence: Synthetic peptide
  XENP018128 vhCDR1
NWWMN

SEQ ID NO: 12028 - protein, 19 aa, Artificial Sequence
  Description of Artificial Sequence: Synthetic peptide
  XENP018128 vhCDR2
EIRLKSNNYATHYAEPVKG

SEQ ID NO: 12029 - protein, 11 aa, Artificial Sequence
  Description of Artificial Sequence: Synthetic peptide
  XENP018128 vhCDR3
YYGNYGGYFDV

SEQ ID NO: 12030 - protein, 214 aa, Artificial Sequence; identical to SEQ ID NO: 11550
  Description of Artificial Sequence: Synthetic polypeptide
  XENP018128 1G6_H1.31_L1_IgG1_PVA_/S267K Light Chain

SEQ ID NO: 12031 - protein, 107 aa, Artificial Sequence; identical to SEQ ID NO: 6247
  Description of Artificial Sequence: Synthetic polypeptide
  VL of XENP018128

SEQ ID NO: 12032 - protein, 11 aa, Artificial Sequence
  Description of Artificial Sequence: Synthetic peptide
  XENP018128 vlCDR1
RASQSVSNDVA

SEQ ID NO: 12033 - protein, 7 aa, Artificial Sequence
  Description of Artificial Sequence: Synthetic peptide
  XENP018128 vlCDR2
YASHRYT

SEQ ID NO: 12034 - protein, 9 aa, Artificial Sequence
  Description of Artificial Sequence: Synthetic peptide
  XENP018128 vlCDR3
QQDYSSPRT

SEQ ID NO: 12035 - protein, 451 aa, Artificial Sequence
  Description of Artificial Sequence: Synthetic polypeptide
  XENP018129 1G6_H1.32_L1_IgG1_PVA_/S267K Heavy Chain
EVQLVESGGGLVKPGGSLRLSCAASGFTFSNVWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12036 - protein, 122 aa, Artificial Sequence; identical to SEQ ID NO: 6642
  Description of Artificial Sequence: Synthetic polypeptide
  VH of XENP018129

SEQ ID NO: 12037 - protein, 5 aa, Artificial Sequence
  Description of Artificial Sequence: Synthetic peptide
  XENP018129 vhCDR1
NVWMN

SEQ ID NO: 12038 - protein, 19 aa, Artificial Sequence
  Description of Artificial Sequence: Synthetic peptide
  XENP018129 vhCDR2
EIRLKSNNYATHYAEPVKG

SEQ ID NO: 12039 - protein, 11 aa, Artificial Sequence
  Description of Artificial Sequence: Synthetic peptide
  XENP018129 vhCDR3
YYGNYGGYFDV

SEQ ID NO: 12040 - protein, 214 aa, Artificial Sequence; identical to SEQ ID NO: 11550
  Description of Artificial Sequence: Synthetic polypeptide
  XENP018129 1G6_H1.32_L1_IgG1_PVA_/S267K Light Chain

SEQ ID NO: 12041 - protein, 107 aa, Artificial Sequence; identical to SEQ ID NO: 6247
  Description of Artificial Sequence: Synthetic polypeptide
  VL of XENP018129

SEQ ID NO: 12042 - protein, 11 aa, Artificial Sequence
  Description of Artificial Sequence: Synthetic peptide
  XENP018129 vlCDR1
RASQSVSNDVA

SEQ ID NO: 12043 - protein, 7 aa, Artificial Sequence
  Description of Artificial Sequence: Synthetic peptide
  XENP018129 vlCDR2
YASHRYT

SEQ ID NO: 12044 - protein, 9 aa, Artificial Sequence
  Description of Artificial Sequence: Synthetic peptide
  XENP018129 vlCDR3
QQDYSSPRT

SEQ ID NO: 12045 - protein, 451 aa, Artificial Sequence
  Description of Artificial Sequence: Synthetic polypeptide
  XENP018130 1G6_H1.33_L1_IgG1_PVA_/S267K Heavy Chain
EVQLVESGGGLVKPGGSLRLSCAASGFTFSNAWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12046 - protein, 122 aa, Artificial Sequence; identical to SEQ ID NO: 6651
  Description of Artificial Sequence: Synthetic polypeptide
  VH of XENP018130

SEQ ID NO: 12047 - protein, 5 aa, Artificial Sequence
  Description of Artificial Sequence: Synthetic peptide
  XENP018130 vhCDR1
NAWMN

SEQ ID NO: 12048 - protein, 19 aa, Artificial Sequence
  Description of Artificial Sequence: Synthetic peptide
  XENP018130 vhCDR2
EIRLKSNNYATHYAEPVKG

SEQ ID NO: 12049 - protein, 11 aa, Artificial Sequence
  Description of Artificial Sequence: Synthetic peptide
  XENP018130 vhCDR3
YYGNYGGYFDV

SEQ ID NO: 12050 - protein, 214 aa, Artificial Sequence; identical to SEQ ID NO: 11550
  Description of Artificial Sequence: Synthetic polypeptide
  XENP018130 1G6_H1.33_L1_IgG1_PVA_/S267K Light Chain

SEQ ID NO: 12051 - protein, 107 aa, Artificial Sequence; identical to SEQ ID NO: 6247
  Description of Artificial Sequence: Synthetic polypeptide
  VL of XENP018130

SEQ ID NO: 12052 - protein, 11 aa, Artificial Sequence
  Description of Artificial Sequence: Synthetic peptide
  XENP018130 vlCDR1
RASQSVSNDVA

SEQ ID NO: 12053 - protein, 7 aa, Artificial Sequence
  Description of Artificial Sequence: Synthetic peptide
  XENP018130 vlCDR2
YASHRYT

SEQ ID NO: 12054 - protein, 9 aa, Artificial Sequence
  Description of Artificial Sequence: Synthetic peptide
  XENP018130 vlCDR3
QQDYSSPRT

SEQ ID NO: 12055 - protein, 451 aa, Artificial Sequence
  Description of Artificial Sequence: Synthetic polypeptide
  XENP018131 1G6_H1.34_L1_IgG1_PVA_/S267K Heavy Chain
EVQLVESGGGLVKPGGSLRLSCAASGFTFSNQWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12056 - protein, 122 aa, Artificial Sequence; identical to SEQ ID NO: 6660
  Description of Artificial Sequence: Synthetic polypeptide
  VH of XENP018131

SEQ ID NO: 12057 - protein, 5 aa, Artificial Sequence
  Description of Artificial Sequence: Synthetic peptide
  XENP018131 vhCDR1
NQWMN

SEQ ID NO: 12058 - protein, 19 aa, Artificial Sequence
  Description of Artificial Sequence: Synthetic peptide
  XENP018131 vhCDR2
EIRLKSNNYATHYAEPVKG

SEQ ID NO: 12059 - protein, 11 aa, Artificial Sequence
  Description of Artificial Sequence: Synthetic peptide
  XENP018131 vhCDR3
YYGNYGGYFDV

SEQ ID NO: 12060 - protein, 214 aa, Artificial Sequence; identical to SEQ ID NO: 11550
  Description of Artificial Sequence: Synthetic polypeptide
  XENP018131 1G6_H1.34_L1_IgG1_PVA_/S267K Light Chain

SEQ ID NO: 12061 - protein, 107 aa, Artificial Sequence; identical to SEQ ID NO: 6247
  Description of Artificial Sequence: Synthetic polypeptide
  VL of XENP018131

SEQ ID NO: 12062 - protein, 11 aa, Artificial Sequence
  Description of Artificial Sequence: Synthetic peptide
  XENP018131 vlCDR1
RASQSVSNDVA

SEQ ID NO: 12063 - protein, 7 aa, Artificial Sequence
  Description of Artificial Sequence: Synthetic peptide
  XENP018131 vlCDR2
YASHRYT

SEQ ID NO: 12064 - protein, 9 aa, Artificial Sequence
  Description of Artificial Sequence: Synthetic peptide
  XENP018131 vlCDR3
QQDYSSPRT

SEQ ID NO: 12065 - protein, 451 aa, Artificial Sequence
  Description of Artificial Sequence: Synthetic polypeptide
  XENP018132 1G6_H1.35_L1_IgG1_PVA_/S267K Heavy Chain
EVQLVESGGGLVKPGGSLRLSCAASGFTFSNDWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12066 - protein, 122 aa, Artificial Sequence; identical to SEQ ID NO: 6669
  Description of Artificial Sequence: Synthetic polypeptide
  VH of XENP018132

SEQ ID NO: 12067 - protein, 5 aa, Artificial Sequence
  Description of Artificial Sequence: Synthetic peptide
  XENP018132 vhCDR1
NDWMN

SEQ ID NO: 12068 - protein, 19 aa, Artificial Sequence
  Description of Artificial Sequence: Synthetic peptide
  XENP018132 vhCDR2
EIRLKSNNYATHYAEPVKG

SEQ ID NO: 12069 - protein, 11 aa, Artificial Sequence
  Description of Artificial Sequence: Synthetic peptide
  XENP018132 vhCDR3
YYGNYGGYFDV

SEQ ID NO: 12070 - protein, 214 aa, Artificial Sequence; identical to SEQ ID NO: 11550
  Description of Artificial Sequence: Synthetic polypeptide
  XENP018132 1G6_H1.35_L1_IgG1_PVA_/S267K Light Chain

SEQ ID NO: 12071 - protein, 107 aa, Artificial Sequence; identical to SEQ ID NO: 6247
  Description of Artificial Sequence: Synthetic polypeptide
  VL of XENP018132

SEQ ID NO: 12072 - protein, 11 aa, Artificial Sequence
  Description of Artificial Sequence: Synthetic peptide
  XENP018132 vlCDR1
RASQSVSNDVA

SEQ ID NO: 12073 - protein, 7 aa, Artificial Sequence
  Description of Artificial Sequence: Synthetic peptide
  XENP018132 vlCDR2
YASHRYT

SEQ ID NO: 12074 - protein, 9 aa, Artificial Sequence
  Description of Artificial Sequence: Synthetic peptide
  XENP018132 vlCDR3
QQDYSSPRT

SEQ ID NO: 12075 - protein, 451 aa, Artificial Sequence
  Description of Artificial Sequence: Synthetic polypeptide
  XENP018133 1G6_H1.36_L1_IgG1_PVA_/S267K Heavy Chain
EVQLVESGGGLVKPGGSLRLSCAASGFTFSNKWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12076 - protein, 122 aa, Artificial Sequence; identical to SEQ ID NO: 6678
  Description of Artificial Sequence: Synthetic polypeptide
  VH of XENP018133

SEQ ID NO: 12077 - protein, 5 aa, Artificial Sequence
  Description of Artificial Sequence: Synthetic peptide
  XENP018133 vhCDR1
NKWMN

SEQ ID NO: 12078 - protein, 19 aa, Artificial Sequence
  Description of Artificial Sequence: Synthetic peptide
  XENP018133 vhCDR2
EIRLKSNNYATHYAEPVKG

SEQ ID NO: 12079 - protein, 11 aa, Artificial Sequence
  Description of Artificial Sequence: Synthetic peptide
  XENP018133 vhCDR3
YYGNYGGYFDV

SEQ ID NO: 12080 - protein, 214 aa, Artificial Sequence; identical to SEQ ID NO: 11550
  Description of Artificial Sequence: Synthetic polypeptide
  XENP018133 1G6_H1.36_L1_IgG1_PVA_/S267K Light Chain

SEQ ID NO: 12081 - protein, 107 aa, Artificial Sequence; identical to SEQ ID NO: 6247
  Description of Artificial Sequence: Synthetic polypeptide
  VL of XENP018133

SEQ ID NO: 12082 - protein, 11 aa, Artificial Sequence
  Description of Artificial Sequence: Synthetic peptide
  XENP018133 vlCDR1
RASQSVSNDVA

SEQ ID NO: 12083 - protein, 7 aa, Artificial Sequence
  Description of Artificial Sequence: Synthetic peptide
  XENP018133 vlCDR2
YASHRYT

SEQ ID NO: 12084 - protein, 9 aa, Artificial Sequence
  Description of Artificial Sequence: Synthetic peptide
  XENP018133 vlCDR3
QQDYSSPRT

SEQ ID NO: 12085 - protein, 451 aa, Artificial Sequence
  Description of Artificial Sequence: Synthetic polypeptide
  XENP018134 1G6_H1.37_L1_IgG1_PVA_/S267K Heavy Chain
EVQLVESGGGLVKPGGSLRLSCAASGFTFSNYGMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12086 - protein, 122 aa, Artificial Sequence; identical to SEQ ID NO: 6687
  Description of Artificial Sequence: Synthetic polypeptide
  VH of XENP018134

SEQ ID NO: 12087 - protein, 5 aa, Artificial Sequence
  Description of Artificial Sequence: Synthetic peptide
  XENP018134 vhCDR1
NYGMN

SEQ ID NO: 12088 - protein, 19 aa, Artificial Sequence
  Description of Artificial Sequence: Synthetic peptide
  XENP018134 vhCDR2
EIRLKSNNYATHYAEPVKG

SEQ ID NO: 12089 - protein, 11 aa, Artificial Sequence
  Description of Artificial Sequence: Synthetic peptide
  XENP018134 vhCDR3
YYGNYGGYFDV

SEQ ID NO: 12090 - protein, 214 aa, Artificial Sequence; identical to SEQ ID NO: 11550
  Description of Artificial Sequence: Synthetic polypeptide
  XENP018134 1G6_H1.37_L1_IgG1_PVA_/S267K Light Chain

SEQ ID NO: 12091 - protein, 107 aa, Artificial Sequence; identical to SEQ ID NO: 6247
  Description of Artificial Sequence: Synthetic polypeptide
  VL of XENP018134

SEQ ID NO: 12092 - protein, 11 aa, Artificial Sequence
  Description of Artificial Sequence: Synthetic peptide
  XENP018134 vlCDR1
RASQSVSNDVA

SEQ ID NO: 12093 - protein, 7 aa, Artificial Sequence
  Description of Artificial Sequence: Synthetic peptide
  XENP018134 vlCDR2
YASHRYT

SEQ ID NO: 12094 - protein, 9 aa, Artificial Sequence
  Description of Artificial Sequence: Synthetic peptide
  XENP018134 vlCDR3
QQDYSSPRT

SEQ ID NO: 12095 - protein, 451 aa, Artificial Sequence
  Description of Artificial Sequence: Synthetic polypeptide
  XENP018135 1G6_H1.38_L1_IgG1_PVA_/S267K Heavy Chain
EVQLVESGGGLVKPGGSLRLSCAASGFTFSNYAMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12096 - protein, 122 aa, Artificial Sequence; identical to SEQ ID NO: 6696
  Description of Artificial Sequence: Synthetic polypeptide
  VH of XENP018135

SEQ ID NO: 12097 - protein, 5 aa, Artificial Sequence
  Description of Artificial Sequence: Synthetic peptide
  XENP018135 vhCDR1
NYAMN

SEQ ID NO: 12098 - protein, 19 aa, Artificial Sequence
  Description of Artificial Sequence: Synthetic peptide
  XENP018135 vhCDR2
EIRLKSNNYATHYAEPVKG

SEQ ID NO: 12099 - protein, 11 aa, Artificial Sequence
  Description of Artificial Sequence: Synthetic peptide
  XENP018135 vhCDR3
YYGNYGGYFDV

SEQ ID NO: 12100 - protein, 214 aa, Artificial Sequence; identical to SEQ ID NO: 11550
  Description of Artificial Sequence: Synthetic polypeptide
  XENP018135 1G6_H1.38_L1_IgG1_PVA_/S267K Light Chain

SEQ ID NO: 12101 - protein, 107 aa, Artificial Sequence; identical to SEQ ID NO: 6247
  Description of Artificial Sequence: Synthetic polypeptide
  VL of XENP018135

SEQ ID NO: 12102 - protein, 11 aa, Artificial Sequence
  Description of Artificial Sequence: Synthetic peptide
  XENP018135 vlCDR1
RASQSVSNDVA

SEQ ID NO: 12103 - protein, 7 aa, Artificial Sequence
  Description of Artificial Sequence: Synthetic peptide
  XENP018135 vlCDR2
YASHRYT

SEQ ID NO: 12104 - protein, 9 aa, Artificial Sequence
  Description of Artificial Sequence: Synthetic peptide
  XENP018135 vlCDR3
QQDYSSPRT

SEQ ID NO: 12105 - protein, 451 aa, Artificial Sequence
  Description of Artificial Sequence: Synthetic polypeptide
  XENP018136 1G6_H1.39_L1_IgG1_PVA_/S267K Heavy Chain
EVQLVESGGGLVKPGGSLRLSCAASGFTFSNYYMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12106 - protein, 122 aa, Artificial Sequence; identical to SEQ ID NO: 6705
  Description of Artificial Sequence: Synthetic polypeptide
  VH of XENP018136

SEQ ID NO: 12107 - protein, 5 aa, Artificial Sequence
  Description of Artificial Sequence: Synthetic peptide
  XENP018136 vhCDR1
NYYMN

SEQ ID NO: 12108 - protein, 19 aa, Artificial Sequence
  Description of Artificial Sequence: Synthetic peptide
  XENP018136 vhCDR2
EIRLKSNNYATHYAEPVKG

SEQ ID NO: 12109 - protein, 11 aa, Artificial Sequence
  Description of Artificial Sequence: Synthetic peptide
  XENP018136 vhCDR3
YYGNYGGYFDV

SEQ ID NO: 12110 - protein, 214 aa, Artificial Sequence; identical to SEQ ID NO: 11550
  Description of Artificial Sequence: Synthetic polypeptide
  XENP018136 1G6_H1.39_L1_IgG1_PVA_/S267K Light Chain

SEQ ID NO: 12111 - protein, 107 aa, Artificial Sequence; identical to SEQ ID NO: 6247
  Description of Artificial Sequence: Synthetic polypeptide
  VL of XENP018136

SEQ ID NO: 12112 - protein, 11 aa, Artificial Sequence
  Description of Artificial Sequence: Synthetic peptide
  XENP018136 vlCDR1
RASQSVSNDVA

SEQ ID NO: 12113 - protein, 7 aa, Artificial Sequence
  Description of Artificial Sequence: Synthetic peptide
  XENP018136 vlCDR2
YASHRYT

SEQ ID NO: 12114 - protein, 9 aa, Artificial Sequence
  Description of Artificial Sequence: Synthetic peptide
  XENP018136 vlCDR3
QQDYSSPRT

SEQ ID NO: 12115 - protein, 451 aa, Artificial Sequence
  Description of Artificial Sequence: Synthetic polypeptide
  XENP018137 1G6_H1.40_L1_IgG1_PVA_/S267K Heavy Chain
EVQLVESGGGLVKPGGSLRLSCAASGFTFSNYDMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12116 - protein, 122 aa, Artificial Sequence; identical to SEQ ID NO: 6714
  Description of Artificial Sequence: Synthetic polypeptide
  VH of XENP018137

SEQ ID NO: 12117 - protein, 5 aa, Artificial Sequence
  Description of Artificial Sequence: Synthetic peptide
  XENP018137 vhCDR1
NYDMN

SEQ ID NO: 12118 - protein, 19 aa, Artificial Sequence
  Description of Artificial Sequence: Synthetic peptide
  XENP018137 vhCDR2
EIRLKSNNYATHYAEPVKG

SEQ ID NO: 12119 - protein, 11 aa, Artificial Sequence
  Description of Artificial Sequence: Synthetic peptide
  XENP018137 vhCDR3
YYGNYGGYFDV

SEQ ID NO: 12120 - protein, 214 aa, Artificial Sequence; identical to SEQ ID NO: 11550
  Description of Artificial Sequence: Synthetic polypeptide
  XENP018137 1G6_H1.40_L1_IgG1_PVA_/S267K Light Chain

SEQ ID NO: 12121 - protein, 107 aa, Artificial Sequence; identical to SEQ ID NO: 6247
  Description of Artificial Sequence: Synthetic polypeptide
  VL of XENP018137

SEQ ID NO: 12122 - protein, 11 aa, Artificial Sequence
  Description of Artificial Sequence: Synthetic peptide
  XENP018137 vlCDR1
RASQSVSNDVA

SEQ ID NO: 12123 - protein, 7 aa, Artificial Sequence
  Description of Artificial Sequence: Synthetic peptide
  XENP018137 vlCDR2
YASHRYT

SEQ ID NO: 12124 - protein, 9 aa, Artificial Sequence
  Description of Artificial Sequence: Synthetic peptide
  XENP018137 vlCDR3
QQDYSSPRT

SEQ ID NO: 12125 - protein, 451 aa, Artificial Sequence
  Description of Artificial Sequence: Synthetic polypeptide
  XENP018138 1G6_H1.41_L1_IgG1_PVA_/S267K Heavy Chain
EVQLVESGGGLVKPGGSLRLSCAASGFTFSNYWMSWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12126 - protein, 122 aa, Artificial Sequence; identical to SEQ ID NO: 6723
  Description of Artificial Sequence: Synthetic polypeptide
  VH of XENP018138

SEQ ID NO: 12127 - protein, 5 aa, Artificial Sequence
  Description of Artificial Sequence: Synthetic peptide
  XENP018138 vhCDR1
NYWMS

SEQ ID NO: 12128 - protein, 19 aa, Artificial Sequence
  Description of Artificial Sequence: Synthetic peptide
  XENP018138 vhCDR2
EIRLKSNNYATHYAEPVKG

SEQ ID NO: 12129 - protein, 11 aa, Artificial Sequence
  Description of Artificial Sequence: Synthetic peptide
  XENP018138 vhCDR3
YYGNYGGYFDV

SEQ ID NO: 12130 - protein, 214 aa, Artificial Sequence; identical to SEQ ID NO: 11550
  Description of Artificial Sequence: Synthetic polypeptide
  XENP018138 1G6_H1.41_L1_IgG1_PVA_/S267K Light Chain

SEQ ID NO: 12131 - protein, 107 aa, Artificial Sequence; identical to SEQ ID NO: 6247
  Description of Artificial Sequence: Synthetic polypeptide
  VL of XENP018138

SEQ ID NO: 12132 - protein, 11 aa, Artificial Sequence
  Description of Artificial Sequence: Synthetic peptide
  XENP018138 vlCDR1
RASQSVSNDVA

SEQ ID NO: 12133 - protein, 7 aa, Artificial Sequence
  Description of Artificial Sequence: Synthetic peptide
  XENP018138 vlCDR2
YASHRYT

SEQ ID NO: 12134 - protein, 9 aa, Artificial Sequence
  Description of Artificial Sequence: Synthetic peptide
  XENP018138 vlCDR3
QQDYSSPRT

SEQ ID NO: 12135 - protein, 451 aa, Artificial Sequence
  Description of Artificial Sequence: Synthetic polypeptide
  XENP018139 1G6_H1.42_L1_IgG1_PVA_/S267K Heavy Chain
EVQLVESGGGLVKPGGSLRLSCAASGFTFSNYWMHWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12136 - protein, 122 aa, Artificial Sequence; identical to SEQ ID NO: 6732
  Description of Artificial Sequence: Synthetic polypeptide
  VH of XENP018139

SEQ ID NO: 12137 - protein, 5 aa, Artificial Sequence
  Description of Artificial Sequence: Synthetic peptide
  XENP018139 vhCDR1
NYWMH

SEQ ID NO: 12138 - protein, 19 aa, Artificial Sequence
  Description of Artificial Sequence: Synthetic peptide
  XENP018139 vhCDR2
EIRLKSNNYATHYAEPVKG

SEQ ID NO: 12139 - protein, 11 aa, Artificial Sequence
  Description of Artificial Sequence: Synthetic peptide
  XENP018139 vhCDR3
YYGNYGGYFDV

SEQ ID NO: 12140 - protein, 214 aa, Artificial Sequence; identical to SEQ ID NO: 11550
  Description of Artificial Sequence: Synthetic polypeptide
  XENP018139 1G6_H1.42_L1_IgG1_PVA_/S267K Light Chain

SEQ ID NO: 12141 - protein, 107 aa, Artificial Sequence; identical to SEQ ID NO: 6247
  Description of Artificial Sequence: Synthetic polypeptide
  VL of XENP018139

SEQ ID NO: 12142 - protein, 11 aa, Artificial Sequence
  Description of Artificial Sequence: Synthetic peptide
  XENP018139 vlCDR1
RASQSVSNDVA

SEQ ID NO: 12143 - protein, 7 aa, Artificial Sequence
  Description of Artificial Sequence: Synthetic peptide
  XENP018139 vlCDR2
YASHRYT

SEQ ID NO: 12144 - protein, 9 aa, Artificial Sequence
  Description of Artificial Sequence: Synthetic peptide
  XENP018139 vlCDR3
QQDYSSPRT

SEQ ID NO: 12145 - protein, 451 aa, Artificial Sequence
  Description of Artificial Sequence: Synthetic polypeptide
  XENP018140 1G6_H1.43_L1_IgG1_PVA_/S267K Heavy Chain
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12146 - protein, 122 aa, Artificial Sequence; identical to SEQ ID NO: 6741
  Description of Artificial Sequence: Synthetic polypeptide
  VH of XENP018140

SEQ ID NO: 12147 - protein, 5 aa, Artificial Sequence
  Description of Artificial Sequence: Synthetic peptide
  XENP018140 vhCDR1
NYWMD

SEQ ID NO: 12148 - protein, 19 aa, Artificial Sequence
  Description of Artificial Sequence: Synthetic peptide
  XENP018140 vhCDR2
EIRLKSNNYATHYAEPVKG

SEQ ID NO: 12149 - protein, 11 aa, Artificial Sequence
  Description of Artificial Sequence: Synthetic peptide
  XENP018140 vhCDR3
YYGNYGGYFDV

SEQ ID NO: 12150 - protein, 214 aa, Artificial Sequence; identical to SEQ ID NO: 11550
  Description of Artificial Sequence: Synthetic polypeptide
  XENP018140 1G6_H1.43_L1_IgG1_PVA_/S267K Light Chain

SEQ ID NO: 12151 - protein, 107 aa, Artificial Sequence; identical to SEQ ID NO: 6247
  Description of Artificial Sequence: Synthetic polypeptide
  VL of XENP018140

SEQ ID NO: 12152 - protein, 11 aa, Artificial Sequence
  Description of Artificial Sequence: Synthetic peptide
  XENP018140 vlCDR1
RASQSVSNDVA

SEQ ID NO: 12153 - protein, 7 aa, Artificial Sequence
  Description of Artificial Sequence: Synthetic peptide
  XENP018140 vlCDR2
YASHRYT

SEQ ID NO: 12154 - protein, 9 aa, Artificial Sequence
  Description of Artificial Sequence: Synthetic peptide
  XENP018140 vlCDR3
QQDYSSPRT

SEQ ID NO: 12155 - protein, 451 aa, Artificial Sequence
  Description of Artificial Sequence: Synthetic polypeptide
  XENP018141 1G6_H1.44_L1_IgG1_PVA_/S267K Heavy Chain
EVQLVESGGGLVKPGGSLRLSCAASGFTFSNYWMGWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12156 - protein, 122 aa, Artificial Sequence; identical to SEQ ID NO: 6750
  Description of Artificial Sequence: Synthetic polypeptide
  VH of XENP018141

SEQ ID NO: 12157 - protein, 5 aa, Artificial Sequence
  Description of Artificial Sequence: Synthetic peptide
  XENP018141 vhCDR1
NYWMG

SEQ ID NO: 12158 - protein, 18 aa, Artificial Sequence
  Description of Artificial Sequence: Synthetic peptide
  XENP018141 vhCDR2
EIRLKSNNYATHYAEPVK

SEQ ID NO: 12159 - protein, 11 aa, Artificial Sequence
  Description of Artificial Sequence: Synthetic peptide
  XENP018141 vhCDR3
YYGNYGGYFDV

SEQ ID NO: 12160 - protein, 214 aa, Artificial Sequence; identical to SEQ ID NO: 11550
  Description of Artificial Sequence: Synthetic polypeptide
  XENP018141 1G6_H1.44_L1_IgG1_PVA_/S267K Light Chain

SEQ ID NO: 12161 - protein, 107 aa, Artificial Sequence; identical to SEQ ID NO: 6247
  Description of Artificial Sequence: Synthetic polypeptide
  VL of XENP018141

SEQ ID NO: 12162 - protein, 11 aa, Artificial Sequence
  Description of Artificial Sequence: Synthetic peptide
  XENP018141 vlCDR1
RASQSVSNDVA

SEQ ID NO: 12163 - protein, 7 aa, Artificial Sequence
  Description of Artificial Sequence: Synthetic peptide
  XENP018141 vlCDR2
YASHRYT

SEQ ID NO: 12164 - protein, 9 aa, Artificial Sequence
  Description of Artificial Sequence: Synthetic peptide
  XENP018141 vlCDR3
QQDYSSPRT

SEQ ID NO: 12165 - protein, 451 aa, Artificial Sequence
  Description of Artificial Sequence: Synthetic polypeptide
  XENP018142 1G6_H1.45_L1_IgG1_PVA_/S267K Heavy Chain
EVQLVESGGGLVKPGGSLRLSCAASGFTFSNYWMNWARQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12166 - protein, 122 aa, Artificial Sequence; identical to SEQ ID NO: 6759
  Description of Artificial Sequence: Synthetic polypeptide
  VH of XENP018142

SEQ ID NO: 12167 - protein, 5 aa, Artificial Sequence
  Description of Artificial Sequence: Synthetic peptide
  XENP018142 vhCDR1
NYWMN

SEQ ID NO: 12168 - protein, 19 aa, Artificial Sequence
  Description of Artificial Sequence: Synthetic peptide
  XENP018142 vhCDR2
EIRLKSNNYATHYAEPVKG

SEQ ID NO: 12169 - protein, 11 aa, Artificial Sequence
  Description of Artificial Sequence: Synthetic peptide
  XENP018142 vhCDR3
YYGNYGGYFDV

SEQ ID NO: 12170 - protein, 214 aa, Artificial Sequence; identical to SEQ ID NO: 11550
  Description of Artificial Sequence: Synthetic polypeptide
  XENP018142 1G6_H1.45_L1_IgG1_PVA_/S267K Light Chain

SEQ ID NO: 12171 - protein, 107 aa, Artificial Sequence; identical to SEQ ID NO: 6247
  Description of Artificial Sequence: Synthetic polypeptide
  VL of XENP018142

SEQ ID NO: 12172 - protein, 11 aa, Artificial Sequence
  Description of Artificial Sequence: Synthetic peptide
  XENP018142 vlCDR1
RASQSVSNDVA

SEQ ID NO: 12173 - protein, 7 aa, Artificial Sequence
  Description of Artificial Sequence: Synthetic peptide
  XENP018142 vlCDR2
YASHRYT

SEQ ID NO: 12174 - protein, 9 aa, Artificial Sequence
  Description of Artificial Sequence: Synthetic peptide
  XENP018142 vlCDR3
QQDYSSPRT

SEQ ID NO: 12175 - protein, 451 aa, Artificial Sequence
  Description of Artificial Sequence: Synthetic polypeptide
  XENP018143 1G6_H1.46_L1_IgG1_PVA_/S267K Heavy Chain
EVQLVESGGGLVKPGGSLRLSCAASGFTFSNYWMNWIRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12176 - protein, 122 aa, Artificial Sequence; identical to SEQ ID NO: 6768
  Description of Artificial Sequence: Synthetic polypeptide
  VH of XENP018143

SEQ ID NO: 12177 - protein, 5 aa, Artificial Sequence
  Description of Artificial Sequence: Synthetic peptide
  XENP018143 vhCDR1
NYWMN

SEQ ID NO: 12178 - protein, 19 aa, Artificial Sequence
  Description of Artificial Sequence: Synthetic peptide
  XENP018143 vhCDR2
EIRLKSNNYATHYAEPVKG

SEQ ID NO: 12179 - protein, 11 aa, Artificial Sequence
  Description of Artificial Sequence: Synthetic peptide
  XENP018143 vhCDR3
YYGNYGGYFDV

SEQ ID NO: 12180 - protein, 214 aa, Artificial Sequence; identical to SEQ ID NO: 11550
  Description of Artificial Sequence: Synthetic polypeptide
  XENP018143 1G6_H1.46_L1_IgG1_PVA_/S267K Light Chain

SEQ ID NO: 12181 - protein, 107 aa, Artificial Sequence; identical to SEQ ID NO: 6247
  Description of Artificial Sequence: Synthetic polypeptide
  VL of XENP018143

SEQ ID NO: 12182 - protein, 11 aa, Artificial Sequence
  Description of Artificial Sequence: Synthetic peptide
  XENP018143 vlCDR1
RASQSVSNDVA

SEQ ID NO: 12183 - protein, 7 aa, Artificial Sequence
  Description of Artificial Sequence: Synthetic peptide
  XENP018143 vlCDR2
YASHRYT

SEQ ID NO: 12184 - protein, 9 aa, Artificial Sequence
  Description of Artificial Sequence: Synthetic peptide
  XENP018143 vlCDR3
QQDYSSPRT

SEQ ID NO: 12185 - protein, 451 aa, Artificial Sequence
  Description of Artificial Sequence: Synthetic polypeptide
  XENP018144 1G6_H1.47_L1_IgG1_PVA_/S267K Heavy Chain
EVQLVESGGGLVKPGGSLRLSCAASGFTFSNYWMNWFRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12186 - protein, 122 aa, Artificial Sequence; identical to SEQ ID NO: 6777
  Description of Artificial Sequence: Synthetic polypeptide
  VH of XENP018144

SEQ ID NO: 12187 - protein, 5 aa, Artificial Sequence
  Description of Artificial Sequence: Synthetic peptide
  XENP018144 vhCDR1
NYWMN

SEQ ID NO: 12188 - protein, 19 aa, Artificial Sequence
  Description of Artificial Sequence: Synthetic peptide
  XENP018144 vhCDR2
EIRLKSNNYATHYAEPVKG

SEQ ID NO: 12189 - protein, 11 aa, Artificial Sequence
  Description of Artificial Sequence: Synthetic peptide
  XENP018144 vhCDR3
YYGNYGGYFDV

SEQ ID NO: 12190 - protein, 214 aa, Artificial Sequence; identical to SEQ ID NO: 11550
  Description of Artificial Sequence: Synthetic polypeptide
  XENP018144 1G6_H1.47_L1_IgG1_PVA_/S267K Light Chain

SEQ ID NO: 12191 - protein, 107 aa, Artificial Sequence; identical to SEQ ID NO: 6247
  Description of Artificial Sequence: Synthetic polypeptide
  VL of XENP018144

SEQ ID NO: 12192 - protein, 11 aa, Artificial Sequence
  Description of Artificial Sequence: Synthetic peptide
  XENP018144 vlCDR1
RASQSVSNDVA

SEQ ID NO: 12193 - protein, 7 aa, Artificial Sequence
  Description of Artificial Sequence: Synthetic peptide
  XENP018144 vlCDR2
YASHRYT

SEQ ID NO: 12194 - protein, 9 aa, Artificial Sequence
  Description of Artificial Sequence: Synthetic peptide
  XENP018144 vlCDR3
QQDYSSPRT

SEQ ID NO: 12195 - protein, 451 aa, Artificial Sequence
  Description of Artificial Sequence: Synthetic polypeptide
  XENP018145 1G6_H1.48_L1_IgG1_PVA_/S267K Heavy Chain
EVQLVESGGGLVKPGGSLRLSCAASGFTFSNYWMNWVRKAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12196 - protein, 122 aa, Artificial Sequence; identical to SEQ ID NO: 6786
  Description of Artificial Sequence: Synthetic polypeptide
  VH of XENP018145

SEQ ID NO: 12197 - protein, 5 aa, Artificial Sequence
  Description of Artificial Sequence: Synthetic peptide
  XENP018145 vhCDR1
NYWMN

SEQ ID NO: 12198 - protein, 19 aa, Artificial Sequence
  Description of Artificial Sequence: Synthetic peptide
  XENP018145 vhCDR2
EIRLKSNNYATHYAEPVKG

SEQ ID NO: 12199 - protein, 11 aa, Artificial Sequence
  Description of Artificial Sequence: Synthetic peptide
  XENP018145 vhCDR3
YYGNYGGYFDV

SEQ ID NO: 12200 - protein, 214 aa, Artificial Sequence; identical to SEQ ID NO: 11550
  Description of Artificial Sequence: Synthetic polypeptide
  XENP018145 1G6_H1.48_L1_IgG1_PVA_/S267K Light Chain

SEQ ID NO: 12201 - protein, 107 aa, Artificial Sequence; identical to SEQ ID NO: 6247
  Description of Artificial Sequence: Synthetic polypeptide
  VL of XENP018145

SEQ ID NO: 12202 - protein, 11 aa, Artificial Sequence
  Description of Artificial Sequence: Synthetic peptide
  XENP018145 vlCDR1
RASQSVSNDVA

SEQ ID NO: 12203 - protein, 7 aa, Artificial Sequence
  Description of Artificial Sequence: Synthetic peptide
  XENP018145 vlCDR2
YASHRYT

SEQ ID NO: 12204 - protein, 9 aa, Artificial Sequence
  Description of Artificial Sequence: Synthetic peptide
  XENP018145 vlCDR3
QQDYSSPRT

SEQ ID NO: 12205 - protein, 451 aa, Artificial Sequence
  Description of Artificial Sequence: Synthetic polypeptide
  XENP018146 1G6_H1.49_L1_IgG1_PVA_/S267K Heavy Chain
EVQLVESGGGLVKPGGSLRLSCAASGFTFSNYWMNWVRQSPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12206 - protein, 122 aa, Artificial Sequence; identical to SEQ ID NO: 6792
  Description of Artificial Sequence: Synthetic polypeptide
  VH of XENP018146

SEQ ID NO: 12207 - protein, 5 aa, Artificial Sequence
  Description of Artificial Sequence: Synthetic peptide
  XENP018146 vhCDR1
NYWMN

SEQ ID NO: 12208 - protein, 19 aa, Artificial Sequence
  Description of Artificial Sequence: Synthetic peptide
  XENP018146 vhCDR2
EIRLKSNNYATHYAEPVKG

SEQ ID NO: 12209 - protein, 11 aa, Artificial Sequence
  Description of Artificial Sequence: Synthetic peptide
  XENP018146 vhCDR3
YYGNYGGYFDV

SEQ ID NO: 12210 - protein, 214 aa, Artificial Sequence; identical to SEQ ID NO: 11550
  Description of Artificial Sequence: Synthetic polypeptide
  XENP018146 1G6_H1.49_L1_IgG1_PVA_/S267K Light Chain

SEQ ID NO: 12211 - protein, 107 aa, Artificial Sequence; identical to SEQ ID NO: 6247
  Description of Artificial Sequence: Synthetic polypeptide
  VL of XENP018146

SEQ ID NO: 12212 - protein, 11 aa, Artificial Sequence
  Description of Artificial Sequence: Synthetic peptide
  XENP018146 vlCDR1
RASQSVSNDVA

SEQ ID NO: 12213 - protein, 7 aa, Artificial Sequence
  Description of Artificial Sequence: Synthetic peptide
  XENP018146 vlCDR2
YASHRYT

SEQ ID NO: 12214 - protein, 9 aa, Artificial Sequence
  Description of Artificial Sequence: Synthetic peptide
  XENP018146 vlCDR3
QQDYSSPRT

SEQ ID NO: 12215 - protein, 451 aa, Artificial Sequence
  Description of Artificial Sequence: Synthetic polypeptide
  XENP018147 1G6_H1.50_L1_IgG1_PVA_/S267K Heavy Chain
EVQLVESGGGLVKPGGSLRLSCAASGFTFSNYWMNWVRQAPEKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12216 - protein, 122 aa, Artificial Sequence; identical to SEQ ID NO: 6801
  Description of Artificial Sequence: Synthetic polypeptide
  VH of XENP018147

SEQ ID NO: 12217 - protein, 5 aa, Artificial Sequence
  Description of Artificial Sequence: Synthetic peptide
  XENP018147 vhCDR1
NYWMN

SEQ ID NO: 12218 - protein, 19 aa, Artificial Sequence
  Description of Artificial Sequence: Synthetic peptide
  XENP018147 vhCDR2
EIRLKSNNYATHYAEPVKG

SEQ ID NO: 12219 - protein, 11 aa, Artificial Sequence
  Description of Artificial Sequence: Synthetic peptide
  XENP018147 vhCDR3
YYGNYGGYFDV

SEQ ID NO: 12220 - protein, 214 aa, Artificial Sequence; identical to SEQ ID NO: 11550
  Description of Artificial Sequence: Synthetic polypeptide
  XENP018147 1G6_H1.50_L1_IgG1_PVA_/S267K Light Chain

SEQ ID NO: 12221 - protein, 107 aa, Artificial Sequence; identical to SEQ ID NO: 6247
  Description of Artificial Sequence: Synthetic polypeptide
  VL of XENP018147

SEQ ID NO: 12222 - protein, 11 aa, Artificial Sequence
  Description of Artificial Sequence: Synthetic peptide
  XENP018147 vlCDR1
RASQSVSNDVA

SEQ ID NO: 12223 - protein, 7 aa, Artificial Sequence
  Description of Artificial Sequence: Synthetic peptide
  XENP018147 vlCDR2
YASHRYT

SEQ ID NO: 12224 - protein, 9 aa, Artificial Sequence
  Description of Artificial Sequence: Synthetic peptide
  XENP018147 vlCDR3
QQDYSSPRT

SEQ ID NO: 12225 - protein, 451 aa, Artificial Sequence
  Description of Artificial Sequence: Synthetic polypeptide
  XENP018148 1G6_H1.51_L1_IgG1_PVA_/S267K Heavy Chain
EVQLVESGGGLVKPGGSLRLSCAASGFTFSNYWMNWVRQAPGKGLEYVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12226 - protein, 122 aa, Artificial Sequence; identical to SEQ ID NO: 6810
  Description of Artificial Sequence: Synthetic polypeptide
  VH of XENP018148

SEQ ID NO: 12227 - protein, 5 aa, Artificial Sequence
  Description of Artificial Sequence: Synthetic peptide
  XENP018148 vhCDR1
NYWMN

SEQ ID NO: 12228 - protein, 19 aa, Artificial Sequence
  Description of Artificial Sequence: Synthetic peptide
  XENP018148 vhCDR2
EIRLKSNNYATHYAEPVKG

SEQ ID NO: 12229 - protein, 11 aa, Artificial Sequence
  Description of Artificial Sequence: Synthetic peptide
  XENP018148 vhCDR3
YYGNYGGYFDV

SEQ ID NO: 12230 - protein, 214 aa, Artificial Sequence; identical to SEQ ID NO: 11550
  Description of Artificial Sequence: Synthetic polypeptide
  XENP018148 1G6_H1.51_L1_IgG1_PVA_/S267K Light Chain

SEQ ID NO: 12231 - protein, 107 aa, Artificial Sequence; identical to SEQ ID NO: 6247
  Description of Artificial Sequence: Synthetic polypeptide
  VL of XENP018148

SEQ ID NO: 12232 - protein, 11 aa, Artificial Sequence
  Description of Artificial Sequence: Synthetic peptide
  XENP018148 vlCDR1
RASQSVSNDVA

SEQ ID NO: 12233 - protein, 7 aa, Artificial Sequence
  Description of Artificial Sequence: Synthetic peptide
  XENP018148 vlCDR2
YASHRYT

SEQ ID NO: 12234 - protein, 9 aa, Artificial Sequence
  Description of Artificial Sequence: Synthetic peptide
  XENP018148 vlCDR3
QQDYSSPRT

SEQ ID NO: 12235 - protein, 451 aa, Artificial Sequence
  Description of Artificial Sequence: Synthetic polypeptide
  XENP018149 1G6_H1.52_L1_IgG1_PVA_/S267K Heavy Chain
EVQLVESGGGLVKPGGSLRLSCAASGFTFSNYWMNWVRQAPGKGLEWVAEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12236 - protein, 122 aa, Artificial Sequence; identical to SEQ ID NO: 6819
  Description of Artificial Sequence: Synthetic polypeptide
  VH of XENP018149

SEQ ID NO: 12237 - protein, 5 aa, Artificial Sequence
  Description of Artificial Sequence: Synthetic peptide
  XENP018149 vhCDR1
NYWMN

SEQ ID NO: 12238 - protein, 19 aa, Artificial Sequence
  Description of Artificial Sequence: Synthetic peptide
  XENP018149 vhCDR2
EIRLKSNNYATHYAEPVKG

SEQ ID NO: 12239 - protein, 11 aa, Artificial Sequence
  Description of Artificial Sequence: Synthetic peptide
  XENP018149 vhCDR3
YYGNYGGYFDV

SEQ ID NO: 12240 - protein, 214 aa, Artificial Sequence; identical to SEQ ID NO: 11550
  Description of Artificial Sequence: Synthetic polypeptide
  XENP018149 1G6_H1.52_L1_IgG1_PVA_/S267K Light Chain

SEQ ID NO: 12241 - protein, 107 aa, Artificial Sequence; identical to SEQ ID NO: 6247
  Description of Artificial Sequence: Synthetic polypeptide
  VL of XENP018149

SEQ ID NO: 12242 - protein, 11 aa, Artificial Sequence
  Description of Artificial Sequence: Synthetic peptide
  XENP018149 vlCDR1
RASQSVSNDVA

SEQ ID NO: 12243 - protein, 7 aa, Artificial Sequence
  Description of Artificial Sequence: Synthetic peptide
  XENP018149 vlCDR2
YASHRYT

SEQ ID NO: 12244 - protein, 9 aa, Artificial Sequence
  Description of Artificial Sequence: Synthetic peptide
  XENP018149 vlCDR3
QQDYSSPRT

SEQ ID NO: 12245 - protein, 451 aa, Artificial Sequence
  Description of Artificial Sequence: Synthetic polypeptide
  XENP018150 1G6_H1.53_L1_IgG1_PVA_/S267K Heavy Chain
EVQLVESGGGLVKPGGSLRLSCAASGFTFSNYWMNWVRQAPGKGLEWVSEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12246 - protein, 122 aa, Artificial Sequence; identical to SEQ ID NO: 6828
  Description of Artificial Sequence: Synthetic polypeptide
  VH of XENP018150

SEQ ID NO: 12247 - protein, 5 aa, Artificial Sequence
  Description of Artificial Sequence: Synthetic peptide
  XENP018150 vhCDR1
NYWMN

SEQ ID NO: 12248 - protein, 19 aa, Artificial Sequence
  Description of Artificial Sequence: Synthetic peptide
  XENP018150 vhCDR2
EIRLKSNNYATHYAEPVKG

SEQ ID NO: 12249 - protein, 11 aa, Artificial Sequence
  Description of Artificial Sequence: Synthetic peptide
  XENP018150 vhCDR3
YYGNYGGYFDV

SEQ ID NO: 12250 - protein, 214 aa, Artificial Sequence; identical to SEQ ID NO: 11550
  Description of Artificial Sequence: Synthetic polypeptide
  XENP018150 1G6_H1.53_L1_IgG1_PVA_/S267K Light Chain

SEQ ID NO: 12251 - protein, 107 aa, Artificial Sequence; identical to SEQ ID NO: 6247
  Description of Artificial Sequence: Synthetic polypeptide
  VL of XENP018150

SEQ ID NO: 12252 - protein, 11 aa, Artificial Sequence
  Description of Artificial Sequence: Synthetic peptide
  XENP018150 vlCDR1
RASQSVSNDVA

SEQ ID NO: 12253 - protein, 7 aa, Artificial Sequence
  Description of Artificial Sequence: Synthetic peptide
  XENP018150 vlCDR2
YASHRYT

SEQ ID NO: 12254 - protein, 9 aa, Artificial Sequence
  Description of Artificial Sequence: Synthetic peptide
  XENP018150 vlCDR3
QQDYSSPRT

SEQ ID NO: 12255 - protein, 451 aa, Artificial Sequence
  Description of Artificial Sequence: Synthetic polypeptide
  XENP018151 1G6_H1.54_L1_IgG1_PVA_/S267K Heavy Chain
EVQLVESGGGLVKPGGSLRLSCAASGFTFSNYWMNWVRQAPGKGLEWVGQIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12256 - protein, 122 aa, Artificial Sequence; identical to SEQ ID NO: 6837
  Description of Artificial Sequence: Synthetic polypeptide
  VH of XENP018151

SEQ ID NO: 12257 - protein, 5 aa, Artificial Sequence
  Description of Artificial Sequence: Synthetic peptide
  XENP018151 vhCDR1
NYWMN

SEQ ID NO: 12258 - protein, 19 aa, Artificial Sequence
  Description of Artificial Sequence: Synthetic peptide
  XENP018151 vhCDR2
QIRLKSNNYATHYAEPVKG

SEQ ID NO: 12259 - protein, 11 aa, Artificial Sequence
  Description of Artificial Sequence: Synthetic peptide
  XENP018151 vhCDR3
YYGNYGGYFDV

SEQ ID NO: 12260 - protein, 214 aa, Artificial Sequence; identical to SEQ ID NO: 11550
  Description of Artificial Sequence: Synthetic polypeptide
  XENP018151 1G6_H1.54_L1_IgG1_PVA_/S267K Light Chain

SEQ ID NO: 12261 - protein, 107 aa, Artificial Sequence; identical to SEQ ID NO: 6247
  Description of Artificial Sequence: Synthetic polypeptide
  VL of XENP018151

SEQ ID NO: 12262 - protein, 11 aa, Artificial Sequence
  Description of Artificial Sequence: Synthetic peptide
  XENP018151 vlCDR1
RASQSVSNDVA

SEQ ID NO: 12263 - protein, 7 aa, Artificial Sequence
  Description of Artificial Sequence: Synthetic peptide
  XENP018151 vlCDR2
YASHRYT

SEQ ID NO: 12264 - protein, 9 aa, Artificial Sequence
  Description of Artificial Sequence: Synthetic peptide
  XENP018151 vlCDR3
QQDYSSPRT

SEQ ID NO: 12265 - protein, 451 aa, Artificial Sequence
  Description of Artificial Sequence: Synthetic polypeptide
  XENP018152 1G6_H1.55_L1_IgG1_PVA_/S267K Heavy Chain
EVQLVESGGGLVKPGGSLRLSCAASGFTFSNYWMNWVRQAPGKGLEWVGDIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12266 - protein, 122 aa, Artificial Sequence; identical to SEQ ID NO: 6846
  Description of Artificial Sequence: Synthetic polypeptide
  VH of XENP018152

SEQ ID NO: 12267 - protein, 5 aa, Artificial Sequence
  Description of Artificial Sequence: Synthetic peptide
  XENP018152 vhCDR1
NYWMN

SEQ ID NO: 12268 - protein, 19 aa, Artificial Sequence
  Description of Artificial Sequence: Synthetic peptide
  XENP018152 vhCDR2
DIRLKSNNYATHYAEPVKG

SEQ ID NO: 12269 - protein, 11 aa, Artificial Sequence
  Description of Artificial Sequence: Synthetic peptide
  XENP018152 vhCDR3
YYGNYGGYFDV

SEQ ID NO: 12270 - protein, 214 aa, Artificial Sequence; identical to SEQ ID NO: 11550
  Description of Artificial Sequence: Synthetic polypeptide
  XENP018152 1G6_H1.55_L1_IgG1_PVA_/S267K Light Chain

SEQ ID NO: 12271 - protein, 107 aa, Artificial Sequence; identical to SEQ ID NO: 6247
  Description of Artificial Sequence: Synthetic polypeptide
  VL of XENP018152

SEQ ID NO: 12272 - protein, 11 aa, Artificial Sequence
  Description of Artificial Sequence: Synthetic peptide
  XENP018152 vlCDR1
RASQSVSNDVA

SEQ ID NO: 12273 - protein, 7 aa, Artificial Sequence
  Description of Artificial Sequence: Synthetic peptide
  XENP018152 vlCDR2
YASHRYT

SEQ ID NO: 12274 - protein, 9 aa, Artificial Sequence
  Description of Artificial Sequence: Synthetic peptide
  XENP018152 vlCDR3
QQDYSSPRT

SEQ ID NO: 12275 - protein, 451 aa, Artificial Sequence
  Description of Artificial Sequence: Synthetic polypeptide
  XENP018153 1G6_H1.56_L1_IgG1_PVA_/S267K Heavy Chain
EVQLVESGGGLVKPGGSLRLSCAASGFTFSNYWMNWVRQAPGKGLEWVGKIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12276 - protein, 122 aa, Artificial Sequence; identical to SEQ ID NO: 6855
  Description of Artificial Sequence: Synthetic polypeptide
  VH of XENP018153

SEQ ID NO: 12277 - protein, 5 aa, Artificial Sequence
  Description of Artificial Sequence: Synthetic peptide
  XENP018153 vhCDR1
NYWMN

SEQ ID NO: 12278 - protein, 19 aa, Artificial Sequence
  Description of Artificial Sequence: Synthetic peptide
  XENP018153 vhCDR2
KIRLKSNNYATHYAEPVKG

SEQ ID NO: 12279 - protein, 11 aa, Artificial Sequence
  Description of Artificial Sequence: Synthetic peptide
  XENP018153 vhCDR3
YYGNYGGYFDV

SEQ ID NO: 12280 - protein, 214 aa, Artificial Sequence; identical to SEQ ID NO: 11550
  Description of Artificial Sequence: Synthetic polypeptide
  XENP018153 1G6_H1.56_L1_IgG1_PVA_/S267K Light Chain

SEQ ID NO: 12281 - protein, 107 aa, Artificial Sequence; identical to SEQ ID NO: 6247
  Description of Artificial Sequence: Synthetic polypeptide
  VL of XENP018153

SEQ ID NO: 12282 - protein, 11 aa, Artificial Sequence
  Description of Artificial Sequence: Synthetic peptide
  XENP018153 vlCDR1
RASQSVSNDVA

SEQ ID NO: 12283 - protein, 7 aa, Artificial Sequence
  Description of Artificial Sequence: Synthetic peptide
  XENP018153 vlCDR2
YASHRYT

SEQ ID NO: 12284 - protein, 9 aa, Artificial Sequence
  Description of Artificial Sequence: Synthetic peptide
  XENP018153 vlCDR3
QQDYSSPRT

SEQ ID NO: 12285 - protein, 451 aa, Artificial Sequence
  Description of Artificial Sequence: Synthetic polypeptide
  XENP018154 1G6_H1.57_L1_IgG1_PVA_/S267K Heavy Chain
EVQLVESGGGLVKPGGSLRLSCAASGFTFSNYWMNWVRQAPGKGLEWVGSIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12286 - protein, 122 aa, Artificial Sequence; identical to SEQ ID NO: 6864
  Description of Artificial Sequence: Synthetic polypeptide
  VH of XENP018154

SEQ ID NO: 12287 - protein, 5 aa, Artificial Sequence
  Description of Artificial Sequence: Synthetic peptide
  XENP018154 vhCDR1
NYWMN

SEQ ID NO: 12288 - protein, 19 aa, Artificial Sequence
  Description of Artificial Sequence: Synthetic peptide
  XENP018154 vhCDR2
SIRLKSNNYATHYAEPVKG

SEQ ID NO: 12289 - protein, 11 aa, Artificial Sequence
  Description of Artificial Sequence: Synthetic peptide
  XENP018154 vhCDR3
YYGNYGGYFDV

SEQ ID NO: 12290 - protein, 214 aa, Artificial Sequence; identical to SEQ ID NO: 11550
  Description of Artificial Sequence: Synthetic polypeptide
  XENP018154 1G6_H1.57_L1_IgG1_PVA_/S267K Light Chain

SEQ ID NO: 12291 - protein, 107 aa, Artificial Sequence; identical to SEQ ID NO: 6247
  Description of Artificial Sequence: Synthetic polypeptide
  VL of XENP018154

SEQ ID NO: 12292 - protein, 11 aa, Artificial Sequence
  Description of Artificial Sequence: Synthetic peptide
  XENP018154 vlCDR1
RASQSVSNDVA

SEQ ID NO: 12293 - protein, 7 aa, Artificial Sequence
  Description of Artificial Sequence: Synthetic peptide
  XENP018154 vlCDR2
YASHRYT

SEQ ID NO: 12294 - protein, 9 aa, Artificial Sequence
  Description of Artificial Sequence: Synthetic peptide
  XENP018154 vlCDR3
QQDYSSPRT

SEQ ID NO: 12295 - protein, 451 aa, Artificial Sequence
  Description of Artificial Sequence: Synthetic polypeptide
  XENP018155 1G6_H1.58_L1_IgG1_PVA_/S267K Heavy Chain
EVQLVESGGGLVKPGGSLRLSCAASGFTFSNYWMNWVRQAPGKGLEWVGHIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12296 - protein, 122 aa, Artificial Sequence; identical to SEQ ID NO: 6873
  Description of Artificial Sequence: Synthetic polypeptide
  VH of XENP018155

SEQ ID NO: 12297 - protein, 5 aa, Artificial Sequence
  Description of Artificial Sequence: Synthetic peptide
  XENP018155 vhCDR1
NYWMN

SEQ ID NO: 12298 - protein, 19 aa, Artificial Sequence
  Description of Artificial Sequence: Synthetic peptide
  XENP018155 vhCDR2
HIRLKSNNYATHYAEPVKG

SEQ ID NO: 12299 - protein, 11 aa, Artificial Sequence
  Description of Artificial Sequence: Synthetic peptide
  XENP018155 vhCDR3
YYGNYGGYFDV

SEQ ID NO: 12300 - protein, 214 aa, Artificial Sequence; identical to SEQ ID NO: 11550
  Description of Artificial Sequence: Synthetic polypeptide
  XENP018155 1G6_H1.58_L1_IgG1_PVA_/S267K Light Chain

SEQ ID NO: 12301 - protein, 107 aa, Artificial Sequence; identical to SEQ ID NO: 6247
  Description of Artificial Sequence: Synthetic polypeptide
  VL of XENP018155

SEQ ID NO: 12302 - protein, 11 aa, Artificial Sequence
  Description of Artificial Sequence: Synthetic peptide
  XENP018155 vlCDR1
RASQSVSNDVA

SEQ ID NO: 12303 - protein, 7 aa, Artificial Sequence
  Description of Artificial Sequence: Synthetic peptide
  XENP018155 vlCDR2
YASHRYT

SEQ ID NO: 12304 - protein, 9 aa, Artificial Sequence
  Description of Artificial Sequence: Synthetic peptide
  XENP018155 vlCDR3
QQDYSSPRT

SEQ ID NO: 12305 - protein, 451 aa, Artificial Sequence
  Description of Artificial Sequence: Synthetic polypeptide
  XENP018156 1G6_H1.59_L1_IgG1_PVA_/S267K Heavy Chain
EVQLVESGGGLVKPGGSLRLSCAASGFTFSNYWMNWVRQAPGKGLEWVGAIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12306 - protein, 122 aa, Artificial Sequence; identical to SEQ ID NO: 6882
  Description of Artificial Sequence: Synthetic polypeptide
  VH of XENP018156

SEQ ID NO: 12307 - protein, 5 aa, Artificial Sequence
  Description of Artificial Sequence: Synthetic peptide
  XENP018156 vhCDR1
NYWMN

SEQ ID NO: 12308 - protein, 19 aa, Artificial Sequence
  Description of Artificial Sequence: Synthetic peptide
  XENP018156 vhCDR2
AIRLKSNNYATHYAEPVKG

SEQ ID NO: 12309 - protein, 11 aa, Artificial Sequence
  Description of Artificial Sequence: Synthetic peptide
  XENP018156 vhCDR3
YYGNYGGYFDV

SEQ ID NO: 12310 - protein, 214 aa, Artificial Sequence; identical to SEQ ID NO: 11550
  Description of Artificial Sequence: Synthetic polypeptide
  XENP018156 1G6_H1.59_L1_IgG1_PVA_/S267K Light Chain

SEQ ID NO: 12311 - protein, 107 aa, Artificial Sequence; identical to SEQ ID NO: 6247
  Description of Artificial Sequence: Synthetic polypeptide
  VL of XENP018156

SEQ ID NO: 12312 - protein, 11 aa, Artificial Sequence
  Description of Artificial Sequence: Synthetic peptide
  XENP018156 vlCDR1
RASQSVSNDVA

SEQ ID NO: 12313 - protein, 7 aa, Artificial Sequence
  Description of Artificial Sequence: Synthetic peptide
  XENP018156 vlCDR2
YASHRYT

SEQ ID NO: 12314 - protein, 9 aa, Artificial Sequence
  Description of Artificial Sequence: Synthetic peptide
  XENP018156 vlCDR3
QQDYSSPRT

SEQ ID NO: 12315 - protein, 451 aa, Artificial Sequence
  Description of Artificial Sequence: Synthetic polypeptide
  XENP018157 1G6_H1.60_L1_IgG1_PVA_/S267K Heavy Chain
EVQLVESGGGLVKPGGSLRLSCAASGFTFSNYWMNWVRQAPGKGLEWVGGIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12316 - protein, 122 aa, Artificial Sequence; identical to SEQ ID NO: 6891
  Description of Artificial Sequence: Synthetic polypeptide
  VH of XENP018157

SEQ ID NO: 12317 - protein, 5 aa, Artificial Sequence
  Description of Artificial Sequence: Synthetic peptide
  XENP018157 vhCDR1
NYWMN

SEQ ID NO: 12318 - protein, 19 aa, Artificial Sequence
  Description of Artificial Sequence: Synthetic peptide
  XENP018157 vhCDR2
GIRLKSNNYATHYAEPVKG

SEQ ID NO: 12319 - protein, 11 aa, Artificial Sequence
  Description of Artificial Sequence: Synthetic peptide
  XENP018157 vhCDR3
YYGNYGGYFDV

SEQ ID NO: 12320 - protein, 214 aa, Artificial Sequence; identical to SEQ ID NO: 11550
  Description of Artificial Sequence: Synthetic polypeptide
  XENP018157 1G6_H1.60_L1_IgG1_PVA_/S267K Light Chain

SEQ ID NO: 12321 - protein, 107 aa, Artificial Sequence; identical to SEQ ID NO: 6247
  Description of Artificial Sequence: Synthetic polypeptide
  VL of XENP018157

SEQ ID NO: 12322 - protein, 11 aa, Artificial Sequence
  Description of Artificial Sequence: Synthetic peptide
  XENP018157 vlCDR1
RASQSVSNDVA

SEQ ID NO: 12323 - protein, 7 aa, Artificial Sequence
  Description of Artificial Sequence: Synthetic peptide
  XENP018157 vlCDR2
YASHRYT

SEQ ID NO: 12324 - protein, 9 aa, Artificial Sequence
  Description of Artificial Sequence: Synthetic peptide
  XENP018157 vlCDR3
QQDYSSPRT

SEQ ID NO: 12325 - protein, 451 aa, Artificial Sequence
  Description of Artificial Sequence: Synthetic polypeptide
  XENP018158 1G6_H1.61_L1_IgG1_PVA_/S267K Heavy Chain
EVQLVESGGGLVKPGGSLRLSCAASGFTFSNYWMNWVRQAPGKGLEWVGYIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12326 - protein, 122 aa, Artificial Sequence; identical to SEQ ID NO: 6900
  Description of Artificial Sequence: Synthetic polypeptide
  VH of XENP018158

SEQ ID NO: 12327 - protein, 5 aa, Artificial Sequence
  Description of Artificial Sequence: Synthetic peptide
  XENP018158 vhCDR1
NYWMN

SEQ ID NO: 12328 - protein, 19 aa, Artificial Sequence
  Description of Artificial Sequence: Synthetic peptide
  XENP018158 vhCDR2
YIRLKSNNYATHYAEPVKG

SEQ ID NO: 12329 - protein, 11 aa, Artificial Sequence
  Description of Artificial Sequence: Synthetic peptide
  XENP018158 vhCDR3
YYGNYGGYFDV

SEQ ID NO: 12330 - protein, 214 aa, Artificial Sequence; identical to SEQ ID NO: 11550
  Description of Artificial Sequence: Synthetic polypeptide
  XENP018158 1G6_H1.61_L1_IgG1_PVA_/S267K Light Chain

SEQ ID NO: 12331 - protein, 107 aa, Artificial Sequence; identical to SEQ ID NO: 6247
  Description of Artificial Sequence: Synthetic polypeptide
  VL of XENP018158

SEQ ID NO: 12332 - protein, 11 aa, Artificial Sequence
  Description of Artificial Sequence: Synthetic peptide
  XENP018158 vlCDR1
RASQSVSNDVA

SEQ ID NO: 12333 - protein, 7 aa, Artificial Sequence
  Description of Artificial Sequence: Synthetic peptide
  XENP018158 vlCDR2
YASHRYT

SEQ ID NO: 12334 - protein, 9 aa, Artificial Sequence
  Description of Artificial Sequence: Synthetic peptide
  XENP018158 vlCDR3
QQDYSSPRT

SEQ ID NO: 12335 - protein, 451 aa, Artificial Sequence
  Description of Artificial Sequence: Synthetic polypeptide
  XENP018159 1G6_H1.62_L1_IgG1_PVA_/S267K Heavy Chain
EVQLVESGGGLVKPGGSLRLSCAASGFTFSNYWMNWVRQAPGKGLEWVGIIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12336 - protein, 122 aa, Artificial Sequence; identical to SEQ ID NO: 6909
  Description of Artificial Sequence: Synthetic polypeptide
  VH of XENP018159

SEQ ID NO: 12337 - protein, 5 aa, Artificial Sequence
  Description of Artificial Sequence: Synthetic peptide
  XENP018159 vhCDR1
NYWMN

SEQ ID NO: 12338 - protein, 19 aa, Artificial Sequence
  Description of Artificial Sequence: Synthetic peptide
  XENP018159 vhCDR2
IIRLKSNNYATHYAEPVKG

SEQ ID NO: 12339 - protein, 11 aa, Artificial Sequence
  Description of Artificial Sequence: Synthetic peptide
  XENP018159 vhCDR3
YYGNYGGYFDV

SEQ ID NO: 12340 - protein, 214 aa, Artificial Sequence; identical to SEQ ID NO: 11550
  Description of Artificial Sequence: Synthetic polypeptide
  XENP018159 1G6_H1.62_L1_IgG1_PVA_/S267K Light Chain

SEQ ID NO: 12341 - protein, 107 aa, Artificial Sequence; identical to SEQ ID NO: 6247
  Description of Artificial Sequence: Synthetic polypeptide
  VL of XENP018159

SEQ ID NO: 12342 - protein, 11 aa, Artificial Sequence
  Description of Artificial Sequence: Synthetic peptide
  XENP018159 vlCDR1
RASQSVSNDVA

SEQ ID NO: 12343 - protein, 7 aa, Artificial Sequence
  Description of Artificial Sequence: Synthetic peptide
  XENP018159 vlCDR2
YASHRYT

SEQ ID NO: 12344 - protein, 9 aa, Artificial Sequence
  Description of Artificial Sequence: Synthetic peptide
  XENP018159 vlCDR3
QQDYSSPRT

SEQ ID NO: 12345 - protein, 451 aa, Artificial Sequence
  Description of Artificial Sequence: Synthetic polypeptide
  XENP018160 1G6_H1.63_L1_IgG1_PVA_/S267K Heavy Chain
EVQLVESGGGLVKPGGSLRLSCAASGFTFSNYWMNWVRQAPGKGLEWVGEVRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12346 - protein, 122 aa, Artificial Sequence; identical to SEQ ID NO: 6918
  Description of Artificial Sequence: Synthetic polypeptide
  VH of XENP018160

SEQ ID NO: 12347 - protein, 5 aa, Artificial Sequence
  Description of Artificial Sequence: Synthetic peptide
  XENP018160 vhCDR1
NYWMN

SEQ ID NO: 12348 - protein, 19 aa, Artificial Sequence
  Description of Artificial Sequence: Synthetic peptide
  XENP018160 vhCDR2
EVRLKSNNYATHYAEPVKG

SEQ ID NO: 12349 - protein, 11 aa, Artificial Sequence
  Description of Artificial Sequence: Synthetic peptide
  XENP018160 vhCDR3
YYGNYGGYFDV

SEQ ID NO: 12350 - protein, 214 aa, Artificial Sequence; identical to SEQ ID NO: 11550
  Description of Artificial Sequence: Synthetic polypeptide
  XENP018160 1G6_H1.63_L1_IgG1_PVA_/S267K Light Chain

SEQ ID NO: 12351 - protein, 107 aa, Artificial Sequence; identical to SEQ ID NO: 6247
  Description of Artificial Sequence: Synthetic polypeptide
  VL of XENP018160

(The sequence listing continues in the following parts.)

The invention claimed is:

1. A composition comprising a Programmed Cell Death 1 (PD-1) binding domain, the PD-1 binding domain comprising:
   a) a light chain variable domain comprising a vhCDR1 having SEQ ID NO: 37778; a vhCDR2 having SEQ ID NO: 37779, and a vhCDR3 having SEQ ID NO: 37780; and
   b) a heavy chain variable domain comprising a vlCDR1 having SEQ ID NO: 37782, a vlCDR2 having SEQ ID NO: 37783, and a vlCDR3 having SEQ ID NO: 37784.

2. The composition of claim 1, wherein the light chain variable domain has the sequence of SEQ ID NO: 37777 and the heavy chain variable domain has the sequence of SEQ ID NO: 37781.

3. The composition of claim 1, wherein the PD-1 binding domain is a single chain variable fragment (scFv).

4. The composition of claim 3, wherein the scFv has the amino acid sequence of SEQ ID NO: 37785.

5. An antibody comprising a PD-1 binding domain, the PD-1 binding domain comprising:
   a) a light chain variable domain comprising a vhCDR1 having SEQ ID NO: 37778; a vhCDR2 having SEQ ID NO: 37779, and a vhCDR3 having SEQ ID NO: 37780; and
   b) a heavy chain variable domain comprising a vlCDR1 having SEQ ID NO: 37782, a vlCDR2 having SEQ ID NO: 37783, and a vlCDR3 having SEQ ID NO: 37784.

6. The antibody of claim 5, wherein the PD-1 binding domain is an scFv.

7. A bispecific antibody comprising:
   a) a first monomer comprising an anti-PD-1 scFv-linker-CH2-CH3, wherein CH2-CH3 is a first IgG Fc domain and the anti-PD1 scFv comprises a first heavy chain variable domain having the amino acid sequence of SEQ ID NO: 37781, a first light chain variable domain having the amino acid sequence of SEQ ID NO: 37777, and a scFv linker that attaches the first variable heavy chain with the first variable light chain;
   b) a second monomer comprising a VH-CH1-hinge-CH2-CH3, wherein VH is a second heavy chain variable domain and CH2-CH3 is a second IgG Fc domain; and
   c) a light chain comprising a second light chain variable domain, wherein the second heavy chain variable domain and second light chain variable domain form an antigen binding domain.

8. The antibody of claim 7, wherein the anti-PD-1 scFv has the amino acid sequence of SEQ ID NO: 37785.

9. An antibody comprising:
   a) a first monomer comprising a VH1-CH1-linker 1-VL2-scFv linker-VH2-linker 2-CH2-CH3, wherein VL2-scFv linker-VH2 is an anti-PD1 scFV, linker 1 and linker 2 are a first linker and second linker, respectively, and CH2-CH3 is a first IgG Fc domain;
   b) a second monomer comprising a VH1-CH1-hinge-CH2-CH3, wherein VH1 is a first variable heavy domain and CH2-CH3 is a second IgG Fc domain;
   c) a common light chain comprising a first variable light domain (VL1); and
   wherein the first variable heavy domain on the first monomer and the first variable light domain form a first binding domain, and the first variable heavy domain on the second monomer and the first variable light domain form a second binding domain, and
   wherein the VH2 is a second variable heavy domain having the amino acid sequence of SEQ ID NO: 37781 and the VL2 is a second variable light domain having the amino acid sequence of SEQ ID NO: 37777.

10. The heterodimeric antibody of claim 9, wherein the anti-PD-1 scFv has the amino acid sequence of SEQ ID NO: 37785.

11. A nucleic acid composition comprising:
    a) a first nucleic acid encoding the heavy chain variable domain of claim 1; and
    b) a second nucleic acid encoding the light chain variable domain of claim 1.

12. An expression vector composition comprising:
    a) a first expression vector comprising the first nucleic acid of claim 11; and
    b) a second expression vector comprising the second nucleic acid of claim 11.

13. A host cell comprising the expression vector composition of claim 12.

14. A nucleic acid composition comprising:
    a) a first nucleic acid encoding the first monomer of claim 7;
    b) a second nucleic acid encoding the second monomer of claim 7; and
    c) a third nucleic acid encoding the light chain of claim 7.

15. An expression vector composition comprising:
    a) a first expression vector comprising the first nucleic acid of claim 14;
    b) a second expression vector comprising the second nucleic acid of claim 14; and
    c) a third expression vector comprising the third nucleic acid of claim 14.

16. A host cell comprising the expression vector composition of claim 15.

17. A nucleic acid composition comprising:
a) a first nucleic acid encoding the first monomer of claim 9;
b) a second nucleic acid encoding the second monomer of claim 9; and
c) a third nucleic acid encoding the common light chain of claim 9.

18. An expression vector composition comprising:
a) a first expression vector comprising the first nucleic acid of claim 17;
b) a second expression vector comprising the second nucleic acid of claim 17; and
c) a third expression vector comprising the third nucleic acid of claim 17.

19. A host cell comprising the expression vector composition of claim 18.

* * * * *